United States Patent 10,221,454 (METHODS AND COMPOSITIONS FOR SCREENING AND TREATING DEVELOPMENTAL DISORDERS) - sequence listing, part 16

SEQ ID NO: 127 - DNA, 77219 bp, Homo sapiens
caggagttagaagccgctcttcacagagatgacgtggagtttatcagtgacctgattgcctgcctgcttcagggctgctatcaacgaagagatatcacgtgagtaattctgatctttctaagcatttcttgccccaagaactaattaaccaaccatagtgatgtttcctgtctcctgtgacaaaccagaaccgatcattaggcatcacgggacactgtagatggaggacgtacacgtaaatttccaggctgtgtttggcttattctgcagttgggtttttattccatcataatctttgagtttatttcattctcacaaatccatatcacttactcttggataccccagctaacatattttagtgtagaatttcttcttatatttgccattttctgattttgcagtattggtaaagtattgcctaagaaatcaaaactagtttttattacctttctgtcatttgagtatcttctgttgtttacatagccagcagcactgatgtaataaaaaaaaaagagagatgtgtagagacattgagcaaaatgtgatgtatggagacaaataaaggagagtcctgataggacctcttgttttgatctttacttaatacacgtttctttgctatgtgtctatataggacagaactacagggcaaactcacaaaaaggtgagatgcaatgggtttcctggtctcttgccttctgatgccatgtagggggtttgagttgttatggtttgcctttctcagataggtaaaatggtatcaaattttttttttttttttttttttgagacggagtctcactctgtcgcccaggctggagtgcagtggcgcaatcccggctcactgcaagcttcacctcccaggttcacgccattctcctgcctcagcctctcgagtagctgggactacaggcactcgccaccacgcccggctaattttttgtatttttagtggaaatggggtttcaccgtgttagccaggatcgtctcgatctcccgacctcgtgatctgcccgcctcgacctcacaaagtgctgggattacaggcgtgagccaccgcgcctggccaagtatcagatatttttgttctaacgaattcagtctgttagggctgggaaacgatgcttgttgttaatgtgcaataaagttgtagacaaggtaagaaggagatgtaaatgctgtttttctcagggtggaagtctgcattctctaggggagagttattgctcgtgcactaagtataatgacttttccccctagaatacccaggttgtatttgtaaataaaaataaacataaaatataccttagaatattttcttccgttctctatttaggatgtagacttgggagtttgtaatttttaagcactgttgtattcgtaccttgtgtttaattccacattttcataacctggaattttttttcattatagcaatcagtttcttataaccacattttctaaatgtcattgtcaaataatccagtctggtagctgacaagttatgtctagcttttagctgttataaacatatataatgcatagctttgtacaaaattcaccaggttcctggaagtacatcactcagtcaaaagatatgcccatttaagatcttcattttaagcaaggcttaaaggcttttgccaggtttcccgtcacagaggtggttgtattttagccttaaatgatcagtgcgtgagagtgtctgcttggatgatccttgtgagccctctgtacacagactagtaggtactggcagcacaaacactcaccagatctcttagagttcacagttgtgacagggaggtccatgaatcattacagtaatgattatatagttgccagttatgtaattacaacagtaagtgcttagaaataaaaatacaacatattaacagagcatacaacctggggtaagaaagtgacttgtgaactgagccttcacatatgggctgttttctctcataggatattcctccgtggctgagttcatcctctaatttgtccttctgtttaaaattgatcttaactaattctgcttgtttgttcttccagatagtggttacaaagttatgtcctgttctttaagaactccccttatctaatcattctaactagaatcaaataaacctatgaagaaatgtgggcaaaattgacatccctacaatgtggtctttcttttttttttttttttttttgggacagggtcttgctgtttcacccaggctggagtgcagtggcaggatcctgtctcactgtagcctcaacctgggctctagcagtcttcccacctcagcctcctgagtagctcaggacaggactgtgccaccatccccagctgatttttaacaattttttgtagagacaaggtctgtgttccctggctggtcttgaactcctggtctcaagcgatcctgctgccttggcctctcaaagtgctgggattacaggtgtgagccactgtgccttgcccctacaagtatttattaaataatagaataccgtatccctgtatctgtctttaatttgcagagtttattggccttgatttttttcttgagttagtattcttttgactctctaggattattatctatctcttttttcagtgttaatactgatgtctgcttcaagctgtattatccattgttaagtaacaaattaccctaaaacttagcaacttaaaaccacaaaaagtgtaatcttacagtttctgtgggtcaggaacctggacaaaccactactggtgtgtttagctcgagttagcttacaggtctgtgatcaaggtaccagtgacagcagtcatcttgaaacttactactcatgtataatacacacacacacacacacacacacacacacacacacagagaaaagtgctcatttcctaattctaaagctcaatgaattttcacaaactgaacacacctgtgtaacagagaacctggacaagaaagaacactacaatctactttacttttttccctgaagggaattgcctaaaatgatggttccacatgcggttactgtgaatgtacactcgttcttgtctgaagttctactttgatctcattctaaagaaagagaaatttggataagtaaatgtttacctgttatgcctccaagactaaactgttctatgcagcttaaaaagttacttaatttcggccgggcgcagtggctcatgcctataatctcagcactttgggaggccgagacgggcagatcacttgaggtcgggagttcaagagcagtctggccaatgtgatgaaacccggtctctactaaaaatacaaaaattagccaggcgtggtggtgcacgcctgtagtcccagctactcaggaggctgagatgggagaattgcttcaacccgggaggcggaggttgcagtgagccaagatcgcaccattgcactccagcgtgggcgaaagagtgagactccatctcttttttttttaaaaaaaaaaaaggccgggcacggtgcctcacgcctgtaatcccagcactttgggaggtggaggcgggcagatcacgaggtcaggaaatcaagaccatcctggctaacacggtgaaaccccgtctctactaaaaatacaaaaaattagccgggcgtggtggtgggcgcctgtagtcccagctacttgggaggctgaggcatgagaatggcgtgaacccgggaggtggaggttgcagtgagccaagatcgtgtcattgcactccagcctgggtgacagagcgagactctgtctcaaaaaaaaaaaaaaaaaaaaagtaacttcatttagttgtgcataattcgcctcatctataaaatggaattagtgacaatattcagtaaagttattatgaggattaaacgaaatgatgagtgagagtaatcatcatgaaacactatgcctagttcctccaaaggctcagcagaaaacagattttgactcaaccaagtgtctgtatccttttccgttgtggtttgcatgttttagaacaggggccagcaaatgttttttgtaaagggccagatagtcaatacaggcatgcatcacatactgtcattttgttcagtggcagacctcatgtacgacagtggtcacacgaggttgtgatagacacaaaaatttttatcccctagagatattattgcccttgtaacatgcttgcacatgcattactcatgtggttatggtgatgctggtgtaaacaaacctagtgcgctaccagtcatataaagacctagcacttacaggccaggcgtggtggctcacgcctgtaatcctagcactttgggaggccgaggcgggcggatcaccaggtcaggagatcaagaccatcctggctaacacagtgaaaccccatctctactaaagatacaaaaaagtagccgggcgtggtggcggcacctgtagtcccagctactcgggagactgaggcaggagaatggcatgaacctgggaggcggagcttgcaggaagccgagatcacgccactgctctccagcctgggtgacagatcgagactctgtctccaaaaaaaaaaaaaaaaaaaaaaggcgtggcatggtgactcacgcctgcaatcccagcactttgggaggctgaggcaggtggatcacaaggtcagaagatcgagaccatcctggctaacatggtgaaaccccgtctctactaaaaatacaaaaaattagccgggcgtggtggcaggtgcctgtagtcccagctactcgggaggctgaggcaggagaatggcgtgaacccaggaggcagagcttgcagtgagccaagatcatgccaccgtactccagcctgggcgacagagcgagacaagacatagcatataccgtcatgtacactacataatagttgatagtaaacaactcttactggtttctgtatttactatgccgtactttaaatcattattttagagtgtattccttctagttttgtttagtttttttgacacggggtctcactctggcacccaggctggagtgcagtggtgcagtcttggctccctgcaatctccacctcctggtctcaaacgatcttcccacttcagcctcccaagtagctgggactccaggcgtgcaccaccaggcccatctaatttctttattttggggtagaggtagggtttcatcatgttggccatgatggttttgaactcctttttttttttttttttgagacggtgtcctgcctcagcctccccagcagctgggactacaggtgcccaccaccacaccttgctactttttttgtatttttagtagagacggagtttcaccgcattagccaggatggtctcgatctcctgacctcgtgatcctcccaccttggcctcccaaagtgctgggattacaggcgtgagccaccgcgcccagcctagttatttttaaaaagttaactataatatacaacagcctcaggcggtccttcagaagagattccagaagaaggcattgttacaggagatgacagcaccgtgcatgttactgccttgaagacgttccagtgggacaagatgtcgaggtggaagacagtaatattgatgatcctgaccctgtgtcggcctaggccgatgtgtgtgtttttgtcttccttttgaacaaaacagatcaaatgtaaaaaacaaaaaatttcaacaatagaaaacagcttatagaataaggatataaagaaggccgccacacagtggctcatgcctgtaatcccagcactctgggaggatgaggtgagaggacggtttgaggccaggagttcgagaccagcctgggcaacatagcaagactccgtctctactaaaaaataaaaataaatgaattagctgggcaatatagcaagacccctgtctctactaaaaaaattaaaataattatctggacatggtggtgcatgcatgtagtctaagctactagggaggttgaggtgggaggatcaggagttggaggctgcagtgagctacggtccctactgcactctagctgtggctacagagcagaaaaaaaaagaaaaaaatatttttgtatagctctaaaaagtgttttaggctgttattacaaaagaatcaaaaagttaaaagtttgtgaatttttaaatgtcatagtaagctaaatttattattgaaggaaaggttttttttaaaataaacatagtatagcctaagtttacagcatttagaaagtttacagtgatgtacagtcatgtgccaagccttcacattcatttactactcagttactgattcacccagagcaactttagttctgcaagctgcactcatgacaagtgctttatacagatacaccattttaaaaatcttttgtaccatgtccttactataccttttctatgtttagatgtgtctggatccacaaatccttaacattccattacagtggcttacagtattcagtacagtcaggtgcagtataggtttgtagcctaggagcagtgggctatgccatatagtctaggtgtgtagtaggctctaccatctaggtttatgtaaatacactatgatgtttccacagcaacagaatcacctaaccatgcctttcttagaacatatcctttatgttaagcaatgcgtggctattttaggccctcacttgcaacagagtctcactctgttccccaggctggagtgcattcgaccaatcctaacccattgcagcctcaaacttctagattcaagcaatcttcctgcctcagcctcctgatcctgaggaactagtgttacaggtgcacacccaccttgtattttaggctctgtgttgcaggtaatcagctctgtcactatgaaagcagccataggcaatacagaaaaaccaatagtgactgtgtcttattagaactttctaatcactgaggtttgacttttgtatcattttcacctgccaggaaagactgtttttctgttgttgttttttttaattttttttccccaccattaaaaaatataaaaaccattattatagactgttttttgtttgtttgtttgttttgttttgtttttaaaggaggtctggcgcaacgtctcaagcctgtaatcccagcactttgggaggccaaggtgggcggatcacttgaggtcaggagttcgagaccacgtctctactaaaaattcaaaaattagccgggtgtattggcacacgcctgtagtcccagctactctgtaggctgaggcatgagaattgcttgaacctggaaggcagaggttgcagtgagccgagatcatgccacagcactccagcctctgcgacagagcgaaagtgtgtctcaacaaaaaaggacatcaggccagatttggccctcgggctataattttccgactcctgtatttaggaagctagttaactattccagttccactgactcaatctaatctttaaaattgaaatatagaagccacatttcctttcaaccgtactctccaacctgaggtttttgcacttacaggacagcataacactgtctactcatggaaatgatactggccagcatgtcctatgtcctggacgctgccaactgcttctcaagaacactcatttaatccttccgacagccctctaatagaaagtcctctcccatccttccatcagggatgaggaatttgaggcacagagaagttaaataaattgcccaaggttacacagctggtaattgagacagtacagatctgtttcctagacctccgactcctaactgcagccccgtgctgtcaatgagaagtacaggagaaaagtgttaagtaaaacagttttccttgaaaacaggatttttaactctttgacatactaaggaagcctgtgaaccccatctaaaaataatgttttgaaatcataagattacacccgaacccaattatactgaaaagtagtgaagtattggccgggcgtggtggctcacgcctgtaatctcaacactcttgggaggccgaggcaggccgctcacatgaactcaggagttcgagaccagcctgggcaacatggtgaaaccccggctctacaaaaagtattatacaaaaattagtggggtacagtggcgcacacctgtagtcccaggtactcgggaggctgaggcaggagaatcagtggagcccaggaggcggaggttgcagtggagatggtgccactgcactccagcctgggtagcagagtgagaccctgtctccaaaaaagaaaagaaagtaaagtattgaagaatgaaatttttgatatagttagtgttgtattcatctaacagcagagctaatttcccaaaattactgtcttcagatctcagtgagcataagtgctatttggaaatatctgcagtatctatatgatttcagtagaaatcagttatttctgtggacctctgctttaaaacgtgggttttgtttgttctgtttttgttttgaagacgagatctcactcttcagcgcagtcttgagtgctgtggcgcagtcatagctgactgcagcctccaactcctgggctcaagccatcttctcacctcagcctcctaagtagctgagatgacaggcaggcaccaccgtgcccatctaaaagggtttttaaatcctagattgatctgcagttcatagtcaacaacttagacgtaaaaggaacctcatcatcaagtacagtttatttttttacctgaggaagcgaaggcaaaacaaaactggtataagcctgagagacatcgagaataaagtctcaattcaaatgattttttcaggaatttgttcattttgttgccaaaataaagtggtataaagtggtattttcctgggtgtaaggcgtggggctggactccgaggaggcccccgtgatgctgtggaaccctgtgtgcctgtatgtgacacgccactgggggcgtgtcagtcacatgctagtgttcactgtcacactctggagacgccccttgcggcttggatgaagcgtcagccactgggaaagcccacatggctgggaacgcgggtggccttgaggagctgagggcaagccttactacagctgtgcattctccccaggaaaaactaggccattagaaagaatgttaggcaaataatgcaagtcacagaagcatacacaccagtgacttattaagtgtaaggcaaggagaaccaaataaggatacatatatatggaaaacttacgaagaagatcaagtgaaagcttatcgcaattcaggaaagttatcatacctggtgagcagggagaagacggaaggtatgaataagcgcaagtggtgattctccagccttaccacacaatcacctaagggtggttacaacacaaatcgctgggcctcaccagcgtttcattccgtaggcttgggctggggcttgggaacctgcatgctgtgcaagttctgggtggtgctgatgctgcacgctgctggtccaggacttcgctggaaggtcactaatctaaggcattgctcactttctgtttttcagctcgatggtgaaatgtggattcttcatttttgacaattctttgcctttctctttcaatataaaacttaagcagagttttgatttgatgctaacatgttctttgcaacactacatactttttcttctatattctccctggaattgcaaatctggtcagtgggttttatggtcctgtatcaataaaaatactttaggaatttaactagtggctctttcagcacttttgttttccactgggaagtaacctggcaaattgagcactgggtggaaaataggaacttctgatttgctcttcactgtcaaagtaaagctacgattgaatcaaactgtgttttgagctacggtttaagcagcgtaaaaatatttttcattggttgggcgcggtggctcatgcctgtaatcccagcactttgggaggccgaggcgggtggatcactaggtcaggagatagagaccatcctggctaacgcggtgaaaccccgtctgtacttaaaaaatataaaaaatcagccgggtttggtagcgagcacctgtagtcccagctactgaggcaggagagtggtgtgaacccgggaggcagagcttgcagtgagccgagatcgcgccatgcacaagcctgggtgtctcaaaaaaatttttttcattaaatactcatgatgataatacttactgctaaaatgtttttccttttgtccgtacatctttagtagagtgctctttatagaacgcagactgatttgtgcttcagtatggtcttcacccactgtcctgtggcttacactcttaaacggtaattcatcaacattgtatattcaatttttcatgtatttatttatttatttatttatttattttgagagaagtctcgctcttgtcccccaggtttgagtgcaatggcctgatctcgactcactgcaacctccacctcctgggttcaaatgattcttctgcctctgcctcccaagtagctgggattaaggcacccaccatcatgcccggctaatttttgtatttttagtagagacagcgtttcaccatgttgaccaggctggtctcaaactcctgacctcaggtgatctgcccccccttggcctcccaaagtgctgggattacaggcgtgagccaccgcacccggcctcatttaatttttaattatggatctagcattgcgtaatagattccctaatttagatcccttataaacaaacatttagtgttttgggttctctttacagaaatatctgtcatctttttggaaatgacaatacttctgttaagtacgttcatcgtgtcttttttaacataggccagtgttttgtaacaaatgagggcaccacatagtcactatcctactgaagaaaatagacatttctgtcttcccagaaagtttcctttgtagtcagtcttccccatacctacattgtacacctggcaaccactgacgacatttttatcactatagttggagcctaacctgttctagaactgtatgaatgggatcacacagtgtgaaatgaactcacatcagcttctttcattcacatagtgcctgtatgatattcacccatgccattgtttgtatcagtggtttattcctttgaggggggtgggggactaaattgtatctagtgaaaaatatatcacaatttattgaatctgttcttgggatgagcacttaggttgcttccagttggagcctattatgaatgaagctgctgtgaacatttgcatacaaatgcttgtgtgcacttaatttcatttctcttgggaattgctggcgggtcacatggtaaaagtatgtttgacttaaactgtgaaattattttccaaacacttgcaacatttacgtttccaccagcaatatctgaacagtccagttgcttcatatctttttaaatttttatttacttatttatttgtttgagacaagagttttgctctttttgcccaggctggagtgcaatggtgctatctctgctcactgcaacctccacctcaagtgattctcctgcctcagcctcccaagtagctgggattacaggcatgcgccagctaattttttgtatttagtagagacagggtttcaccatgttaatcaagctggtcttgaactcctgacctcaggtgatcacccgcctcggcctcccaaagtactgggattacaggcatgagccacctcgcccggcctagttacttcctatctttgccaacatctgctgtttttaattttactaatcctattgtgttgaaagtggcagctcattgtgggtttaatttgcatttccccgatgactagtaatgtggagtggttattcatgtgcttaccataaatttgtatatgtcttttttggtgaaatatttggccaagtgttttacttatttcttttaaattagggatgcttatttaatttatttattgacttttttgagacagggttcccactctgttacccaggctggagtgcagtgctgtgatcatagcccactgcagcctcgacctcctgggctcaaacagtcctccggcttcagcctcctgagtagctgggactataggtatgctccatcacaccctgcttatttaaagcatatttgttgtagagacaggtcttgatatattgcccaggctggtcttgaactcatggcctcaagttgtcctccagcctcagcctcccaaagtgctggaattacaggcgtgagcagccattccaggccttatcaactttttaaatgtttactaaggaactgttttatattattaattttctttactctttgcttttttattttattgatttctcttttttatttcctctgtttactttggctttagcttgctctttttttttttttgcttctttggagtactgtttttgagccttttttcaaaaaacaggcatttaaagctataaattttccctaaaaaacttttaaatttccttctaacccatagttggctgcatcctgcgaattttgatgtttatattattgtttaaaacatgctctcctttatttcttctgtgacccaaaagtgtattatttaaattcgtgatttagtatgttagtggtaatactgttgagatctgttccttactgttttttttttgtgtgtgtgtgtgtgtgtgtttggtctattaatgagaagccagtattaaaatctctctgattgtggatctatttctcccattagttgtgcccattttgtctcatgggttgtggtgtcctgttattggatgtgtagcggtagctttgttatatagtcctgggaagttgttccatttcttcttatgtgacactctgtctccacatctgctttgtctcatattaatcctcagctttctcatgcttactgtgcctggtagatcattttctatccttttaatctttgtatttttatttatttattttttgagatggcgtcttgctctgtcacccaggctggagtgcagtggtgtgatctcagctcactgcaacctccgcctcctgagtgcaagcaattctcctgcatcagcctcccgagtagctgggattacaggtgcatgccaccacgcccggctaattttttttttatttttattttttatttttagtagagacagggtttcaccatattggccaggctggtctcaaactcctgacttcatgatctgtccacctcagcctcccaaagtgctaggattacaggcatgagccaccatgccaggcctccttgtgtttttttaaagtgtacaattcattggtttttatgtattaacaaaattgtgcaaccatcaccactatctaattgcagaatacttctattaccctacagaagacactttgtaccattagcaatcattccctgtttcctcccacccacttcccagcgtcactattcttactgtctccacaggtttgagtgttgtaggcccatcttataactggagccatatgggaagtgtccttttgtatctggcttttttcacttagagttatttttcaagttttaaccatgttgtagcatgaatcagtacttcattcatttttatggtaaaataatacttcattgtgtggatacacacttaatccttcagttcatgggtatgtacgcagattttagcttttggctgttaggaattctgccgctttgaacatttgtgcgcaagtctttgtgtggatgtgttttccttttctctggggtgtacacctaggagttggagtggctgggttggtagttcagtgcaacttggcgaaacttccacagcagctgcacacttagccttcccaccggccgtgtgtgaggattccgtgtctctgcatcctggtcagcacttgttactgtgtgttttttgacgtcctccattatagtggacatgaggtggtacctcattatggttttgacttgcatttcccaagtggctaaggttgagaaacttctctgctgccttctgctttttgttcctttgttggtcctttaatgctttcttttaggcacatgaatttgttttaagtgtatcactttatttccactattggcttcttattctgtgtgtgtgtgtgtgggggggtgggtgtttagcagtcgtagggcaaacaatatatatccttaaattttatccagagctattcagaatttttattgtacctcttcatgccttatacatgatacttgagacttctcacttcatctgtacagtatttaggttccattaaaaaaatagcctttatcattttaaagatacatttggggtttattcactttcttggttacccaacataaacattcataaacacatgtaaaaatctgtattatgtacatgtttctctaggcaaagatgttttgcagattctgccttaaccatattttcctttaatttgaaataaccatgattttaacttatcttggctgtcatgttgattttagtatgtgggatatagtagctattctacagccctagagaagaagaactgttattttaattattttggcctggtctttttataagcttcgagaataaatgctttatcaagtattcatacagaatcttttacttgttgctttactactagaaccagaatatttatctcaattcagtacttatgttaaacgtggcctgtgtgtacatgtatttcatttgcttcacaaattgttgtagcaaatgggagaatgcaatttgatttttcatcttatctccattctgggaagcctggtgccaaacctttattgctcccctgtagagagaccatggctgccctttcatgtccctaacacatgcctcaaagaacttaagagtcttcttcttgtgatctccccaaacagggtgcagatattaacaatgtgttgtcctacacagtgaagaattctgccagttccagccggcagaggcttgtgctggaacacttgaatcaggtcgtgccgtccttggtctcagcagtagaagcatgttctgtctggagcaagctgagaaattctctgctgggcctctaagaaatggctaactttaagagtttggaaaggttgttgactcattcttattttcactctttcttgctctttcactcatagagggaaaaaaagaggtaattaagagccagtctcttactgctgttttgtaggatggaaaatgaatgcgaaaatgggtcatttaagagtatttggaacttttcctagacaagaaataaaatagaccttgttgttctgagaaattccgtttggtttgatctttgcattactatttttaaatgaaatgttttattatagttcaagataatttcagaatgatgagaattactaagtcattaagagggaattgcaaggagatgaatggatgagtaagtgaatgaatgttccaggtaatctaaacttgagaagcttaaaaatatgtacacattagtttttagcagcacagtgccactgttctttttcctttattttattttactttatattttattttattttatttttgagacagagtctggctctgtcgcccaggctggagtgcagtggtgcaatctcagctcactgcaacctcctcctcctgagttcaagtgattctcctgcctcagcctcccgagtggctgggattacaggcacgtaccaccatgcctggctaatttctgtatttttagtagagacaggctttctctgtgttggccaggctggtctcaaactcctgtcctcaagtgatctgcccatctcggcctcccaaagtgctgggattaccggcgtgagctactgcgcccggcctctttttcctttaaatagtaaaacctgaaagtacatgcaaaattgtgtgctcatttttctgggggagaaagtatgtagtctttatcaaattattaagtgttttctgtcctatagaagatgaagaaccagtaagtcaaaagaattagcctgatttttagcttcctgaagcctttttatttcaaatcacccttagccagtgcctttgccctcaagagatttttccccattcactctctgatgtttaaaaggagatgtagatttctaggagaaggttgatctacatacaaggaaatggaattgtcttggattgtaggccctcaggtgtctcctagttaaggtggcatggagatagatgccttaagaaagcttttagcaaaagtgatgtaatttaaactgagtaggacaataggcctgttgggaaggaatctgaaacatggaattgtttgagacaagtaagggcttccagacagactgttgtctaaaggagcagcactgcggatgcacacgcagtgtttgtgggctggtatgcctgtactttctcaacctcacattggaataagaaaggtctcgctccctggcccagcatcttctgcacatcctccagtgaagctgctattctggtgaaatgatacagatttcactgattccatgttttattttattgcaggaaaaaacagactttagtgtttgtggaacttggtgtacattagaaattctcgaaagcatgcggtagataaagagatttattgccaaaggatgattgtcttctacacacttctggctactaaaaaagcagtttttaaaaaaacactttttcattttctttctttctttctttctttttggagacggcgtttcttcttgcccaggctggagcgcaatggcgcgatcttggctcaccacaacctctgcctcccgggttcaagcgattctcctgcttcagccttccagagtagctgggattacaggcatatgccaccacaaccggctaattttgtatttactttagtagagacggggtttctccatgtcggcctcccaaagtgctgggattacaggcgtgagccaccatgcccggccaaactttttcattttcaaattcaccgttacgacactgtctgcattttaatgtgagtttgaactactctttgcccggctcctcactctggaagggttggtagcaacttcacagacaatggagaggcagccagtccaaaccctgcaaggttcaagcactcagtaatggccggtgctcgtgtgctgaatgtgaatgctgtagtccagtgagatttgtgagagccctgattgttagaactgttacgctgcattttgataaagctgccatactcatgttttcccccgtgagatagtaagagtaggggaaagatgtttcttctctctttgaaaaagcaaactgtttaagtgtttttttgttttttttgagacagcatctcactctgttgcccaggctacagtgcaggggcacaatctcggctcacggcaaactctgcctcccaggttcaagcaattctcctgcctcagcctcctgagtagctgggactacaggcacacgccaccacgcccggctaatttttgtatttatagtagagatgggatttcaccatattggccaggctggtctcaaactcctgacctcgtgatccgcccacctcggcctcccacagtgctgggattacaggcgtgagccaccgcgcccggcaaactgtttaatttcttatttgcctaagccttcttaattttttccacaaatatttcctttcactttgctgcaaatataactaccatagattataagtcaacatagtagttgcctaattttaaaatgataccaataacttctttaggcctctttgcttattaataagaaaaaacttttcacatcaagcatgaggtaaattagatcttgattcttaatagttgagatgtaaaataaccatctaacaaacagcacattattacatggaaggcatatttaggtactaatcaaaatacgtggctgggcacagtggctcacatctgtaatcccagcactctgggaggctaaggcaagcggatcacctgaggtcaggagttcaagactagcctggccaacgtggtgaaaccctgtctttactaaaaatacaaaaattagccggtcatggtggtgggcatctgtaatcctagctactcaggagactgaggcaggagaatcacttgcacccaggaggcagaggttgcagtgagccaagatcacgccattgtactccagcctgggctacaagagcaaaactccattaaaaaaaaaaaaaaaacgggtgtggtggctcacgcctgtaatcccagcacttcgggaggccgaggcgggtggatcatgaggtcaggaaatcgagaccatcctggctaacacagtgaaaccctgtctctactaaaaatacaaaaaattagctgggcgtggtggcaggcgcctgtagtcccagctactcgggaggctgaggcaggagaatggcgtgaacctgggaggcggagcttgcagtgagccaagatcgcaccactgcactccagcctgggtgacagagcaagactctgtctcaaaaaaaaaaaaaaaaaaaaaaaaggtatttacacctggatgtggtaagacgcacttatagtccagatgctctggagaccaaggtgggaggattgcttgagctcaggagtttgagtccagcctggacaatatagtgagaccccatatgggaaaaaatatatttaacacaattatagggtttccagactgtactgaagaaaaaatttaaattgccatctaggtgtcttaaatgttctctgcagaaaaactatcttcaaattttaatatacagacatgggaggattgcttgagccctggagttcaagaccagcctgggcaacatgctgagaccccatctctgaaaaatcaaagaaaggacgggcacggtggctcacgcctgtaatcccagcactttgtgaggacgaggcgggtggatcacgaggtcaggagatcgagaccatcctggttaacacagtgaaacccggtctctactaaaattacaaaaagaaattagccgggcatggtggtgggcgcctctagtcccagctactcgggaggctgaggcaggagaatggcatgaacccgggaggtggagcttgcagtgagctgacatcgagccactgcactccagcctgggtgacagagcgagactctgtctcaaaaaaaaaaagaaagaaagaaaaatcaaagaaaaaaaatttagaatgcagtgttcatgccttaaagttcatgtataatagaatatgaaattatagttgcatatcagtgtagccatttgtattctggaggactttctgcctttgtatcttaacctgaaatataaattaggttaggccaactatgcgtttcttttttccttttttctcgccacctaagtcatgaacccaactttgtactgtctgaaccgcagggtgtcttcagttgtacgcgtagcgggtgagacttttgcctcagcttcataacctacacatttgattatgcttttacccattccaccagaatgtgctattcgggctttaaagtcaacctattctgtgaaaaaccctctttatatatttatcttccttgatagttgacaaaacacaatatccatgtaagtaggctgaaacttcatgagggacttcctgttactgtttttcatttctgctttctgtgtaaaatttgtcaactgggccaagcgtgttacctcacccctgtaatcccagcactttgggaagccaaggcgggcggatcgtgtgagcctgggagcttgagaacagcctgggcaacatagggagacccctgtctctacaaaaaatacaaagattagctgggtgtggtggtgcatgcctgtggtcccaggtacctgggaggttgaggtgggaaaatcttttgagcccaggagagctgcagtgagctgagatcttgccactgtgctctagcctggatgacagagcgagaccctgtctgtataaaaacaaaaatctgttagctgtcagatcatgagttctctctctctctccttctcccaaccaacctatattttatattaatgtatttttgtgtttggggccctggtctaggcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaaggtatgcttaactggcgaacctttccctgtagctgtgaaaagccagcaatcagaaatgtagtcagaacgtaaaacccaaagatactaagccagagtttggcttgtggtactagtcttggtactattcattgccaataacactgtatggaaaaccatgactgctgtagccacggagatgcaagatgtacatccctatggaagtacgttattttggtctaatttctagtctggtttcatcttcctttacgtgcactgagtcctatctgcaataggtacaaccagaggaccctgtttgttctgtcatcagccaaacctgcaactaaatccgccactgagttttatttttcagggtgtaaatttgattgaaatatttactgaaatctccaagaacttgaaaccgtatatgttagtgaaggtcatcctctacacacatccacgttacaaaaaatgtgttgaaggaagctgtggccatctctctgtcccccttggtgtggttatctgtttagaagtatatcctagagggggccgggtgctgtggctcacgcctgtaatcccagcactttgggaggccaaggcaggcagatcacgaagtcaggagatcgagaccatcctggctaacacggtgaaatcccgtctccactaaaagtaaaaaaaaattagccgggcgtggtggcaggcgcctgtagtcccagctactcgggaggctgaggcaggagaatggcatgaacccgggaggcggagcttgcagtgagccgagattgcgccactgcactccagcctgggtgacagagcgagactccgtctttaaaaaaaaaaaaaagtatatcctcaagggagagtgtgggttattgctttcactcatagggaagtcagtttctaatcctgttccatcatcagtgattaaatgtggtgatgacttctcagttgagctctggttatgggcacattataaaaaaatcattgtgtaatttagcacggtctttgctgaggactcaaggacttcagtagcagtgagaaggccagtacaggtcagcccccgaggtaaattgggagccctgtcactggaactcagctggagtgagaggtcacaggaggttatgccggaactgccacagaggatcccatggggcaaagcttgccccgtgcctgatccacccggttgtacttgtctttcttttcgtgtgtgctcacataaaacaaccgctcccagccaaatctgtaaactgttcatcaggattgctgttggattctctcttttttgaaaagggaacaatggtggggatagggagcattgtaatatttccatctcttgttcctcaaagtaggtaccaccttcccattatatccgtgtttcttatgctgattgaaaattacataagatacttggacatttttatttatttatttatttatttattgtttgagacagagtctctctctgtcgcccaggctggagtgcagtggcatgatcttggctcactgcgacctccacctcccaggttcaagcgattctcctgcctcagcctcccgagtagctgggattacaggcgcgcgccaccacgcccagctgattttttgtatttttagtagaggtggggtttcaccatgttggccaggctggtcttgaactcctgaccccatgatttgcccgcctcagcctcccaaagtgctgggattacaggcgtgagccaccacgcccagcgatacttgggcatttttagatttgagttatgcttacgtgtaaatttggaatcctcgttctggttttttcctggtgcgttttgttccccatttccccaaaccccttttccgtgctctgtgtagggcctggatgcagacagtctccgtgtggagccattgggtgaagacaattctggggcactatattggtatttctatggaacacgaatgtacaaagaggacccggtgcaaggaaaatccaatggagaactctctttgagcaggtatgttcttcagtgttagggcatgatagctactgtattaaaatgtcattaagattaaatgcatcagaattctacagcacaatttttttttcctaatgaaggaattctctaagcatgcctgcaaagagatggtaaggagatacttcatgcaaaaacaaaaaggaattaattctctgctaccagaggggttaaatatacttttttaatctgaagttcttgataggaggtttctgagaaatgccactcctcttgccacaggctattttaatatagcaggtttcttctcagcagcacaatcatttcactgcagtaacaatttcatcttgcatcatcagtccttgagatctccttatttcgactagaattaatgatgtagtttatgccaggcgcagtggctcatgcctgtaatcccagcactctgggaggccgaggcgggcggatcacgaggtcaggagatcgagaccatcctggctaatacggtgaaaccctgtctctactaaaaatacaaaaaattagccaggcgtggtggcgggcacctgtagtcccagctactcgggaggctgaggcaggagaatggtgtgaacccgggaggctgatcttgcagtgagccgagatcgcaccactgcactccagcctgggcgacagagcgagactccatcaaaaaaaaaaaaaaaaaaagaatttaatgatgtagtttatgaacgttagtatccatcagtttaagaacagaaggaatttaaatgatgcctgaaacataagctttactaagtaaggaagaggccgcatttccatagcatcccaaaacaatgctaacctcttatttaggctttcttactgctaggagaatgcttactcttcggaaggtgttagttagatcttaagcacattttagtattgcaaaatgttagttttcctcagatccacagtctaataatgaagactggaagttgctgttcccttttcctttcactgctacatttaatcctttttggtaatctcatggccagaaatactgttttaaaatcatatgtagcaatgccaatcctgtgccagaacatttctatttaatattatttattagggaaagtgaaggacaaaaaaatgtctcaagtattcctggaaaaacgggaaaaagaagaggaagacccccaaaacggaagaaactgcaggaggagattctgttgaggtaagaaaatcttgttagttgtggtcatagaccatggcagaagggaccttaattcatttattcctttttctttattttgcctgtgccatgggaagcacattattatagcaacctgaaactgagtccttatgaaattaccacatgtgcagtacagtcaggaagcccttagtgtgtgacatctggcaagtcacctcccctctctaagcgagtcctcttactagacgatggatgtgcacttaatgaggattatattgaacaagacagtttttttcattcttcaattttatatttaattttagcaaagaaagatacttgggggattttcttttatatgtcattatcttctaggaaatttcaccatgtgaatcttgctataggacttttcaaaatctgacctatgctgtgtaaatacactttttacttaaggatcagctctatcactaagcctattgaagtgaggctgtattcttaaaaattctgataactcaggacaagtggcttcttcccttcctacttaatctaaatgcttgagttaggctgaatttcaccctgtcactttttaaccactaagaaatatttctgggaaatcagattaagaatatagatcactcaggagatcgagaccatcctggctaacacggtgaaaccccgtctctactaaaaatacaaaaaattagccagtcgtggtggcgggtgcctgtagtcccagctactcgggaggctgaggcaggagaatgacgtgaacctgggaggcagagcttgcagtgagccgagattatgccactgcactccagcctgggcgacacagcgatactccatctcaaaaaaaaaaagaatgtagatcactcagatcctgattttaactcaatcagcatccacttaactttacagaagttcagcttcagattgcagctgcctatttcttgcttatccgtttctgtgacaaatgtcctgtaattacttaacgttttatgtatcaacacctgtttccgggtttgttaggatttcacacgtccttcgatattcagaaagctgcatgatacctgtctccgtttccccataagtatcaagaatcacagtagcttagggttgggactgtagaatcattttaacaagcatccatggacttgtgctaccctctactggtgacttttttcctttagagctgtgtgtgtaagccagtatttaaatattttttcattaaatttaaaattcagtttctggttcacgctggccacgtttcagatgctcagcagccacatggtttattggataatgccaatatagaacattttcattctcatagaaactttaatcgaaaacaagcgaaaagtccacagagtgtcctttctgtttcagggatacaagtgaaaatgatacttcatcctaatgcgttatacactttgcattttgtcatttaatctccaacgtccctgtgaggtaggcactattaatagctccattttgggggaaagttaattaactttcctgaggtcacattgtaagtggcacagcttgaatagaggcattcccccttcggagcccatgctcttaaccctctgccttaggtaaggatcaattataataaatacacctgtcttcagtgcggccctgaatcagggaggaggacattggaatccctacagttcttttttcttggcatttaattattaacagttgcatctctctcttgactggagcagtgataaaaaacaagaacaaacaaacaaaaaaaacagtgcatctgtttgatttccaaaaaaagctttaaaagttactgttttctggctgggcacggtggctcacgcctgtaatcccaacactttgggaggccaaggcaggcagatcatgaggtcaggagttcaagaccagcctggccaacatggtgaaatcccgtctctactaaaaaatacaaaaattagctgcacctggtggcgggtgcctatagtcccagctactcaggaggctgaggcaggagaatcatttgaacctgggaggcggaggttgcagtgagctgaaatcgcgccattgcactccagcctaagtgacagggcaagactccgtctcaaaaaaataaaaataaaaaataaaagttactgttttcttatgcattgatactgttgccataacatagggtagctgtatgtcagtacttccctcctagaccagcatgcctgcatcttagtgttcatttattcagcgttccgcctccaagccttgtccccttaacacacacacatacactctctttgtgttaaattaatgggttctaccatcctggggtggcacagaacaattttggacctgtctttgttttaattggcacctctttttcctgtgtttcagtgaaaagcaggaagaaaattccttggcatccgagccacagacaagacatggtaatgttctttactggcatttagaaagaattaaataaatatgattcatttatgctagggtgttgactctttttctagagtcatacaaagtaaaggttattgcaatagccttttacctaccccctgtactcttcttcagttctcctcctcacaccttatcctgtgcccagctcatcatctgactaaggattaagatcagaactagatcttttcactagtgccctgtttactggggacagtgtaatagacaccttaacgttggagtgaataaccagcttctcaaagagaggtctttttaatgtcagtgcttcatgacacaatggtttccttataggtttactacatactggtttcctacctagattttaattttgtaatccaaataacataaaaatgggaggcacataccagtttgcacagtgtagttgaggcagggtagactcagcaaagactcaaaatcaaaaccatttctgtcaatatatttaatcatttctagactgtgaatatctatcttgttaaattcacagtagttatatttgtattgcctttagacattacatttttttttagttgttaacaatgactttaacaggaaaaccagaagtatacattgtcaactttaaagtcaaaaagaggccattgtggcggctcatgcctgtaatcccagcactttgggaggtcgaggtggatggatcacttgaggtcgggagttcgagaccagcctggccaacattgtgaaaccccatctctactaaaaatacaaaaattacctgggcgtggtggcaggcacctgtaatcccaactactcgggaggctgaggcaggagaatcacttgaatccaggaggcggaggctgcagtgagctgagatggtgcccctgaactccggcctggacaacagagcaggactctgcctctaaataaataaataaataaataaataaataaaatttaaaagtaggccaggtgcagtggctcacacctgtaatcccagcactttgggagttcgaagcaggcagatcacttgagctcaggaattagagcccagcctggacaacatggcaaaaccctgtctctacgaaaaatacaaaagtttagctggatgtgctggtacacacctgtagtcccagctacttggggggtgctgagatgggaagatggcttgagcccaggaggtgtaggttacagtgagctgagatggcaccactgcactccagcctggacaatagagccagacgttgtctcaaaaaaaataaaattaagtaataggtctcttttttgagttccttattttattttttttatttttatttatttatttatttgagacggagtctcactctgtcgcccaggctggagtgcagtggcgtgatctcggctcactgcaagctccgcctcccgggttcacgccattctcctgcctcagcctcccgagtagctaggatcacaggcgcccgccaccgcgcccggctaatttttttttttctatttttagtagagacggggtttcaccgtgttagccaggatggtctcgatctcctgacctcgtgatccgcccgcctcggcctcccaaagtgctgggattacaggcttgagccaccgcgcccggccgagttccttattttagtcatgacccacagtagaaacaaaattgagaataaataaggaaaggtcctcatgggatctcctgtagtgaatccgttcctttattttctagggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaaggtgcgccacactctctgctctgtcctcctcagtgttaggcctgatgctgcattatttaaggattattcatgagaccttccccatacaccccactgtcctggaaatagtgcagtcttccatcctgtctgaactccagtgttagaatgggacctcatgccaccccctctccttcactgtgggtcctatcatgttctccttcccccagaaagtcctcagtgtctaccacccaccaatagtgacggtggcttttcacagcctggaaccaactttccttctcccatacactcctcaggaaacattccttgagtccctgtgtaatgctttaaaaaaaaaaaaaatcttgtgggtttgtctttgtccttgtagctccattgccagccctttgcctggctctacctgattgtgtcctcttcaccaaattcagggcaagctatagtctcataaaccatatgccccatattatcatgcatgtacaccctacttcatgcattttcaaacatccttcatcctctttttcctttttttttttttttttttttttgagtctctctctgtctcccaggctgcagtgcagcggtgcaatctgagttcactgcaacctctgccttccaagttcaagcgattctcctgcctcagcctcctgagtagctgggattataggctcacaccaccaccacgcccagctaattttttgtgtttttagtagagacagggtttcaccattttgaccaggctggtctagaactcctgacctcaagtgatataccgcctcagcctcccaaagtgctgggattacaggtgtgagccactgcacccggcttttttttttttttttttttttttaaggacaagctctctcactttgtcgcccagactggaatgcagtagtgtggtcacagctcactgtagcctcgatttgccaggctcatgtgatcctctcatctcaacctcccaagtagctggggacacaggctcgtgccaccacacccagctaattattttttattttttgtagagacgaggtcttgctctgctgcctaggcttgtcccaaactcctagcctcaatctatccttctgtcttggcttcccaaagtgctgggattataggcatgagccactgtgcccagcttttattgctttaagacagggtcttgctctatttcccaagctggagtacagtggtgcagtcatagctcactgcagcctcaatctcccaggccgaagtgatcctctcgagtagctgggcctgcaggcacatgccaccacgcctggctaatcttttaattttatctgtgcgtagggtttccctatgttgcctgggctggtcctgaactcctgggctgaagcactcttcctgtcttggcctcccaaagtgctgggattacaggtgtgagccaccacacctggccccctctctacttccttacccatttaaatactactctctcaaaagccttacttaaatgtcactacgtccatgaactgtccttgtttcccccagccttttgtcgcttaacatgtttctttatgcttattttatatctttgtgagttcaggcttcttcatctcaaggaccatgtcttatctttttaacagccacgacacttaatgtcatttcttttcatgtttttttgtttgtttgtttgtttgttttgagacagagactcgctctgtcactcagggtggagtgcagtggcacaatcttggccccccgcagcctccacctcctgggttcaagcgattctcatgcctcagcctcccaagtagctgggactataggcgtgcgccaccatgcctggctaatgtttttatatttttagtagagatggggtttcgctgtgttggccaggctggtcttgactcctggccacaagtgatccacccaccttggcctcccaagtgttatgattacaggcgtgagctaccacgtttagcctgccttgccttttctatggtggttggttgataattattcagtttgcttatttcatatcgataataatatttctgattattgatacatgttaatagaggaccagaaatatttgaccacttgccagtgaaatatgaagagaaagtatttgtaaatcatcactgcagtacctacagggaggcaaacatgtcaaatgtattatttaatttattgtagatctggtgctgtgtctaacccttaagcaggttgatgctttagggaaagtcctagaaattacctttctctaataacgggaacttacaaacagtgcttcaagacttccgccgtcctggatgatccagaaaacctccgtttcaccatcggtgtacttaagttcatgtacgataattgcattctgtttttgtgatcagcaattcactgcaacaatttttctaggaattaaaatatataatctaattttcttaaagtaacaatgatgtaaagagatagtttttatgactttgtgtaaccttgcatatgactttattgatatcatcagtcatggcacattaaattatctggaaatatacccagtcaccttaagccttcttttatcatttctgcttttttactgctatattcagcctaacattttgggggatagaagaattaaggggaaaaaaaacttaaagcataaaactgatgattttgattaaaaatttcaagcattgattcttttcaaaaggagaaaaattcaaataaggtaacccttaaatagggtaatctttaaatacaattttcaagaaccatggagttgcagaccagaaagaaataatggatttgatattttcaaagaaatagatagtgcttttaagttcaaaaacctcaatgaagtcctattaaccagaagaatagtatagtaagaaaaatctaaattgggaagtagaaaatcttagcagactaataattagggagttctcacagaaggatcgatttattcacaggtaaagttttctaaaccttcaaggaaaagataacttccaaacatttccaaaatgaaagaaataactggaagctactctgttcgttctgatatagatatctttgaacgccatacctgataaaattaaacatactctcctcattccatagtatatacaataatgccccaagtaaccatgttttggtcaatgacaaaccatttataccactgtggtcccataagattataattgagctgaaaatttcctatcgtcatagcctttatgacactgtagcacaattccatttctttttataaattgagtgcagcctgaatgcattgtgtttacaaggtctacagcagtgtactgtaatgtcctaaccttcacattcacaccactcagtcacggactcagcagagcaactgccagtcctgcaagctccattcatgataagtgccctatctcggtgtgtcagttcttaaatcttttatactgtatttttactgcaccttttctatttatgtatgtttagatacacaaatactttaccattgtgtgtctgggattgtaagtagtaggctacaccacctaggagcaataggctatatatcctgtagtctgggtgtgtagtcggccctaccatctagggttgtatatagtagactacaccatctaggagtaataggctataccccataacctaggtgtgtagcacactacatcgtctagggttgtagtaggctataccatctaggaccctcaggctgtaccccatagcctagctgtgtagtaggctatgccatctagtccctgaattctatattgttgaaaacataacaaaatcacctaagaatgtggtttctcaaaatatatcctcattgttaagtataacacatgactgcgtgtcagattgttaatagcgagaagtaaaagctgtcttgttaccaaaagagtaatgtttgagactatcttactggtaatactgttttgcagtcttatccagtgtaacacaataaagaatagtaagatgcaacatttaaaaatgttgacctggggccagggacgtggtggctcatgcctgtaatcccagcactttgggaggccgaggcgggtggatcacctgaggtctagagttcaagaccagcctggccaacatggcaaaaccccatctctactaaaaatgcacaaattagtcaggcatggtgatgggtgcctgtaattccagccactcaggaagctgaggcagaagcattgcttgaactcaggaggcagaggttgcagtgagatgagatcgcaccactgcactccagcctgggcgacagatggagaaaaaaaaagaaaagaaaatgcagtgtgtaatggaggcacaagaaacggggcagtggaagaggggttaatgtggtatgtggaagagtcaggagcttttctttcaaacctgcttaaattatgacactcccctgtcctgtcccttggataagtttcttgataccattccatttcaccttgtttcttttcttttttttttttttaaacagagacagggaccttactctgttacccaggctggagtgcagtagcgtgatcatagctcattgtaaccttgaattcctgggctcaaacgattctcctccctcagcctcctgagtacctggactataggcacacaccaccacgcccagttaattttttaattttttgtagaagtggggtccatttcagttttcttattagtaaaatgaaatgctatcacttgacagaagtttttgtttaattacaaagaacccatgtcaatgtacagagcatagtatttggcaatcaaaagacactactcggtcctctcccattgtttatggtagtggataattgatgagaaaccttgatagaaaactaaacccacattttatagtaacataaaggcaataatggatgacgttaatccttctctgtccgccatcagaagatttgatacatctttgttgaggtattatatgatcgtcctctaaactttgaaataattaacagaaggtaagtcctgctgtgatggccatataaaagtttacttaaaccttttttttgtttgtttaaataaaaggcgatgtagatactggtagagcttgttgctcatgttacagaatatacagctttataaactttaatttctcaacaaataaattgactaagggtatagatggtttacagatgcggcgatgggaaagtgcgtagggaaacattcacgttctgtatcaagaatagcatttttctcattcgtagcttttatctgatttggcagggttgaagtgaagctggcattgtcatttttgcaactatcatggtaaactggcataatccctttggaaggcagttccctgataagtttttactgtacttaaagttgaagagatcttgttagagtcttgaggcttataaaataatcgctatctcagtgctttgggagtccaaggtggtacgattgtttgaggccagtagtttgaggctgcagtgagttatgattgcaccactgcactccatcctcggcgacagaacaagaacctatgaaaaaaaaaaagagcttataggtatatttcaggaaactgctgggctaggtttttcgggacaagtacttaaagaaggtcatgacagcgtttgataattgggcttgcatttgcattaggcactagtcattctctttttctttctttctttttttgagatggagtctcgctctgtcgcccaggctggagtgcagtggcatgatgtcggctcactgcaagctccgcctgccaggttcaagcaattctcctgtctcagcctcctgagtagctgggactacaggcacgcaccaccatgcctggctaattttttgtgtgtgtgtttagtagagatggggtttcaccatgttggtcaggatggtcttgatctcctgacttcgtgatccgctcacctcggcctcccaaagtgctgggattacaggcgtgagccaccccacccagcccgaaacagaaaagctttctaaagttgctgactcactaaatgtacccccgtggctttgcggtatgtttaagttgtataaaccaccccttcttgtcattttctatcctataattccttacctaatggattaagtggtgccagaactgaccctggagaatgcagatttttgatgcggaagtcacggaagttatgttatcttaagggaaggcctttgcttgttaccttttagtagtaggttacagttggtgatgccatggggctcattcctcacaaattgcaaaacttacatgtgctaataaaccttggccttcaaaagtagtaacctagatacaagtagttctccatgctctttctttgaaatttcctataaggactgctttccagcctggtgcatttccttggcactcaccgcattctgctcgctgagcccttttcccacccctgctctctccctggcttcccctcctgggcaactgctctcacttctcactgctgccactgtgctgcctttgcccggcggcccacctccggctgctcctgatgccccctcccagagccgccccttcagctgaaggtgataaagcatggctttccctttgtaatttgggaagataattttttttttttttttactgtttaaactgttaagggagttttttgccagtgatacatattataaaagacacttgtttgtctccaagtttttgtttttattttttcaagagaataaactggcttctgtccctacacagctgagcagtggttcctgattgtcctaaggaagcctttggccctaacctgtgtgcctcattggccacttttttactggcggcagcagcagcagcagcatcagtagttgagaacaccctaatctatcttttcctttctcttcttcacttctaactatagggaaaacgtccacagcgcacaaaggcagagttgcatcctaggtggatgtctgaccacctgtccatcaaacccgtcaagcaagaggtgagtgtgggtgagagtagcgaggaggagctttcctgatgaaagagacggatccttttcatgtacttccattcctgcctttttattttccttcattttttttcctaaaccccaaatgtttatttagcaatcttatgcttaagatacatttctagaaagagaaagaattagaagacgtgaggccacactctggttctgacaatctcctgggatggtaggcatgtccacatttaataagaatacgtactgcaataggtgcatgtataggagcagttcacaaatgcaaagatgggaggatgtagagctgggcaacggaaggagaatttgagtaggcagagccatatttgacctgaatcctgagatggctgggattgatggaaggggagcaaagagggtgggagaggtggggcagaaggcatcccacactacaggagtagtagaaacaaaagcacagagacaggaaattatataaatttatataaaatgatataaatatatatggtcaaaaaacagcatatattagagccaagcacaggtagctcatgcctgtaatccgagcactttaagaggccaaggcaggtggattgcttgtactcacgagttcaagaccagcctggccaacatggcaaaaccccatctctactaaaaatacaaaaattagctgggtgtggtggcgggcacctgtaatcccagctactcgggaggctgaagcaggagaattgcttgaacccaggaggcggaggttgcagtgagctacgatcgcaccactgcactccagcctgggcaacttcagagtttcactctgtctcagaaaaaaaaaaaaaaaagaaagaaagaaaagaaaacctgagagtttgtggcaagtttgttgttttgtttctaattggagatgtagcatggacctgaaaagggtccaggaatgagagagcgtggatctggctgatctgtggggagatgaaattcttaggtgtcaagacctcgccatggagggtagataatcacatttcttctaagacacaaagcaaaacaacataaatgggagggcagggaaatgtttaggtcacatgaaagagagagggcatcatgtgggagtttgagatataatgttaggtgaagaaagaatatttggtgcaaccactaattaaaagagttgtccaaggagcattctggagctgactgtgtttcggcattttcattctgtaatgtagctcaggagcctgaagcaggagatttacttgagcctaggagtttgagaccagcctgggcaacatagcaagaccccacctctgaaaaaaaatagttaaattactttatcacatcacatcacactgtaggaagggacaacactttttaaccgtttatcctttgggcactctttcatcgaatatttaaacagttcagtgatcgtagagagttttgagttaagggacagtagttttactctggaccatgtctttgaattgttacgttacggagccttccttttgcctttcagtaacattttcatggatcttaaatttgagtgacgacacgatgttctattacagagatcttgtcagtaactaaacacattctaccttgagccctgaaaagggaaagctaatttataaatttgtatttacttcagtatattttgatttcacatctgtctctttttaactcagagatgtgtcttgcccgatgtttaattacctgggggttgacaattctattcatgattgacctcccttctccagtatcctcttcctcctagcagtcactaatttcagagtggcctttggtccctggtattcagccatgttctcaaatggttttctagcctggccttgttgggctctctctgctgtctttattaccttgacagttcacacctccttgcaagctcccttttctgtttactgttcactgctctgagtattcctagatgccataacttaacacttcagactgcatagcaggctgaatagactgaaacgtccttcattgctccaagcaaaactttggcatcaaacactaaaatttctttttattcttggcagtgtttgagctttcttttattctactcttcagttcgaacaaaaagaaaccacagtattacagagactgtaaactatctgttgtggtccccgatatcctggagaaacccttagtggtgacatgactttttaagcatggaggcagggtttctggcctctattggtcactcagcagtccaaacttattgcctgataaaagactttgagttgtgacttcttggggaaaatatcagtgaggggagactgtctcgctgaactcagggattcgggatgcagtggttatttttgtccggacactttggtcattgctgttgctagggagctgtttgttgggtgttcgtctcaaatgtgctgctaacgggagcaagggtgccagcaagtctgatacctgccctcagagaggggagcgtgtaagggcacagcatgttgggcattgcttaaaccaggggttctgttgaatcgtccttgactggattttaaagtgttgtttctcattagcttctcattaaaaacccccttgattctagcaggactcttatctgtaaagcattcctacaccaacatctctaccatttgcaactgaccccaccttttaaagaaaaaaattgcagcctaagacagtatcacatttttgtaactgtgcaggtttatttttgcttggccagttgtcattcatttggttgtactggttctttaatagttaaaacactacaaaaagtgagtcctgttttttagtggtgttttcatcaagacttgctttaccttgcatcagcctagtgctgaaaatcagcagaggaattttaaaacagacttgtgggccaggcgcggtggctcacgcctgtaatcccagcactttgggaggccgagttgggcagatcacaaggtcaggagatcgagaccatcctggctaacacgatgaaaccccgtctctactaaaaatacaaaaaattagctgggcgtggtggtgggcgcctgtagtcccagctacttgggaggagaatggcgtgaacccgggaggcagagtttgcagtgagccaagatcgcaccactgcactccagcctgggcgacagagcaagactccgtctcaaaaaaaaaaaaaaagaaaagcagatttgttgttcacaacatagattttttttttctcatatgtgtgtaatgtcatttaggtaaaattgtaattgttgagaattcacatcagatgggaaactgctaaaatggtaaaatggtaacccatgctgatgaaagaaaaaaggcccagagaaatgtgaggcagacatattcagctaagcaggaggtgtttacaagtgcagggccgtgctggaggagggggcagattgtggagaaagtggtctgagacaggtggagcaataactagggggacagatggcatccgcaagggcaggagccacagctgggcgtggccggtgcaggctcccacctgcccaccatgtctttatagaaaatgtggagactacatgtagaaaactgtaaaagacctggtaatcccacaactcaggaatcattactatttacgtttttacgtatttgcttcaggcttttcctctatgcatttattgcatattgagcattatatttaagatactttgtgatcagtatatcgagacattcatacatttcaagaattgtttaaattctgatacccagatttaagcatgtgaacatgtgatgagatttttaagcatacaataaaagctgtttataatttgctgcactaccaaccttttttttttttttttgagacggagtctcgctctgtcacccaggctggagtgcagtggcacaatctgggctcactgcaagctccacctcccaggttcaagccattctcctgcctcagcctcccaagtagctgggactacaggcgcccgccaccacgcccggctaattctctgtatttttagtagaaatggggtttcaccgtgttagccaggatggtctcgatctcctgacctcgtgatccacccgccttagcctcccaaagtgctgggattacaggcgtgagccaccacgcccggccagtaccagccttaaattagttactttggggggcctaagtcaaatggtttaaactgtgagcctgttgaacatacctaaggaataccttcctatattatatatgtatgtgacttcttcgtgtaaaggttttttcacttgaattcctatgttacctggctctggaagtcactactcaggagcttatggtccaaagaggagagggacagataaccaggattgatcaaaatatagagatatatatatatggatatatatccatacacacacacatatttacagttatgtacatacatatacacatttattatatttatatgtgtatacattttatatgtatatatacatatatacatgtatgtacatgcacctgtgtgtacacatggatggcacagcagaagggaacacaaatctcgaagtgcaagccctcaagaagcagcatattacgataaatcccttctttagaaaagtattgatatggtttggctctgtgtccccacccagagctcatctcaaattgcaatccccacatgtcaggagaggggcctggtaggaggtgatgaatcatgggatggacttcccccttgctgttcttgtgatggtgtgtgagttctcaggagatctggctggtgttttgttttgttttgttttgagacggagttttgctgttgttgcccagactggagtgcaatggcaccatctcggctcactgcaacctccgtgtcctgggttcaagctattcccctgcctcagcctcacgagtagctgggattacatgcacctgccaccacgcctggctaattttgtatttttagtagagatggggtttctccatgttggtcaggctggtcttgaacacccgacctcaggtgaaatgcccgcctcgtcctcccaaagtgctgggattacaggtgtgagccactgcgcccagctgatctggttgtttattgttttttcggggtttttttgagacggagtctcactctgtcgcccaggctggagtgcagtggcgtgatctcagctcactgcaacctcggcctcccgagtagctgggattataggcgcctgccaccacgcctggctaatttttgtatttttagtggagtcggggtttcaccatcttggccaggctggtctcgaactcctgacctcgtgatccaccctcctcagcctcccaaagtgctgggattacaggcgtgagccaccgcgcctggccaagatctgggtgttttaaagtgtgtggcacatcccccatcgcacatgcgcacttgcgctttctggctctatcttgcttcgctgtgctaagacgtgcttcctttcccctcaccttccgccacgattataagtttcctgaggccccccagtcatcctttctatacagcctgtggaattgtgagtcaattaagcctctttgcttcatatatcccagtctcatgtagttctttatagcagtgtgagaacggaggaataccggtatcatttctaccactgataccacaggttaagttatatattatgccatcttcgagtaacacttgaagccacacaataaatgcaaaggcattacaatgaatcccacttaatacaaataactatatagaccaacactgctctacaaatttagcttgggtctttttctaatggccggttaaatacagttttaatttcgtaggttaatggtgaaggttcatacactgaagccagtacgtatacctagcattgcttttcagcctaaacttatccacgtacacaactcagttacaaggcttggccttaaaatgctaggagagcttcttaaagtagtttttacaggtattaaatttcgtcttgcacaccgaagtcatcgtacataacagggcaaagtcagagtttttatcattgcgtttattcttcatttacctttaaaacacttctctagctgaatatttaaagcaataggaagcagtgagcatattatggttacaggccttcactcagtcactgttgcagataaaatgccagcagtgagtgttactcactggcccagttaagggctttgacactgaccacctcttctggggagatggtgttccttgccctcatatgcttctccattgtaatgctgccatctttgctgatttgcctcagagcccaccagttctttttgatcatcccatcagtctcttcttcctttctaccaggtagaagtttttccagcaaagagagtttattaggagagagagccattctgaggagcgtttacataaattaagtgattaggcgacgctttgcatacggtgtgcagtaaattggcattccttcatttagcacacacttgatgtccccgtgcttgacattctgacctggaccatggttcagtcttgaaagcagatgttagcgtttgggagtcacacagtgtttcagccagctgtgtgtctgtacacaggaaaaggtcttctccctgtcaagtaaaaatagcatggtctttctgttctaccccagtggtaatgtttcctggctccagttctggtcttggtatccttcaccacggaatgttatcttctggccatctttcatgcctttgtcaatagggacttctagaatctccttctctgcaactgtcttccttccattgcagctttcacgtctatctttaggacggatggtttccccatgggcttggcactccatgcacacagattgaatttgctgaaccattccaggtcttattgatgaattactgtttgcattcaagcacctcagcagttggcacagcaggatcctgctcccttcttaacacctctgccttcacatttgtcacaaatcatattcttttgcagagccagttttcttttttcaccattggatagatctcctaaggctactgagagctgatgtaggagtttttacctctcctttctcttagtatccttccttctcccccaaaaaaacttagcagagatgtccatgggggaatgagaactgccaccagccccaccctctttaattgcctgtcctcctttgtcatagaattccctattctctgcatcagagagaacttctcaagattgagaaatccatttaacttctctccttcatttagattcttaccagggtattacttcaaagccatttttaagcctttgtcagttcttcgtgggtagcattaggtttgacccccaagatgtcatagtaagtggtttctttcacaattttctgtagccagtgagtgggctgaggctggtggtggggagtggggaggggcctgtagctctatgcagtccgtgcagccactgctcctccacctcacaccaagcatctggaaagttccctcaggtgttttgttttgttttttttttttgagacggagtctcattctgtcacccaggctggagtgcagtggcacaatctcagcttactgcaacctctgcctcccgagtagctgggactacaggcgcccgccaccatgcccagctaattttttgtattgttagtagagacagggttcaccacattagccaggaaggtcttgatctcctgacctcgtgaaccacccacctcggcctcccacagtgctgggattacaggcatgggccaccatgcccggcccctcgtgtgctttatatattgtttgtgagttttgtgttcgtgttccatttgtttgaggggagcactgttaactgattgtgagatattacatattaagaataataagtcatactcattacagaaaaagaattatatattagtaagatttaggttattggcttttgggttttttctctttctccctctccactgacttaacacatgaacacttcctatgtttgtttagattatcaagtcttttttttttttttgagacataatctcactctgttgccaggctggagtgcagtggcacaatcttggttcactgcaacctccgcctcccaggttcaagcgattttcctgcctcagccccccaagtagctgggactacaggcacacaccaccgtgcccagctaatttttgtatttttagtaaagacagagtttcaccatgtttaccaggatggtctcaatctcttaacctcatgatccacccaccttggcctcccaaggtgctgagattacaggcgtgagccaccgtgcctggccagattatcaagtcttgagtgacttaacattacaatttcataagtaattggcttgcatttgctcagtccttattaaaatgttagattctatttaatgtaccctgtactgatgaaagaagaatatttcacaggtttacacctattgtcttttgttgtgggggagagtggccagaatacacataggtaattctgtaaataactttcatgtttgatatatagatatacctgttttcctctcattttggggtctgacatacataaagcatcacaattctctttcaatgaaatcttccctttgacaaggctcaggttttttttttattgtaagtaggatttttaaattattattatactttaagttctagagtacatgtgcagaatgtgcaggtttgttacataggtatacatacatgtgccatgttggtttgctgcacccatcaactcatcatttacattaggtatttctcctaatgctatccctcccccagtcccccaccctctgacagaccccggtgtgtgatgttccccgccctgtgcccaagtgttctcattgttcagttcccacctatgagtgagaacatgcggtgtttggttttctgtcttgtgatagtttgctgagaatgatggtttccagcttcattcatgtccctgcaaaggacatgaactcgtctttttgggttttttgggctgcatagtattccatggtgtatatgtgcctcattttcttattccagtctatcattgatgtccattgatggacaatttgggttggttccaagtctttgctattgtgaatagcgccgcaataaacatacgtgtgcatgtgtctttatagtagcatgatttataatcctttgggtatatacccagtaatgggatcactgggtcaaatggtatttctagttctagatccttgaggaattgtcacactgtcttccacaatggttgaaccagtttacactcccaccaacagtgtaaaagcgttcctatttctccacatcctctccagcatctgttgtttcctgactttttaatgatcgccattctaactggcgtgagatggtatctcattgtggttttgatttgcatttctctgatgaccagtgatgatgagcattttttcatgtgtcttttggctgcataaatgtcttcttttgagaagcgtctgttcggccgggcgcagtggctcacgcctgtaatcccagcactttgggaggccaaggcaggaggatcacgaggtcaggagatcgagaccatcctggcaaacacagtgataccccgtctctactaaaaatacaaaaaattagccaggcgtggtggcgggcgcctgtagtcccagctactcaggaggctgacgcaggagaatggtggagcttgcagtgagccgagatggcgccactgcactccagcctgggtgacagagcgagactccatctcaaaaaaaaaaaaagagagagagagagaagtgtctgttcatatcctttgcccactttttcatggggttgtttgattttttttgttgttgttaatttctttaagttctttgtacattctggatatcagccctttgtcagatgagtagattgtaaaaattttctcccattctgtaggttgcctgttcactctgatggtagtttcttttgctgtgcagaagctctttagtttaattagatcccatttgtctgttttggcttttgttgccattgcttttggtgttttagtcatgaagtccttgcccatgcctatgtcctgaatggtaatgcctaggttttcttctagggtttttatggttttaggttttacatttaagtctttaatgcatcttgaattaatttttgtataaggtataaggaagggatccagtttcagctttctacatatggctagccagttttcccagcaccatttattaaatacggaatcctttccctgttactggtttttgtcaggtttgtcaaagatcatatggttgtagatgtgtggtgttatttccgaggcctctgttctgttccattggtctatatctctgttttggtaccagtaccatgctgttttggttactgtagtgacaaggctcagtattatctcctctctttcccctgcccatgtgagtcaactgataccttatggtgtttttttggcatcagtatacatctgaaaagagcaaaggcaaatagttttgttttactttgctttgttaactgcagtttcatcatatctcagctgggtaaagatgttgctggaacaattaagaacctgggaagtggggtggaagtgagagcagggattatggcaaaatttagggaaggtgcttgacagacatttattcgggaagcagtggccagagttgcagtcttcgggacagtcgtccttgccaagtgtccatagcatccccttttcagaatcaacatccaccatattgaaactggcctgctctggctataggataaagattttatggttgttatttaattctgtttgttacactgagacaccttatgggtacagtgttaacgtatgcagtttttatttttgtccctcctgttcattccagatttttacctgtaaactcttctaaagtcaggctcatagatttttgaatggtgaaaatgacattgagaagtcaactaactgggccacgcgccatggctcacgcctgtaatcccagcactttgggaggctgaggtgggcggatcacctgaggtcaggagttctagtccagcctggtcaacatggtgaaatcccatctctactaaaaatacaaaaattagctaggcgtggtggtacacacctgtaatctcagctactcgagaggctaaggcaggagaatcacttgaacccaggaggcagtgtctgcagtaagccaaaatcgtgccactgcactccagccttggtgacaaagcaagactccatctcggggggggggaaaaaagcctgctatctaggcaagatcgtctctaaatttggagtcaaatgagaatctaaaccggtttgttttgttttgttttgtgtttttgagatagggtctatctcccaggttggagtattacgcctgtaatctcagcactttgggaggctgaggtcagaagttcgagaccagcctggccaacatggcgaaaccccatctctattaaaaatacaaaaattagctgggcgtggtggcaggtaccctgtaactccagttacttgggaggctgaggcgagagaatcacttgaactgggaggcagaggttgtagtgagccaagatcataccattgcactccagtctcacagagtgagattccatctcaaaaaaaaaaaaggaactgtgttctgttgagtgactgtctttcatcctagtatactttttaaaacttcctagcgctttttaaaacttacctttatcggctgggcacggtggctcacacctataatccctccactttgggaggctgaggcaggtggatcacgtggtcaggagatcaagaccatcctggctaacatggtgaaaccccatctcaagtgaaaatacaaaaaattagccgggcgtggtggcaggcgcctgtagttccagttacttgggagtcggaggcaggagaatggcgtgaacccgggaggcagagcttgcagtgagccaagatcgcaccactgcactccagcctaggcgacagagcgagactctatctcaaaaaaaaaaaaaaaaaagaaaaaaaagcttccctttatcagatgttaactctaaagaaacacatctctgaactgccccagtttctcttctctccagtaaattatccataagattgtctcctaaataccacaaattatataaattgttggacacaaaagttttaccattttgaatctcccttatgttttaacatttatgtatatccatgtgtattttacagataacaaaatcagcttttcgtgatataaagtccctagctaatattatttgttgaaaatactgaattcaatgaactgagagcaaagagcttatcttgcatgattgtgtactgaccggatgtgctcattggctcctcacaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtcctgtagccagagccaactcaagctaagtcctgccatgcatccaagttgtttccggcaatttcttttttttttttttttttttttttttttttttttttttttttttgagacggagtctcgctgtgtcgcccaggctggagtgcagtggcgtgatctcagctcactgcaagcttcacctcccgggttcacgccattctcctgcctcagcctcccaagtagctgggactacaggcgcccaccaccacacccagctaattttttgtattgttagtagagacggggtttcaccgtgttagccaggatgatctagaactcctgaccttgtgatccacccgcctcggcctcccaaagtgctgggattacaggcgtgagccaccgcacccggccactttttttctgtttagagttctgcaagcaaaggataataactgtctttagatgttttcttagataacaattgtatttataagttcaacctgataaatcatgtgataacagatcacttggtgtaattgaagatagtccaagatttaccttttaaataagtgtattgaatatttttaatttttcaatacaacagcatagcatatggatttggctttttgaatgcagtgttttgcagggcaagatttcagtaaattttggctaagaaaattgaagtattctggccttatgtacctattaagtaacagaaagttacttaacctattatgtgcacctcattcctaccaagatctttttttttttttctttttttttttttgagactccgtctcggtttgtcgcccaggctggagtgcagtggcacgatctcgtctcactgcaagctccgcatcccgggttctcgccattctcctgcctcagcctcccgagtagctgggactacaggcacccaccaccacgcccagctaattttttgtatttttagttgagacggtgtttcactgtgttagccaggatggtctcgatatcttgacctcgtaatctgcccgccttggcctcccaaagtgctgggattacaggcatgagccaccatgcctggccctttttttttttttttttttttttgatacatagtctcactctgtggcccacctggagtgcagtggcacaatcttcacttactgcaacctctgcctcagcctcccgagtagctaggactataggcgtgccaccacacccagctaatgtttgtatttttagagatggggttttaccatgttgggcaggttggtctcaaactgctgacctcaaatgatcttgccgcctcggcctcccaaagtgctgggattacaggcgtgagccactgtgcctgcccacattaaggattttagaattaataaagaaatgaggggtcaggcacagtgactcatgcctgtaatcccagcactttgggaggccaaggggggcggatcacatgaggttgggttttcgagaccagcctgaccaacatggagaaaccccatctctactaaaaatacaaaaaattagctgggcgtggtggggcatgcctgtaatgccagctactcaggaggctgaggcaggagaatcgcttgaacccaggaagtggaggttgtggtgagccaagatcgtgccattgtactccagcctgggcaacaagagtgaaactccatctcaaaaaaaaaaaaaaaaaaaaaaagaaaggaagggagggagggaaaagaaaagaaagaaagaaatgatggctgggcacagtggctcacgcctgtaatcccagcactttgggaagccaaagtggccgaatcacttgaggtcaggagtttgagacagcctggccaacatggccaaacgtggtagctcacgcctgtaatcccagctactcaggaggatgaggtgggagaattgcttgaacccgggaggtggaggttgcagtgagccgagatcgtgctactgcactccagcctgggcgacagagcaagactctgtctcaataaaaaaaacaacccttagtgcatataatctacaggtttagcctgtgtcatactatgtagtatatctcacttgtaagatcttccataattggctatgtccagtgccacatttaaattcctcaggacataataactggcttttatttgtttatattttttagtggaattgtgtttttttatttaatagggtccttattgggtacacctgtcattttaatttatataggcaggtccaaaactcatttttatggctcagtttctgtaatgtaagattaataatgcctgtattgtagtcccatctacagaagtcacaaataaaattaaatcctaggaattaaccaaagaagtgaaagagctctataatgaaaactataaaacatggaggaaacaaattgaaaagaacacccaaaaactggaaagctttctacgttcatggataacaagaatcagtattcttaaaatgtccatagtactcaaagtaatctacagattcaatgcaatgtctaccagaataccaatgacattcttcacaaaaatagaaaaaaaaatcctttaatttatatggacccacaaaagacccagaataggcaaagctatcctaagcaaaaataacaaacctggaggaattacctgacttcaaattgtatttcagacctgtggggaccaaaacaatatggggatctggcataaaaaccaacacacagacaaatggaacagaatagagaatccagaaacaagtccacacacgtacagcgaactcattttcaacacacgtgctaagaacatacactggggaaaagagtctcttctacaagtggtgctggggaaactggatatccataagcagaagaatgaaactagacccctatctcctgccacatacaaaaataaaatcaaagtggattaaataattatatctaaggccgggcgtgacgacttatgcctgtaatcccagcactttgggaggccaaggcgggtgaattacaaggtcaagagttcaaggccagcctggccaaggtgttgaaaccccgtctctactaaaaatacaaaaattagccgggcacggtggcaggcaccggtaatcccagctactcaggaggctgaggcaagaaaatcgcttgaacctgggcagcagaggttgcagtgagctaagattgcatcactgcactccaacctgtgtgacagagtaagactccatctcaaaaaaaaaaaaaaaaaaaaaagaattatatctaagacctcaaattatgaaactctacaagaaaaaacgttggagaaaccctctaggacattgatttcaagcacaggcacccaaagcaaaaatggacaaatgggatcacatcaagttaaaaagcttctgcacagcaaaggaaacaaccagcaaagtgaagagacaacccacagaatgggagaaaacatttgcaaactgcccagttgacaaaggatgaataaccagaatgtagaaggagctgaaataactcttaggaaaaagtctaataatcggatattaaaatgggcaaaatatttgaatagagatttctcaaaagaagtcatacaaatgcagacgaggccaggcatgttgagtcatgcttgtaagctcagcactttgggaggccaaggctggcagattgttttagcacaggagttcaagaccagcctcggcaacacggtaaaaccccatctctacaaaaaatacaaaaattaaccgagcatggttgttcatacctgtagtgccagctacttgggaagctgagatgggcagatagcttgagcctgggaggtccaggctccagtgagctgagatcatgccactgcactccatcctgggcaatagagcgagaccctgtctcaaaaaaataaaaataaattaaaaaacaagccaggtgtggtggctcatgcttgtaatcccagcactttgggaggccgaggcgggcagatgacttgagatcaggagttcaagaccaacctggccaacatggcaaaaccctgcctctactaaaaatactaaaattagctaggcatggtggcacacgcctgtaatcccagctactcaggaggctgaggcaggagaattgcttgaacctgggagacagaggtggcagtgagcagagatcaagccaagacttcattccagcctgggcaatacagcaagattctgtctcaaaaaaaaaaaaaaaaagcaaacaagcttatgaaaaaagtgctcagtatcattgatcatcagagaaatggaaatccaaaactattatgagatatcatcttacacagttaaaatggtttatacccaaaggacaggcaataacaaatactggtgagaatgagaagaggaaatcctcatatactgttggtaggaacataaattagtcccccgctatggagaacagcttagatgttccttagaaaactaaaaagagagctaccataaaatctattaatcccactgctgggtatacacccaaaagaaaggaaatcaatatattgaagagataactacactcccatattttttgcagctctgttcacaatagccaagatttggaagcaacctaagtgtccgtcagcaaatgaatggataaagaaaatgtggtactgatacacaagggagtactattcagccataaaaacagaaagatgcagtcgtttgcaacaacatggatagaactggaggttattattttaaatgaaataagacaggcacagaaagacaaacattggatattctcacttacttgtgggatctaaaaatcaaaataattgaacccgtggagatagaggggaaaaggatggttaccagaggctgggaacgatagtggagggttggggagaggtaggatggttaatgggtacaaaaaaaatagttattatgaatgaatatgatctggcatttgatagcacagcagagaagtatggctttttttttcttttcttttcttttttgttatttttgagacagagtctcactcttttgcccaggctagagtgcagtggcatgatctggtctcactgcaacctccacttctcaggttcaagtgattaccatgcctcagcctcccaagtagctgtgattacaggtgtacactaccacacccggctaatttttgtatttttagtagagatggggttttgccgtgttggccaggctggtcttgaactcctggcctcaagtgatccatctgcctcagcctcccaaagtgctgggaatacaagcgtgagcacacacccagccagaagtactattttcattccagtggtgagaaggtggagagtagacaaatattgtgggataatagtggtgagtgatctgaagtaaaattaggcaggtttacaggtaaagagtgacatggctgggcgtggtggctccatctgtggtcccagctacttgggaggctgtggcaggaggaccccttgagcgcaggagatcgaggctgcagtgagcgctgatttcccctgctgaacacagcctgggtgatagagcaaaaccctgtctcagacaaaaaagaaagccctctctgaagatttgacatttaaataaagtgaatgaggttgacccgtgagtgcctgaagcggaaggcgcagtgcagacaagagcagaggcacggaggcagggatatgcagcaggaagtccagggcgaggctgcagcggaggggagcaaagcaagcacaggaaggctggctggaagtcccggcgcggctggagcggagcagagcagagcaagcacaggaaggctggctgggcatgaattgagtcctaccaggtagcccagggtcgcattgggatgggctgtgcagaccttgttagaagggttaaatgggctgggcgccgtggctcacggttgtaatcccagcactttggaaggccgaagtgggcgaatcacgaggtcaggagatcaagaccatcgtgactaacacggtgaaaccccgtctctactaaaaatacaaaaaattagccaggcgtggtggcacatgcctgtagtcccagctactcgggaggctgaggcgggagaatggcgtgaacccgggaggcggagcttccagtgagccgagatcgccccaccgcactccagcctgggcgacagagcaagattccgtctcaaaaaaaaaaaaaaaggaaggattaaatgaaaacaggacagtctctgacacacatttaaagtcacaaatgatagttttctttgtttgagacaaagtctcgctctgcctcccatgatagttcttatggaaggaatttttgtaagccataagatacttacaataaccttttccagactttttagtagcttccaactacaaaaaaagagaaataatcaattatgtactaatcagacacttttaaaaattacaacagtttattcagagaaacaagctttgtgtgacattctaagcggattttattctgcaggtccttttaacataatgagtaatatttgtgttgggaatgactgagaagaaatttcataatgatgtgaagatctacctgtaaatagttcctctgtcgtatgctggtatttatattctagcatctcaacagtgctgatggtcactcatcttggagttccctgaattttttttttttttcaaaactcctgtaatgttacattacccatatttttgttgttgctgctgttgttgttgttttgagacggagtgtcgctctgtcgcccaggctggagtgcagtggtgccgcgcccggcacatgactgcatactttcaaggagaggactcagagcttttatttatttaaagaaacttgaaaggaggaaagtggattaagaaaaaaaaaataaggccaggcgcggtggctcacgcctgtaatcccagcactttgggaggctgaggcaggcagatcacgaggtcaggagattgacaccatcctggccaacatggtgaaaccccgtctctactaaaaatacaaaaaaaaaattagccgggcatggtggcgtgcacctgtagtcccaactactcgggaggctgagacaggagaattgcttgaattcgggaggcagaggctgcagtgagctgagatcatgccactgcattccagcctgggcaacagagcgagactctgtccccctcaaaaaagaaaaaaaaaaacaacagaaggcaaaaagtgaaacagccaagtgtccaccagtggataaaaggagaacctgaatgcagtatacacttagaatggggtgttattcagccttaagagggaaggaaattctgaaacatgctacaacatggatgaaccttgaaggtattacacgaagtgatatcagcaggacacacgtggacaaatgttttgtactagaggctgaggtgagagggaaatggggagtcagtgtttaatgttacagactggagtgatgaaaagatactagaaatggataccggtgatggcgccacaacattacttacacacttaatgctactgaattgtatgctcatttgggtgatatgtctgggtaactagaatgagatgaagccggccatgacgaaagaagtaacttgtagttaatcagttggggtccagccttgaaaaccaaaactacactagctacttcagcagggaaaacatcacatgactctttggtaaaatgggagttagaaaacaaaaaaaaaggttaaagggatccccgtggtgacacagacggaggaatcgggattgtcagaggtggggggctgcagccccactgctagcactatgaaggcaggcaaactcccgctgccaagtgcggcttcgcagatgcaggaccatccatcctaggatgagttgaacggcatcagcaagcaaatggaaggaaatcgctgtcttcctcagcgtgcctcccgtggtccctctgatgctccctttggtagaatataaaaccagcagagaagggagttgtatgtgcaggatcccagccccattatcacaaagcagaacatgaaaattggatttgcaaccatcagaaaaggcttcataacagatgcaggtggcagaaaacatgaaaggtcctgtatgtgttcactgtaagttctagaaggaaagaatcagtatagtaaggccaagagaatgttcagaaacaatgattgagtagttttttggtttgataaaaaaccctgatcctcagatacagaaagcaagaagagatataaactggatataaattatatgtgggcatatggaactgaattatagaacattctgttccctaaaacaaccaatgtggaaaaggtggattaccctgagaggatgttcttaatagtgatagcagataggagcaacagcagacctcaggggacgatgggattgatggccaggtgcagtggctcatgcctgtaatcccagcagtttgggaagccaaggcaggagaattacttgagtcctggagttcaagaccagcctgggcaacataatgaggccccatctctacagaaaatcttaaaaattagccagacatggtggtgcatgcctgtagtcccagctactcgggaggctgaggtaggaggatcacttgagcccaggaggtcaaggctgcagtgagccgtggttgtgcacagcactccagcctgggcaacagcaagaccctgtctcaaaaaaaggaaggggtgggtagtgggttgcattttgaatttttttattagttccttagggctaccataacaacctacattaaccaggtggcataaaatagcagaaatttattctctcatagtcctggaagttagaaatccaaaatctagttattgacagggtttcactctctaaagactgtaggtgagagtctgtggcctttccagcttctagtagtttcaggccttcctggggttttctgcaaacttagaataatagaatgaaacttcctcagccaatatcttaataatctaggcagaccttctacttgatggggaaacattagaagtgttccctttaaagtcaggataaacacaaggatttcctctattgtttccatttaatattgtattgtaaggatttagtgtctacaacgaaaaatacataggtatgtatacatatttgaggtggtgtatgacttgaaactccaagaaaatcacccaggaaactattatagctaagaaattcaccaagtaggtatattcattattattcttttttttttttttttttttttttttttgagatggagtctcactctattactcaggctggagtgcagtggtgcgatctcggctcactgcaacttccgcctcccgggttcaaataattctcctgcctcagcctccaaagtagctgggattacaggcatgtgccaccacgcctggcaattttttttgttatttttagtagagatggagtctcaccatgttggtcaggctgttcttgaactcctgacctcaggtgatccactgcgcccagccgctcattattattctataaatgtcaacatgaacaattttattaaaagatagcatgacccggccaggcgcggtggctcacacctgtaatcccagcactttgggaggccgaggcgggcagatcacgaggtcagaagatcaagaccatcctggccaacttggtgaaaccccgtctctactaaaaatagaaaaattagctggacatgttggtgcacttctgtaatcccagctagctacttgagaggctgaggcatgagaatcgcttgtacccaggaggcagaggttgcagtgtgttaacatagcgccaccgcagcactccagcctgagcaacagagtgagactctatctccaaaaaaaaaaaaaaaaattatgatagctgggcacagtggctcacacctacaatcccagcaccgtgggaggccgaggtggacggatcacttgagctaaggagttgaagatcagcctagctaacatgatgaaaccccgtctctactaaaaatacaataattacccaggcatagtggcatatacctgtaatcccagctacccgggaggctgaggcacgagaattgcttgaacctgagaggcagaggctacagtgacctgaaatcacaccattgcactccagcctgggtgatagagtgaggctctgtctcctaaaaaaaaagaatctgtggatctcaacacactgttcctaaaattcatataaaagagcaaagggcctttttttgtttgtttgtttgtttgtttgtttgtttttgagatgacgtttcacccttgttgcccaggctggagtgcaatggtgtgatctcggctcaccgcaacctccgcctctggggttcaagcaattctcctgcctcagcctcccaagtagctgggattacaggcatgcaccaccacgcctggctaattttgtatttttagtagacagggtttctccatgttggtcaggctggtctcgaactcccgacctctgatgatctgcctgcctccgcctcccaaagtgctaggattacagatgtgagccaccatgcccggccgagcaaagggcatgaaaacttgcaaaaacaatacgatagggtcaatcattatgccacataatgagatcaaatctgcagtgattgagagagaatggtattggcatagagatagacaatgagaccagaaacagaccttgagagaaaacatgggtttttcagaaacagtgccaggcgtggtggtgtgtgcctgtagtcccagccactcaggagtctgatgtgggaggatccgttatgcacaggagttcaaggttgcagtgacctatgatcccaacagagcgagacccctgtctcttgggagagaacagtggtaccaggacacttgttcatttatagggaaaaaatttacatccctgctccttatataagttccagatacactaaaggccagaacctttctgaagaagttgtagatgggatagaaaagaatttttaagtacaaaaagcaaaaaccataaggaaagagagagaactgacatatttgattactttatttatttatttatttattttttgagacggagtctcactctgtcgcccaggctggagtgcagtggcacaatctcagctcactgcaagccccgcctcccgggttcacaccattctcttgcctcagcctcccgagtagctgggactacaggcacctgccaccacgcctggctaatttttttttcttttttttttctttttttttgtatttttagtagagacagggtttcactgtgttagccaggtgggtctccatctcctgacctcgtgatccacctgcctcagcctcccaaagtgcggggagctgagatcatgccattgcactccagcctgggcaacaagagtgaaactctgtctcaaaaaaaaaaatgccaggtgcggtggctcatgtctgtaatcccagcactttgggaggtcgaggcaggtggatcacaaggtcaggagatcaagaccatcctggctaacacagtgaaaccccgtctctactaaaaaatacaaaaagttagccaggcgtggtggcgggtgcctgtagtcccagctattcgggaggctgaggcaggagaatgacgtgaacccaggaggcggagctcgcagtgaggcgagatcgcaccactgcactccagcctgagcgacagagtgagactccatctcaaaacaaaacaaaaaaaattagccaggcgtggtgacagacccctgtagtcccaactactcaggaggctgaggcaggagaattgcttgaacctgggaggcggaggttgcagtgagctgagatcgcaccactacactttagcctgggcaacagagtgagactccatctcaaaaaaaaaaaaattctgtaacctctttggaaatgatggacacccctttgacagtgcctgatgaagtttacatatatactttttactcctatctggtcattctgctgctgggttcacatcttagagaatccttacacacatgcttgagaagacatgttttaaaataactttgttgatactattgtttacaaacttctaaaactggaatcaaggagaataatggattgttaagctgtggaataatcataccatgaaatactatattaacattaataagacaaaatgtttaaagtttgacaggttgggtgatacatgcgtattcattaatttacagttttctttatggttgaaatttttcttttttttccagaaaaaaaaaaaatagttggtttagagaactttcttagaagtcgaaaaaaaaaataatttttaaaaatttaaaatttttcttaaaatttggtgatagcaaacttcttttcattgattaaaggagatatagattagcatcacaaatgaaaataatttaggaacaaaaactcaagtcaaatgcaacccaacagggatcgtgtcttgctcacagcagtagtcaggcaaagatcctatcccttgtggaacagaagctagaattggggaagaaagtagaggctcaggccaggcaccatggctcactcctgtaatcccagcactttgggaggctgaggtgggcagttcacctgaggtcacgagttcgagaccagcctgaccaacatggagaaaccccatccctactaaaaatacaaaattagctgggcgtggtggtgcatgcctgtaatcccagctactcgggaggctgaggcaggggaatcgcttgaacccagggggcagaggttgtggtgagccgaggtggcgccattacactccagcctgggcaacaagagcaaaactccgtctcaaaaataaaaataaaaaagaaaagaaaatagaggctcttgctggcttctcctcccttccatctttgtgccttgctgtctggcagtctcatttttctccttgcctcttttctttggcccctacctccttgttccctgcaagtggtaagtgccccatcaggctgggaatggaatgccaagtgtgcttctcatggctgtggctgggagccaggaagaaaatcatcatccctgccttccagctccttgccaatcccagctggcatctttcccctcttcccagccaaaatcccactggcggcagggcctgctgcctgatctgggggtggggtggggagcagaccattgcttgcatggatgccttcataaacgcagaacggcaagagctgggacgtgcgtttaaaatcctgtgtgtgtatggactgagagtctggtcctaaaaaaggatttgcggatgttgctttttttaagtaaaagatcagaatggcctcaagtaatccgagaagatagtcctcattcaaccttgtactttttcctttttcttcgactgccattcttctgttttcttctgccttgctccctcccctcctgcccaccctgtgcctgccctgccaccttcatctcccaccttgagctcagtgtgagtgaggaaacaggttcaattagtttacccttgtcttaaagcattccatctgtagaaacatcctaattaccaaaaagagggtggcacagggagcagaagttgcttcataatcctgctttggtggcctggttcttccttctctcacagtgatgaaggaacacgccatgtcagtgtctggagtgtgcttagctcactcagcctttgtgttcattgtagatcgagcgaagaggagaaagctcagggaagaaagggcatggctgctggctcaaggaaaggagctccctccagaactttcccatctggaccccaattcccccatgagagaggaaaaaaagactaaagacctgtgagtatttagtaacaacaacaacagcagtagcaactggtagcatttatgaagcattcaggcacttgccccatgtcatccttagaacagccctgttgggtaacatggtcaccatgtgtgagtgaacagggcgggccctgcacacacagacacgcctagctaccctggcctctgacactcttgctgccacactctgtgatacttaacactaagctcttctttcttcatcccctcaatttaatgaaatcagaatctgattattatgtaaattagctccttggaaatgtgaatagaagtttattctttttaaagtaattacttcccgtgacagtactaggtaccatttgtcttgactccttactaaactcaagaggcagatacacattcagtgttcctgagctcatttatcatatgattttttggattattctttagatcacaaaaatattcataactaaaataaaccctagttgaaaatgtgctataggccgggctcacgcctgtaatcccagcactttgggaggctgaggtgggcagatcacctgaggtcaggagttcgagaccagcctggccaatatggtgaaacccccgtctctaataaaaattttaaaaaaaattaggtgaggtggcacatgcctgtagtcccagctactcgggaggctgaggcaggagaatcacttgaactcaggaggtgggggttgcagtgagctgagatcgtgccactgcactccagcctgggtgacagagtgagactccgtccaaaaaaaaaaaaaaaagattgtgctataaagcctgggcaacatggtgaaacctcacctctacccaaaatacaaaaactcgccaggcatggtagcacacacccgtagtcccaactattcaggaggctaaggtgacaggattgctggagcccaggaaatggaggctgcagtgagctgtgatcacaccacttcactccagcctaggcaacagagcaagatcctgtctcaaaataagtaaataaagaatgtgcaattaaataactaacattctagaaccataaagttctggatcatccaggccaaccccacattttatagatgaggaaagtgacattcccagttttgctaaggtccactgtccctcattgtatttccagggagtgttatcagtgtcacaggctcatctaaaccacactattaggactattccaaatcttagttcagtcaggtgtgtctgcgatagacctgagagagctcaggagagaaggtggtcagagttactattaatttcttattttgtgatttacagctttgagttggatgatgatttcactgctatgtataaaggttagttcccattctccactgttctgtttgtgatagaagttttcctctgtgagtgtgttaagatctcttctctggctttcagttctagacgtggtaaaggctcacaaggattcctggcccttcttggaacctgtggatgaatcttatgcccctaactattatcagattattaaggtagaagttgtctttgcagtaatgcctactatagtgtgtatatctttcttgggttttgttgtttgtttgttgttaaatatatatatattttgatacgtttttcttttcaactgtcaaaagttcatgtgatgtttctcgttttatctgttattcattacagatcagcattgctgaattctcattatctctctgtctctctctctctatggaatgtttgctctcagcatattttaactataaagagttatgtgtctcgtttaggcccccatggatatttccagcatggagaagaaactgaatggaggtttatactgtaccaaggaggaatttgtaaatgacatgaagaccatgttcaggaattgtcgaaagtataatggggaaagtagtggtaagcagggaaggagtttgtgctagatacatatctgtaatcaagaataaaatgccttctcttttacaaatacacatcctagtgccttttctgtaggacagtgaacagaatgtgtatgaaaagtcatgggattgaccattccagccacttatacagtgtctgccagggattctctcctgccccacaggacaatagagtgcagctggcagctaactggctcatcctggagaccagtctgggtctggattatactgtgtgtgcctctttaaccaccgaggggactgaccctacatagagctgactcttcaaccatctggggaagctggcgtagtagatctgcaatatcaaagtagaaatggctctttctgaacatcacactccggggcctgttgtgaggtgggggaagaggggagggatagcattaggagatacatatacctaatgtaaatgatgagttaatgggtgcagcacaccagcatggcacatgtatacatatgtaacaaacctgcacgttgtgcacatgtaccctagaacttaaagtataataaaaatatatatctatatatataaaaaaaaggaaatggctctttctactttgggtcatttatgcattaactaaaaatgccctgcttaaaaacagcagattcagccattttttatttagtatttctgcagtttagccttaaagaattaaatttttactggcattttttttctttatttactaacctcgaggcaggatttcactctgtcacccaagcaggagtgcagtagggcaaacatggctcactgcaacctcaaattcttgggctcaagggatcctcctccctcagtcccaagtagctgggactatcggcatgtgcgaccatacctggctaatgttttctttttggtagggacgggtgtctcactttcttgcccagtccagtcttggaactcctgggctcaagtgatcctcctgccttggcctcccaaagtgctgggatcacaggcataagttactgtgctcagcctggtttgacttaatagtcctagaggccctgtcccaaccatacaaccttgggcatcttacagatagaaaccacgtcttcttcatcttgcatccatagctctacaatataatgtgccctaaaggtgaattaaactcatagattacccaggttgcatcttctatttattagaattgtcttttgtgacctatagttctgtttctatagtttctataaactatagtttctataaacaatttctgtaaactatacctagaagtcaatcctcctgtcttcctatagagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatggtaaggaatagagtggagactgttgcggtttctcctagtttgtgagttcatagtaatgtagaggccattcagttagtacttcctgcaaaatacttacgtgtatgtatggaatctttttccctgtgagtcctttgttcatgtgattttattttgtttactttttagtagagacacagtgttgctatgttgcctaggctggtctcaaactcttggcctcaaacagtccttctgcctcagcctcccaaagtgctgggattataggcatgagccactgtgtctagccattcctttattctaaatcctcctttttctcaatcacttgaattaggtattctcaatgtgggcaaaaattgggattaaaaaatatgtaatctggctgggcgcagtggcccactcttgcaatcccagcactttgggaggctgaggtgggcgatcacgaggtcaggagttcaagaccagcctagctaacatggtgaaaccctgtctctactaaaaatacaaaaattagtcaggtgtggtggcgctactcagctactcaggaggctgaggcaaaagaattgcttgaacccaggaggcagagtttgcagtgagctgagatcgtgccactgcaccttagcctgggcaacactgtgagactccgtctcaaaaaaagaaaaaaaaatgtaatctttattgtataaagcacaggtatacatgtagtacatgaatgtacagtatatctgcaacattataagatttcatggtagcaggcaactggggagaaacggctaaaatggatccttgggaggaggagtaataaaaaagagattgagaaacactgatttaatcttgtatctcctggagagggaagttgcttcaggctcataggcaagccctgatgcgggtgagcacgtgtgttcacagtctccctgtctccagccgaggtttagtcgtctgttttattttagtagaacgttcatcttcaggaaaacccttgttgtcaacctaaagtctgtgcctttcctttttcctcttcttgctttgttcaatgtgctgcagaggccagcagtaccaggaacatttggccctctgcgaggatcagatcctgccaccttgtatggctcctctggagtcccggagccacaccccggggagcctgtgcagcagcgtcagcctttcaccatgcaggtaagcagcctactctggaggtgcaggtgcagggggtcccacaggtacgtttcagagaaaaagtctctttccaggttaaatgttgttcattgcgtcctttcccaaagagtctgttcccatagagaagcatggcacaaagtgtgccttattctgtgagtctgtaactgtgctgccttttctcgttgccagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaaggtaatttacactgtcactttgggctctttaagctcttgtttcatgagtaatctttttacacagcatatcaaaccaagtgtaatctggttcccagcctctctttctttgtttattttttggttttgttttgttctgttttgtttttttgagacagagtcttgctctgtcgcccaggctggagtgcagtggtgtgatttcggctcactgcaagttccacctcccgggttcatgccattcttcggcctcagcctcccgagtgtctgggactacaggcacccgccaccacgcccggctaatttttttggtatttttagtagcaacggggtttcaccgtgttagccaggatggtctcaatctcgtgaccttgtgacctgcccccgtcggcctcccaaagtactgggattacaggcccaccgcgcccggccttcccagcttctctttcttgaacttctcagatttgggccaatcacagtccttctcttggtccgtcgatcccatttctggtcataattttgactctgcgcaggtgggcgcttgctgtgccaggcactcctcctgagacttttttttttttttgagacagagtcccactcttgcccaggctggagtggagtggcacaatctcggttgactgcaacttctgcctcccaggttcaagcaattctcctgcctcagcctcctgagtagctgggattacagatgcatgccaccacacccggctaatttttatatttttagtacagacaaggtttcaccgtgttggccaggatggtcttgaacgtctgacctcaggtgatcgcctgccttggcctcccaaagtgctaggattacaggcatgagccttccagagacttttatacattaattcatttattctcagaacaagccttcgagatagctactgttactatccttgtttttacagatgaaaaatccaaggcatggaaatgttagattatttgctctcagccagctagtaagtagcagagctgagatttgggcccagacagactagatccagcatctgtgctttacccactgcatcatcatagttcctctaaaaaagtactgtcagccgggcagtagttttggtggctcatgcctgcagtcccagaattttgggaggccaaggccaatggatcagttgagcccaggagttcgagaccagcctgggcaagagagtaagactgtctctactaaaacattaaaaaatggccaggcgcggtggctgacgcctgtaatcccagcactttgggaggccaaggcaggcagatcacaaggtcaggagattgagaccatcctggccaacatggtgaaaccccatctctactaaaaatacaaaaaattagccgagcgtggtggcaggcgcctgtagtcccagctactccggaggctgaggcaggagaatggtgtgaacctgggagggagaggttgcagtgagccgagattgtgccactgcactccggcctgggcgacagagcgagactccatctcaaaaaaaaaaaaaaaaaaaagttaaaaaattagccaggcgtggtggctcatgcctgtaattccagcactttaggaggccaaggcaggcagatcacctgaggtcaggagttcaagaccagcctgcccaacatggcaaaaccccattctacttaaaatacaaaaattagccaagcatagtggcaggtgcctgtagtcccagctactcagggagctgaggcgggagaatcacttgaacccgggaggcggaggttgcagtgaaccaagattacaccactgcactccagcctcggccacaaagtgagactctgtctcaaaaaaaaaaaaaaaaaaaaaaaaaggttcatgcctatagtcccagctacttgggaggctgaggtgggaggatcacctgaacccagggaggtcaaggctacaatgagctatgattgcaccactgtactccatcctgggcaacagagcaaaaccgtgtctcaataccatcttgaaagttatcaagtgaatttctgttccttggatacatacctggatttattaagaatggccaatagtgagatctagcaaatcttgaagcagtttcttagaaataccatttaggccaggcgcagtggctcacatctgtaataccagcactttgggaggctgacgcgggtggatcacctgaggttgggagtttgagaccagcctggccaacatggtgaaatcttttccctactaaaaatacaaaaattagccagacgtgatggtagaggcctgtaagttcagctacttgggaggctgggtcatgagaatcacttgaacccgggaggcggagcttgcagtgagccgagatcacgccactgcactccagcctgggcgaaacagcgagactccgtctcaaaaaaaaaaaaaaaaaaaaaaaaagaaatgccatttaagaggaataaacattaaactaggggagaaaatggaaaaaaaaatactttccaattaatgcttatttctaggataaatatctagcatgcatgtaattttcttcagtacctggcaggagaatggacacacttggacttaagataatagattcctggctgagcacggtggctcacatctgtaattgcagcactttgggaggccacagtgggtggatcatgaggttaggagttcaaaactagcctggccaacatggtgaaactctgtctctactaaaaatacaaaaatcagccgggaacagtggtgggtgcctgtaatcccagctcctcgggaggctgaggcaggagaatcgcttgaacccgggaggctgaggttgcagtgagccgagatcacatcactgcactccagcctgggcaacagagcaagactccgtctcaaaaaaaaaaaaaaaaagataatagattccacattaaattgatggtagggttagaactcatttaaatttttgtgtttctcatacctgtaatcgcaactacttgggagtctgaagtggaaggattgcttgaaccctggagttcgaggtttcagtgagacacaatcacaccactacactccagcctgggcgacagagttgaaactccgactcttttaaaaaaagaaaaaaaatggttaggggaaaaaaaccttttagtatttcttttgtggaaagtcctactttgttaacaccacctctagcagaattttctaatattgatttcaagtgagttctggaattcagagctttacaagaatcctgtttaggccggcgcgatggctcacgcctgtaatcccagcactttgggaggccgaggcgggtggatcacgaggtcaggaaatcgagatcatcctggctaacacggtgaaaccccatctgtactaaaaatacaaaaaattagccagcatggtgtcgggcgcctgtagtcccagctactccggaggctgaggtgggagaatggcgtgaacccgggaggcggagcttgcagtgagccgagatcgcgccactgcactccaacctgggcgacagagcgagactctgtctcaaaaaaaaaaaaaaaaaaaaaatcctgtttagttaagtctagttgctaagtttaatgttggctgaataatgaaaagtacggtttttcactttcattgtgtaatttgtaccattgacctttagggccagcttcaagtagcctgagctatgttaatagctctttaaaagttgttaagaatctctaaccttgtgcttcagatctgttaccaggatggtaatttcatcacacctggacaactgtcctcctagaaagataataaaaagattattttggctgggcgcggtggctcacacctgtaatcccagcactttgggaggctgaggcgggtggatcacctgaggtcgggagtttgagaccagcctggccaacatggtgaaatcttgtctctactaaaaatacaaaaattagccgggcatggtggtgcaggcctgtaagttcagccacttgggagtctgggtcatgagagtcacttgaacccaggaggcggaggttgcagtgagccaagatcacgccactgcactccagcctgggcatcagagtgagactctgcctcaaaaaaaaaaaaaaaaaaaaagattattttatatagatatatacacacacttacacactattgtatattgtagtcttagttaagaccttatttttaggtcgaatagtaagttaaagaattctgagaatgtaaacaagcataggagtctaattaatttgattgggcttagtaaatttccataatatgttaaaaatgcctcttttttttttgagatggagtctcactctgtcgcccaggctggagtacagtggcacaatcttggctcactacaatctccgcctcctgggttcacgccattctcctgcctcagcctcccgaatagctgggactgcaggtgccggccaccacacccagctaattttttatattttttagtagagacggggtttcaccgtgttagccaggatggtctcaatctcctgacctcgtgatctgcccgcctcggcctcccaaaatgctgggattacaggcgtgagccaccgtgcccggcccctaaagatgccttttgagtttcatgttgtaggcgtcttgtcttcaagacatgcagacaaaatgaatgtattcattcaacaaagtgattgagtctgtgtgcatgaactgagaggacagtgagacggagaagtccctcctgtggagcttttattctcgtggagcagaaaccaggcatttggccttcctgagcgcccgtcatgccctgttctttctggttgcatcccattttagagcttcccagcatggccagtgattctgatgacaaccatcccctcccagtgtgtttcacgtgcatctgcctagagtccgtgagccacaagccgtctctcagcctcttacgaatcgggcaacccacggttaaggacatttccattctccggcccactgtaagagtgaatgtagaggtgctaggttttacctttgtgtccgtgaaaggagtgaaaggaagtgtacagggaccccaatgtcctgccctctttcagggactcaaacaatttccaggtggggcttgaatcaccacacatccaccttaatctgactcaggcatgttcttcacattaatactgtcatttcagctactgagttattttttctcctcttttttttttttttttgcagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcagggtaagattgcattcaggcttttccccctaaagagagaacagatgtttattttatgtatttatttttgagacagagtctcactttgtcacccaggctggagtgcagtggtgtgatcatggctcacggcggcatcgacctcccaggctcaaggatcctcctgcatcagctgtttaagtaactgggactacacacatgccaccacacccagctaactttttgtttttttttttttttttggtggaggtagggtttcaccgtgttgcccaggctggtcctagtctcctgagcgcaagtcatcctcctgcctcagcctgtcaaagtgctgagattacaggcatgagccagcacacctggcctggatgttcattttaaacagaaaaatggccttagagatgaagataacagttcatggtctaggaacaaaaaaaatatgtgaattattgatgttgtacactctgtaggaaggtattaaacttagagcccaactttatctttgaaattttttccactcatgaaaatgaactggcatttaaatgactgacttagattttgatattgtaaactttatttatttatttatttatttatttatttttgagattaagtctcactctgtggcccagggtggagtgcagtggtacgatctctgctcactgcaatctctgcctcccaggttcaagcgattctcctgcctcatcctcccaagtagctgggattacaggtgcccgccaccacacctggctgagttttgtatgatactataaacttaataaccacagtttgagagctgtaagcaagcctgtgtcaacattgctgccatgtggagacactctgaccaaggtaaaaaaaaaaaaaaaaataggcctacccaggagtagaagaggagatcatgtagtattgaagttttactacatacctctcatttcttaccctatcattgaatgagaaaaccaggtttatccagaatgcaaacaagtccccatgagacttctttcacacatgcttgtgtagtgttgttctccagatccagttaggtgatctgccatccaggaagttttcaaatcgatagatacaaatgaaagttatgaagcggccaggcgcggtggctcacacctgtaatcccagcacttcgggaggccgaggcgggcagatcacgaggtcaggagattgagaccatcctggctaacacggtgaaaccccgtctctactaaaaatacaaaaaattagccgggcgtggtggtgggcacctgtagtcccagctactcgggaggctgaggcaggagaatggcgtgaacctgggaggcggagcttgcagtgagccaagatcatgccactgcactccagcctgggcaacagagcaagactctgtctcaaaaaaaaaaagttatgaagcatagtcttgaaaccagtaccattcagcataaaaaccagtgttcccctcctcagtgccatcctgtcatcttattgctagaccctctctactatttaacattttgtcgtgtttgctttatatgtctctaaatacctgttttctttgctttgctttttttcctaagctgttggaaagtaaattgtagacatcatggcccttaacccctcaatacttgagcatgcatctcctaagaatggacatgccttggagcaccatttcaaaacgattaccacactcaaggcaaataacagtatctaatagagtttttgtttctgtttcctcagttgtccccagagtgtcttttagagtcgtttctttgtgttctatttttattgtttttttctgataaaggatccaatgaaggctcatggatttgcatttggctgccgtgtctgtttagtctcttaatttatagcagttgtcatatctttgttttgttttccaaagagtccaggccagttatcatggagagtgttccagattccagattcatcacacagtctccttgtgtgtagatgaaactcttgtgccaggtgcagtggttcatacctataatcccagcactttcgggggctgaggcaggaggattgcttaagctcaggagttcgagaccagcctcggcaacatagtgagatcctgtctctagtgaaaataaagaacttagccaggcatggtagcacacactactcaggagggtgaggcaggaggagcacttgagcccagaagattgaggctgcagtaaaccatgatcctgccactacattctaacagggtgacagagcaagaccctgtctctaaaagaaaaaaaaaaatagattaaacacttttgtcaggagtgcagtaggtggtgcgtgtgcatgccacttactgccccagggggcacagaatgtcgagttgtcccagtatggatgattccaggcctgatcaccggggtgatgaaggcagtaccctcgtgactacagtgtcttgtttcttctgtcgttaacacgtcttcattaattcttcattgcttctttctcgtggctgtagaatgcagatgcacccggtccagtcgcaggcctcgttcccaaagacccccacagcagcaacatcacaggaggaggtgccgcctcataagcctccaacacttcccctggatcaggtaaggatcactaaaaattagagctgttcttcttcctccaggtggtaggaagtaagtatatgacaaccttgctgttctgaaaaaatgttttaaggtatcctgtggatacaggaactttgcctgtatcgtgcttccttggcacttggaaaaagagcaagaggcctcggaagtcacctctcacatgtctctttttcttattgtgatatggaatgcatacctatttggtgagtatttaaacctcattttttccaagccatctgcaaacattttttctgccatgatcccttgtctgttttatgcttcccacctttctcattggagagagactagttggtgggttttaaagtagtaatagctgcctctgagtgctgcttctctcccatgcgttgtctcgtgcaatgcttctctcccatgcagtctttcccttgacccccacaaagtagttctcattggctgcatcatcatcatttcccagtgtgcaagtcctactactgttaagcactgggactgggatctgaattgagaagtccaggactctagaacctaccctctggaagtaaactgtaactgatgaaacagaatcaagccattttcacacatgaggagcttggacattctttggcttacttaagttttttttttttttttttttttttttttaacaacccaatttttatttttgtttaaaatgtctttgtttctttcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatgtgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagtt

SEQ ID NO: 128 - DNA, 39649 bp, Homo sapiens
gtgttgctgtcctcttgggttccacttcggattttgaacccctgtattttcttttcaaaacccccttttccagtggaaatgctctgttgttaaaaaggaagaaactgtctttctgaaactgacatcacgatgctcccagattttatgctggttctcatcgtccttggcatcccttcctcaggtaagcacaagtcacagtaaattaaaactacagttgcagaattatttaagcagaggaggcaaaactatggtgttgataatgttagaattacaatatgtaatgcacaagatacatttaggataacctttaaaatgtggcccaaatgagtaattctgtgagatgtggggttttttttgctgaagaaatcatatctatgattttcataatgtttatgtttttgtcatttgctgcgtttctccttctgaatcactatgagcttggtaagaaaatacaaaagcaggaaaaacattattgaatgcactgagcattactcagagaattgttcaaatatttggcacagaaatttactatatcaacatttttctatcatatttaccaataatttctatatctgcatgtagatatttaattttgtccaatatgccctgtaggcctatatattttaataaatctgtgtatgtaggtagatttagcatgtttatatatcacaattaaacaccaatgtatcaaaactctatgtgttttatgtgactattatcaactgaaaatagaggaatttttgataaggataaaggacaaataaaaggaaaaagtgaaagatagagacagagatgcagagaaagaacaaaaagagaaaaagaaaggggaataaagtactgaaaggctttggggattggtcatttgcacctgccaatttcctgggtttgggaatcttttcactttttgtgtaacttgagaacagaaagttttcccccattgaatcagaaaccatctgaaaccgcagccagatggtgagaaaagtgtcagttcactagcaatttgtattaatttctcagtagtatttttgccacgtttgattattgtaattttcaaatggagaactggagacactaagggagatttgcccaaatccagaaataaattctacatttcaagttcccaaggctgcgaggcacctgaacattatcctgttgtcaaaaacgccttttctcagaccaaggactcaaagtcaaacaggaatttctaaatgcagaaagcctcaaactcactttcaaatatcatgaaatttggacttttcaaagtcttgaatgcagtttgccaatcacaaaaatgataagaaaattctgtgtgtttgagcttaccattaatgtacgtgtgtctgatgtttttctgtctttattattctatttattataagacaattgattcttaccactcttttcccaaggaatgatttctctcaatggttagcgagggtgtttagcataaactctcttggttcagctaagtctcgtcctctgtgtacaatcatgattacataagaaaactggaattgcttggcctctggcattggtctccattgtgtgggctggaagagtttgggaagattgtgtaatctttcacagatctataataaatctaataacctgtgataaatcttacatctgtatttctagatccatcagcatctgctcatatttttaaatctgtcccatatttccttacattttttaactttactattcattgtaaacaaaatagtttctttttgttatgcaaaactacttttttcaaattacaagaggcaaccccttcatttttatatttctggctttggtaaaaaggagccttgggtgtggccatgggttgtctctcatattgctatttcatattttgtgtgtgctatctgctctcaaaaagcaggaggtgtatcttatttatcttcccatctctcttacaacatgatgatatgataagacacaatgtgtttattcattcaataaatacttattgagcatctactgtatcctaggaatggttccagtgtctaggaatgcaagaggaaataaaaacaaagccattttctaataagctctcagctgggcatcatggctcacacctgtaatcccaacactttgggaggccaaggtaggcagatcacctgaggtcaggagtttgaggccagcctgaccaacatggtgaaactccgtttctactaaaaatacaaaaaattagccaggcgtggtggcacacgcctgtaatcccagctgctcgggagactgaggcagaagaatcgaatcgcttgaacctgggaggcagaggttgcagaaagccgagatcacaccactgcactccagcttgggcaacaagagcgaaactcggtctcaaaaaaagaagaaaaaggtctcatgctatcaagaatccattgaatatgcattctttgatttcaccatgagggctagctccatgggtgacggaagaggctgccatatttgtggtatgctttttttttttttttttttgacgaggcggcaatagtggaaggaagaaacaaaatataccaaaaggcatcaaagcaaaaaaatccacatttcacaatcgtctttgctgagatttggaattcttcaataatttcttttcttttttttttttgagatggagtctcgctctgtcgcccaggctggagtacagtggcgcgatctctgctcactgcaagctccgcctcccgggttcacgccattctcctacctcagcctccagaggagctgggactacaggtgcccaccaccacgcccagctaatattttttgtatttttagtagagatgcggtttcaccgtgttagccaggatggtctcaatctcctgacctcgtgatccacccacctcggcctcccaaagtgctgggattacaggtgtgagccactgcgcccggccttgttttttgttttttgtggtttttttgagacggaatctcgctctgtcacccaggctggagtgcagtggcaatcttggctcactgcaacctttgcctcctggattgaagggattctcctgcctcagcctcccgagtagctgagattacgggtgcccaccatcacacctaattcttttttatttttagtagagatgaggtttcaccatgttggccaggctggtctcaaactcctgaccttaggagatccacccgctccggcctcccaaagtgctgggattacaggcatgagccaccatgcccggcccaattatttcttttctgtcctggctgaggataaaaaaatggcattatcagtaaaaccataaataatcctgaagatttttatgaaatcctgttcataaaattatggacagatgttgatggatctagaaatacagatctgagatttataacaggttattggatttagtatagatctgtgagagagaaaagttttatctgttaagtcttatcagttgtttgtacctcagtgtgagtttgtcaaattttgctaaaagtggatgttgatatggaggtgggaagagagcaggggcgtctgagagactgaggaaacagaatcaagaataaagagactggtcgggtgtggggcttacgtctgtaatccagcactttgggaggctgaggcatgcagatcatgaagtcaggaggtggagaccatcctggccaacatggtgaaaccccgtctctactaaaaacacaaaaattagctgggcgtggtggcacatgcctgtaatcccagctacttgggaggctgaggcaggagaattgcttgaaccagggagtcggaggttgcagtgagccgagatcacgccactgcactccagcctggcgacagagcgagactctgtctcaaaaaaaaaaaaaaaaaaagaataaagagaccaaggatgctgcaatggttcacgtctgtaatccaacattttgggaggccaaagcaggaggattacttgagcccaggagctcaagaccagcctggacaacatagtgagagacatacgtctctacaaaaaatttaaaaattagccaggcatggtggcatgctcctgtagtcgcagctactcgggaggctgaggcaggacgatcacatgagcccaggaggttgaggctgcagtgacccatgatcatgccactgcaccccagctggcaacagagcaaggccctgtctctattaaaaaataaaaagaataaagagaccagaaggtcaggtcttcaattccaaaggaaaatttctttgtcttaaagtgttactagggaccttatcaatatctttcatgatttcattcagtgaggctgagagagccccaaccccctcacagaggtgtctctccaatcccctggtagctgtgttacttttacctgactgctctgttgagataaacagcagcttgagtgaagggctgctccccagtcatatgcacatcttaaactctgacagtcttttgtatcttgaaaacagcaaatatctggggttaataggccacagtttgtggatgtttcatagacacaaagaccctaaaagcctggaaggtgtgagctgctggaggcctcagccatcacccatttccttttcttattgggagatgttaactgcttggaatcaagaccagaacccatggtctctaaatcagagtccaatgcctctcattattaaataaatatttgttggattctcctcctaatgagtgatgacttcggaaagggaatcagccttctgagccagcagcagcacactctcccagagcctgtcccagcctgagctcagtgcacaggagatgaccagcatcaggccaagtgcacgccatccctgtctctgcctccgaactgaagccttcacattcgctctctgcctctccatcttccttcctctgcccatggagttgtctgtctggccctaaaggaaatatatatatatttatttaaaatagaaataaacatttatttatttatcagagcttctctgcaccacccaggctggtctcaaactcctggcctcaagcaatcctcctgcctcaggctcccaagtaactgggatttacaggtgtgaaccaccacacccagccccacaggaaatattttgacaaagaaaaatgagacaaagattaagcaaggaggccaggcacgatggctcacgcctgtaaacccagcactttgggaggccaaggtgggatcaccaggtccagagatcgagaccatcctggccaacatattgaaaccctgtctctactaaaaatacaaaaattagctgggcatggtggcacgtgcctgtaatcccagctacttgggaggctgaggaaggagaattgcttgaacccgggaagcagaggttgcagtgaaccaagattgcgccactgcactccagcctggcaacagagtgagactctgtctcaaaaaaaataaaaagaatataattcttccaggtagtagattgctctaaataacagtaaagcattctggaaaatacaatgctaacagcaaaacatcaaaaatagcaataacagcaaatatatgtatatcgaattgaatttttgcaataagggaagatggctggcctggccgccagaagaccacgcaggccaccatcagctggatggccctgggcaaggctcctctcgatgccccagtatcttcacctgtaaaacaaggggctgggatggtcctggaggtacttcttggctttattgtcttagcttcattatcagttcacttttccttcctctttcattgaggctgaaattgggtccaagcttctgtaagagattcatccatgtccgggagtggtggctcatgcctgtaatcccagcactttgggaggccaaggcgggcagatcacttgaggtcgggagttcaagaccagcctgaccaatgtagcgaaaccctgtctctactaaaaatacaaaaattagctgggcatgttggtgcacgcctgtaatcccagctactcaggaagctgaggcatgagaattgcttgaacccaggaggcagaggttgccgtgagccaagatcatgccactgcccttcagccggggtgacagagcaagacttcgtctaaaaaaaaaaaaaatatttatatatatatatatatatatgtatccacaatgggggacactcatcttctgagaaaaaattcttggtttttcaatggattactgagatggatcttagaatatagtgattaatttaaaatataagttattttgcaaattttggtctatgcacaactttccaggaatccttttattccataatacaaagaccacttgtcctggaaaccttgagcgcatctgtgattttacatcttcgggagcagtgagccatgctggctctacctcattcccctgggtcacagaaagccccgttatggccttttgttcatgtgttcatttgttcattcatcaaacatcatcaaatatttatggaggccctggtctcaaaggatcaactgtgagaagcacttggcctttctcataatgttctatttcacaagaaggacaaaccagaaacatttccaggcttgtcctctaagtctgctccaataatgccaatgacttcagcttctattttggaaaggttctggaaatttgaagatattaggcagaaatcatttaatctttggctttttttattagggggataaagtctgttttggtcagaacagatttgcattagtcaggctgccatcacaaaataccatagactgattaaaaacagacatttattttctcacagttctggaggctggaagtctgtgatcacgtgctagaaagtcagtttctggtgagggctctgttcctggcttacaaacagctgccttcttgctgtgtcctcacatggtgtgtcctctgcgcctcctccttataggctctgtttttaaatatagtcacgttgggggttagggcttaaacatttgatttttgagggatataaacattcagtccctaacagccagtatggttcatgctttttgttaattcagacggaaagtgcaccttctgacagtggtaacacaggtggagatgtatgctgtgcgtgaaagagcagagctgcttgctgcccctggatcttggtgaggagcaggattcctgtaccttcacagggagcacagctgcgtaagtgcaaacgctaagcatgtcaggtcagaattctagatttcccctcccaacgtgcaactccacctcctttcagaatgactggacagtttttcttttgggaaaggaagttcatggttacagtccctgctcatcttcaagaaccctctctcttatgtgtccaaaattctcccggctcacagttgtctgagctaataggtgtgtgtgtgtgtgtgtgtgcttgcatgtgttggttcaggcatcattcagttgttctcggcctccctggagtgcctccatccattgtgagatggtgtcttcagtaatttgtgctaatttggctgacctgggactcagggactctgtaagaacttcagcatctcagcagctagtcaggtggtgcaagcagccatcagggctgtgttcagatgcctgtcagtggctacagtggcttaaccaaataggagattgcttttctcacataccaagaaatttggagaccaatagtacagggctatcagaaacccaggttctgtgtgtctttccattctgccctcctatgtgtgtagctttcatcaggttttcaagacagataagtggccaaatctccagtttcagacaaaaagaaggaggcagacatgtcagatcaagtccatcctttttaacaacctttcctctaaccaccccaatcccaacagcttctgtttgtatctaactggctacatgtgccataggccattcccagatgcaagggagcccagagctgagctttttaagctggcaccatgcaaccctgaataaatttagcatctgttgccaaggaaaagggggaatgcctgttgggcagggaactggcagtgtctgccacagtgctgctgtggtttgaatgggttccccaaagttcaagtgctggaaatttgacccccaacgcagtagtgttgggaggtggggcctaatggtaggtgtttgggtcatgggggcaccaccctcatgaatggatttatgccattatcatgggaggggttggcaccctcttgtctctctcaccccctctttgcccttccatcatgtttgatgcagcaagaaggccctgaccagatgtcagtgatctcaccagatgctcatgatcttggacttcccagtctctagaaccataagccaataaatttctgttcattataaattcctcaggttgtggtatcctgttgtagcagcacaaaataagtgaagacaagtgcctttcaaacaatattctctgccttagaggagggggctgcctgacctggggatagatggaggaggacagctgtgtcctcactgcttccctcttctcttgagcaattcacctctggtcccaactctccagatgcccctcagtaaaacaaagtccacgaagctgactgcattgttgctcgagtggttgtccactcaatagccattagctcaacagctgctgggtgacagtcactgttctaggagccgggaatacaggagtgaggaagacaatccccaacttcctggagctggcatcatctagggaggggagacaacaataaacagataaatgtgatatgattaggttctctactggaagatgaagtaccctaagaggatagagaggagagggactttaaatagtgtaacctgaaatgacttactcaaggaaatgacatttgagcaaagactggacaagtgaagggatggctgtgggctctccgggtaagggtaagaactttccccaagcagatgcattctggcttgttctgggaatcgcagactggcccgagggctggggaggagaatgtgggcagtatggtgggggtggtgcacagttagggccatatggggtcagggagactgtggagggacttaggatgattctttctgagtgtgatgggaaaccatctggagcgcttagcagggaactgacataatcctctagctgctgtgtggggaatggactgcagaaaggtcaagagtgaaaacaattaggaagcagtgcaggagcccaagagagagagcatctgtgccctcagcgtggccccggtggagacagtggggaacaatcagggctgggatgtattctcaaggacattaagacccgacgtagggtgggagaaaaagagaggagtcaaggatgacttcaagaatgtccctctgagcaaatgccccctagagcctgtggggttccaggaaggtttcctggctctttacagactgacaccctggtggctgcccagctggctgctcccagtgctgctcttggtactaatagtaatcaacagatcagtttttgtttattaaaaaaaattttttttgagacagggtcttgctctgtcacctaggctggagtgcagtggtgctaccaccactcactgcagccttgacttccgggactcaagccatcctcctgccccagcctcccaagtagctgggactataggggtgtgccaccatgcccggctaatttttttatttttgtaatacagggtcttcctatgttgcctaggctggtctccaactcctgggctcaaaagatcctcccaccttagcctcccaaagtgctaggattacaggtgtgagccaccatgcctggcccacagtttttaagtaaataagcacaaatgtaaggttgcgtctctccctatcactcatttgcattttatgtggaggaaaatggggctgggaaccgtcagaggacacagcccacttcacccatgcctctgaggtgctgggacagaggcacctggaattgctcctctcttaggaaagtgcctacagaagcctcctgcacacagggggatggtgcactgttgtgcttttcttcctaaaagaatccctggattttgagtgggcaaacctggagggtatgtctctcatgagatcattacccagcatgtggatatctcagtgggaagaaaaaggttttctatggtcaggacatggtgcagaatgagttgctgtaggatattaatcgggtgctgaacagacaaggaggggcaggttaaaactcccatgctgatcagtaatgggactgcacctgtgaatggccactgcactctagcctgggcaacatagtgagaccctgtcttctttttttaaaagtaggggcttccttgttttaaatgtgatagcacggcattgtaaggaaatagaactctactttgggactggattcctaagccatttccccaactggagggttaaagcttaacactgggtgtttctgaggttctcacatagtgaggcactgggcagagtgtgacatcctggctgctgaccaaggaaggactttgtaaggaaagactcttccttgggaaaagacaagaggaccgtgaggggcacacggctggtgttcagtgaccatgtgccgactctgacatctactaacacacataaaatgaacacccactatgggccaggcactgttctaggtgctgggtaaacatgatcaaatataacgcccattgctcccatcgtcagggagctccagaggaagacaggtgtgacaaatgacaagagacttccaaagggagatgctggaggctcagggacggagaacagcttggggacagggcccatctctgtgaagagggagcgttgcagatgggaccagaggtaggggtcggggtggctgcagatggagcttttgggacctgggtgttgaccccatgatgggaaaatctcatgagagagtgcagctctgggtaaaatgtggattctgggccgggcgtggtggctcacgcctgtaatcccagcactttgggaggctgaggcggacagaccacgaggtcaggagatcgagaccatcctggctaacatgaggaaaccccttctctactaaaaatacaaaaaattagccgggtgtggtggcaggcacctgtagtcccaggtactcgagaggctgaggcaggagaatggcatgaaccctggaggcggagcttgcagtgagccgagatcgcgccaatgcactccagcctgagcaacagagtgagactctgtctcaaaaaaaatacacacacacacacacacacacaaacaaaatgtggattctgttttcagctgtgtgtgtttggagggaggtgggagtggacgtggagactcttgcatgctccaagttgcctttcaggaactgggctgtttagaaacagacacagcctatggtgcaggaggccaaggccacaggagccatgggacactcatccaggcatcgtgcccctcccattaacccaggtccacccatgattcttttacagccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggtgagtaatccttggcacttggctaaaaagaacatgcattccttaacctgtttatgagtctaaaatatatatttttccctatgtctgccatttcaattttaaaaataatttactgtgagagaaaatctgcccccaagaagccactaaaatgacccaaggaaagaacgagaagttgtcacagggtaaattttcattgcagcactgttagtgtgggacgattcgctgcggggaggatgtggttgctaagatagtcattgctcctggccccggtttgctgaacacccagggaggagggctgggaactgcagagaagaggggctgagcctggggctgacgtgctgtgatcttcgatcctccctggctgtgccctgggctggtagggggctctgcagggagacagggtggtaacaacagtgcccagagcaaggcccattcctgctgtccctaggcagccccgtcacctcttctgaactcacccatgccttcacattctaattttccttttgagcttgcctttctgtcatgattgtgttcttagaagaaaccagtgaactttaactccctaaatgcaacaaaattgtccttctatgatccccaaagccccagaagaatcctcctatgttgtccatattctccaccctactacacacatgtgcgcacactcacctgcctggctggctcaataccccaggattccttctaggaagtcatgcaaagcccgtctccagtttagctattatttccctctactttgtaccttcattattattattgttgttgttgagacagagactctgtttcacacaggctggaatgcagaagggtgatcttggctcacttgcaacctccgtttcccaggttcaagtgaatctcctgcctcagcttcctgagtagctgggattacaggcatgtgccatgatgcccagctaatttttgtatttttagtagagacggggtttcgccatgttggacaggctggtctcgaactcctgacctcaggtgatccacccgcctcggcctcccaaagtactgggattataggtgtgagccactgcacccagcctactttgtacctttaaagtgccttctgggtcatccaattttatgtaaatatagccacaatgaactgctacttgtttcagttgtttttcattttaagcaaaatccgcatgccatttgactatttatatgccatttgactgtttacatgccatttgactattgtaaattgagaatcttttgcacttttaacacctcaaaggtaagattcagatagatttttctgatcgaaaccaaacaaaaaacaactgggtgtggtggcgtgcacttatagtcagctccttgggggctggggtgtgagaatggcttgagccccggaggttgagggtgcagtgagctatggtggcaccactgcactccagcctgggcaacatcttgagatcccatttctaaaacaacaacaaaaatcacaacttattttcacttcaacttacagtattttttaaattttcattttcttaggatgaaaagaatcagctgatgacaaccaatgtgtggctcaaacaggtaaatttcaatccaaggattgtgtctgctaacccagtcacttattttctatttataaaggctcctatctgaaaaacaattatttaagagggcatattgtgttcctcagggagatttgtgggaagggtctatggcttttattttctgttgtgagtgttggggagctgatcctggcaagcccctgggtacacactgttgtgcgtggttgctctcagcagtagagctgctcgtggagcaggcagaggtgactctactgccataaggcctggggatgggccctgggaccacttagaggaaacaacaaagagcctccaagatgcaccactttctcccaggtagggaactgcagctaggtaggaaaatcagggctacatcctccctagccttctctggtcctctgtgggtagaatctacctctaatacctcttgttgcttccaaggaagaactgagccctgaatggaggaataacggggctgcccattattaatttcagaacagagtgaagcccaaaacaaaatgatgaatacgtgttttcctgacatcactgaaaatgcattttgaatcgttttcagctttcttcttagataattgcttttagcttggctagagcttatttcctaaagtcaggggagtgtgcccaaaggagtttgttctaggattgtcagtaaataattaccattcaaatcccagtttcgcatatgttatctacaaagagaaaatattgacatttgatagcaggtaagaagtttggtttatcccagctattcgggaggctgaggcaggagaattgcttgaacccaggtggcagaggctgcagtgagccaagatcatgccactgcattccagcctgggtgacagagcaagagcctgtgtcaaaataaataaataaataaacttggtttaattgcttgtgtttttattttaccagtggttttttttttaatttagttttctcatattcatttacatatttatctgagacacagtctcattctgccgcccaggctggagtgcagtggcatgatctctgctcactgcaacctctgcctcccaggttcaagtgattcttgtgcctcagcctcctaagtagctgggattacaggtgcccgccaccacgcccagctgatttttgtacttttagtagaaacagggtttcaccatgttggccaggctggcctcaaactcctggcctcaagtgatccgcccaccccagcctcccaaagtgctgggattacagacttgagccactgtatgtatttatttattttttagattcaggagttacatgtgcaggtttgtttcatggatatattgtgtgatgctggggtttgggcttctagtgaacccatcacccaaatagtgaacatcatacccaataggtagtttttcaacttattcccctcccttcctccttccctcccttccccttcatctcttttggagtccccagtgtgttttgttcccatctttgtgtccatgggtaccagttgtttagctcccacttctaagcgagaacatgtaatatttgattttctaaagttttttgtttgtttgtttttctttttctttttttttgagaccgaatctcactctgtcacccaggctggagtgcaatggcgcaatctcggctcactgcaacctccgcctcccgggttcaagctatcctcttgcctcagcctcccgagtagcagggactacaggcacatgccaccacgcccggctaatttttgtatttttagtagagatggggtttcaccatgttggccaaattggtcttgaactcctggcctcaggtgatctgctcacctcggcctccaaaagtgctgggattacaggtgtgagccaccgcacccaccctaagtattttgtccagatattgcctaatttgccccattgttttaaaatattcctggtgggatatctttctgctaatgctttataaggagcaatggatacaagaaacagcaaggagcttcccccagcttcatttcatgtcatcaaatgtctcccacccaacaactttagtgagatttagagaactatcatgattttcagtgctttctacttatctgattctctaatcagtagaaacggtctgaatattgttttacttgcaaataaaaatacccaaaagaaaataataagcttggaatgtatatataaaaataccatttaaataaacatatcttgctatacacccatctcattccccagtgacttacccacttttgcaattcagaggcctgagaattgggaagtattttgagttgataaaggccaagaagaaatcctatattcaagtttgcaggggagaaaagaacccacactttcctcttaaggtgaaaacaggcttagaagttaacaaaaaatcaaacaaacacacaaacctttacttcctgcacacctccttcccccactgctctcttttttttttttttttttttgagtctgtgtctcactctgtcgcccaggctagagtacagtggctcaatctcagctcgctgcagcctctgcctcctgggttcaagagattcttctgcctcagcctcctgagtagctgggactacaggcacgtgccaccatacctggctaatttttgtatttttagtagagacggggtttcagcatgttggccaggctggtctcgaactcctgatgtcagcccaaagtgctgggattacaggcatgagccactttgcctggccgagattaagctctaatctctcacataaagcaggggtccagggactctgggccttcacatgggtatagtaggtcttttcacttttcttgtgcttttgaaaattaggagtcgttttggccaaagagaacagcattagacacaaaagagtgggcgccgaggaccctgagggcctcagctacagctttggaaaggacttcccacaaagtgtgccaccagaatcccagaagactggtgggtgtcttcaagccaaggtggaattaaatcctaaaagtcaattcaatacccaaaaccaagcaggagaaatccacaggcatggagcacactgacacttggaaaagtcagcccactgactgaagttcccatttaatagaagcaatgagaataatcgacttttttgggtataaatatgtaaggtacaagtgcagttttgttacacagatacatttgtagtggtgaagtctaggcttctagtgtatctaaatactgatgtacattgtaaccattaggtaatttctcatccctcatccacctcccaccctcccactcttccgagtctccaatatctattgagattaatatactttaattgtgtttaattcacaaatgcataaatgaggtttatctcatttaaacctctctaccacctgacttaggaaaagagacatcattacccctgttttatagagatagaagagtccagtcctcatccagcaggaatctgggtttcctaacccctggccaggatctttctggccatatgcagcctccttcctgaacactaagccctgcttctagatcacaggaggagccaaagcaggagaaacgaagcttcacattccagaaaactacagaggatatagtcattgcgacgtccatttgcacagattgagtttggagtgggaaatgttacagtggatattagttaatacgcgctgttatggcacagacaatgttggggcagaaaagaaaggtcatttttataacagtgggtggcaagaagggaaggctgcctgtaacaggaggcattgagctctgccatgatgttatttttatgctttttaaaaagagctttttggccgggcgtggtggctcacgcctgtaatcccagcactttgggaggctgaggcaggtggatcacaaggtcaggagattgagaccatcctggctaacacggtgaaaccccatctctactaaaaataaaaaataaaaaaaattagccaggcgtggtggtgggcacctgcagtcccagctactcgggaggctgaggcaggagaatcggttgtacctgggagccgagatcgtgttactgcactccagcctggacgacagagcaagactctgtctcaaaacaaaacaaaacaaaacaaaacaaaactttttaaagctatatggattaaagaaagctgaatgattaaaaaaaaaaccatgaaaagaaaaccaagataaaacagatatttataaaaagctatcattggttttacacagatcttagttccagagcagctaataataatatttaagatttactgagtacttattaagtgcccaggcactatgctaactgtgtaacgggaataatcccattgaattttcacaaccatcctataagggaggttctattataatcctaactttgcagatgaggaaacagaactggagagtggaagtgacttgcccagggttaagcactgttagggaagtcgacttatgtagagaaatctttcacttgccttagactggagggagagtttggagagtgtcctgttctcctgttagtcctgttgctgtataatttcctaaccctggtcttctaaggctttgattcctcagtctccggaacatctgatggagttggtctagaaagaattcaggagagaatgaagttaggatccactccatcttccatcccttcaccaggatttattgacatcctatgtgccaggcgccctgctagatcctggatgtataaagagcaacacacaccaccgcctgaaagaagaggacatagcgttagttactaaaaaataattaccatgataaatagcacaaagaaagtacatataaaccactgtggagcttaaaaaatgacaatgagacaggaagaaagtcagggaaagctcccaggaggaggggatatttaatttgagtcttacaggactaacagaagttctacaagccaaaaaggtggggaagttgtgaaccacctgaatagtgaatagtagtccaataacaccactatccaaaagctctcacatttgagcaaacccattggtaactctttgcaatcatctctgtgtccctcagtcaaaatgaaaacaaaaatgcccaattccccctctttcctcatttgcctcccagacactgaaaaatgttctctaattcatatccacatggagaagaaaattctacatacttggaacaaaagcatgttccatggtagcgcatgcaaatgagatacttgtggggttttttaagtcaattctcctgtcttatcctgtttccatagctctcctctggtatatttagacactcttcttctatcctctcaaccaaagaaagaactttataaagcacaaatctagtgacatccagaggaagtcttctacatggtgctatttttattttattgattttattttgcaaactagtttgtcttcctcctttgtacttccagacagtaatcaaaaccctataaactataaatatattgttaacattgactcactggaactatgtgagaaagtacttactgctccagtccctcagatcctgctccatcatatcaaggttaggaaaacgtggaaagcaccttagagacaatgaaaattaaactgaccttttttttttttttttttttgagatggagtcttgctctgtcacccaggctggagcgcagtggcatgatctcggctcagtgcaacctccgcttcctgggttcaagtaattctgcttcagcctcccgagtagctgggattaaaggcgccggccaccatgcccagctaatttttgtatttttcgtagagacgagggtttcatcatgttggccaggctggcctcgaactcctgacttcagattatccacccgccttggcctcccagagtgctgggattacaggcgtgagccactgtgctgggcgaaactgaccttttttgaaatgacacaagggttggccgttttgcctagatgttacaatagaaataatcactatgacaacaaatgccaaatttactcaatccgtatttcctgagagcctgctctgcactgtgtaagtgatgcagggcagatgaaccccaaaactggggcttagtctggcttcaccgaggaaagaactcaaggacagcggcagcagagatactgctccctacagaccatggctacccaccagcagtgcgcccaggctagggctgcaggcatatttatacccacctttaattatatgcaaattaagaggcagtttatgcagaaatgtctaggtgggtggtaacttccaggtcattgccatggaaaggggtggtaacttccgggtattgccatggcgatggtaaactgacatggtgccgtggtggccctgtcttatggaaagccgcctctgcccgaccctgtttagctagttctcaatctggtccggtacccgagtccccgcctccagagtcagtttcaccttctgcctcataaggccctgagctgggcgctgttgcatataaaaataaggcaatgagaggactaaatgacccggcttcactgtagctgagacagtttgttctcctctccccatgacaatcctgaggaaaataaaactgctggaatatctgcccaggccaacatcttaaagtagcagtgtctttccaacagctgatgtctgttttagatcaacaaaaagttcagcaaacatgaaggtcttattggatagacccctggagctgatttcccaggaaaaataagaagcagactggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaaaaagccgacctgttgtggaaaggtcaggctagtactagaggtctgggtgatctccccaaaagtctaccatccgcaacctggaatggcacttacaagttcatgaattcatctcagatctttactcatgatctgattttccttccttttctacaaccttactctgaccttagcaaaggaggccaagtttggacttcttactcaagtggaccctggtaagaattgcgtaggggtcaaaaggcctactgtataaacttgggcaagtcacttcacctctctgaccctcagtctcttcatctattaaatagagctgatgcctagctcacagtgttgtctggggggttacatgagataatgtatgtgaatgtgactagctcaataaatgtcactttctgttgccacctttgagctttctcatccttttttttttttttttttttttttgaggcagagtctcactctgtcgcccaggctggagtatggagtacagtggcacaatctcggctcaccacaacctccgcctcccggattcaagtgattctcccacctcatcctcctgagtagctgtgattacaggcatgtgccaccatgcctggctaatttttgtatttttagtaaagacagtttcgccatgttggctaggctggtctggaactcctgacctcatgtgatcgcctacctgggcctccaaaagtgctaggattataggggtgagccaccacgcctggccttcatccttaataacaaatgacatttcttggccttaacaactcatgaatttaacaggaatatgaaacatataatatgtcatgttggtgcctttaagattaatatgaatcaacaagaatttggctttaagaatttcacatctaagatgactagagatcccagggatgtcccagagactgcaaatcaagacaacagcaaaggatatttgttccttattatcttttggtcctattagcattgaagtaagaataatttggggacttggccgagcatggtggctcacacctgtaatcccagcactttgggaggctgaggcaggcagatcacgaggtcaggagattgagaccatcctagctaacacagtgaaaccccatttctactaaaaatacaaaaaattagccgggcatggtggcaggtgcctgtagtcccagctactcgggaggctgaggcaggagaatggcgtgaacctgggaggcagagcttgcagtgagccgagatggcgccactgcgctccagcctgggtgacagagcaagactctgtctcaaaaaaaaaaaaaaaaaaaaaaaaaaaagaataattcggggactttttttatagtttttttaaaaagccttacaatttaggtttaaataaaatttggctctgggttgtggtttagctagacatttatgagtgatcgttcaggtaatacatctaagaaaagacaattttaagggattatatatatttgatatggatttgaaattgcaattttctgaatgaggaagcctagagttggagtgtttttccatttttttcttagtcatagattaactttgatatttggctctgacatatcctgtgcgatcctgtttcctgcaaaaacacagctctcaagtcgggaactgctgtgatgtggagctggtgtttgacgacggctttgagcatctcagctagaacacactatgcaaacatggaatattatttctcatctcttaccctaagaagggagagacaggagcttaatccccagatgccaccagggtttcagagagaacaaagaagtgaccagaaaacctcgcagccccttagagaacgagatagaggtttgggctctggctgctcagctgggcactgctgactctgccacttgcaaatgtcctgtggcttgtgccattctaaacccacagaggtcctggtctacagggcacagccagctctgtggtgaacacacatcctggcaggaattgggtgggctgggcatggtggctcctgcctgtaatcccaacactttgggaggccaaagcaggaggatcatttgaggctaggagtttgaaaccagcccgatcaacatagggagtcccctgtctgtacaaaaaataagaaaaattagccaggcatggtggtgcatacctgtagtcatagctactagggaggctgaggttggaagatggtttgagcccaggaggttgaaactgcaatgagctatgatcacaccacggcactccagcctgggcgacagagtgagaccctgtctaaaaacaacagaaaagaaactggatgagccctctgatgggaatctcagggagaacgctctgtgattccctgtctgatagcagaaggacactaaggttgtgaagaatgctctctcacccttgcaaagcaatgcagcagctggagatcagtgactcgtccaagttgtacagctagtaaagcacagtcctagtgtggagctcagggcttgtgagtggagtccagtgtgctttctcttttgaggccaccagtgttagcagtattgaccacaagtcccacctagcctctttttctttactggttaggagcaactgagtctgctctagatccctttaaaatcctcctcaaggatctgaaggcagcccgcattcatgatctccttccttcctgccccagcacctttccacaggcagttccatctttggccagccttccttccccacgcaaccctgccccactcagaagccttcttttttttttttttttttttttttttttttttttgagatggagtcttgctctgtcaccaggctggagtgcagcggcacgatctcggctccgcctcccaggttcaagagattctcctgcctcagcctcctgagtagctgggactacaggcgtgtgccaccatgcccagctaatttttgtatttttagtagagacggggtttcaccatgttggccaggatggtctcgatctcttgacctcgtgatctgcccgccttggcctcccaaagtgctggaattacaggcatgagccaccgcgcccagccctcagactgcttcttaccctgcatgtttagtctaaatgtcgtctccatggaaatgccttccctgtctactccactgttctgtatcccatacccaaactgtctcctttacagcaactgtcaggaggtgtgggtatttgttagtttactggtttatcatctgagtcagccccaggataagaggttgaggcagctgtgctcagtgctagtacatgccttgcatatttgatgaatgaatgaactctttgaaaacagtgagccccataaaccactatctctgttttatctctggtcacagctgttaatcctgctgttgaaggtcaggtaagcaacacaaatctttctgacttaaaaatacctccccctgaggcttgccctagttctcttagaacaatttataaagctggtatttgtttgctgcagttttgcaatttgcaacaagacagaagtgctagaattttagtcatcccccatcctcctttgcaggatagaactgggtgtaggtaaagaccttcggtgcctgtagaaggaaggaaactggatccaagaagcaggtgatttcatttccatcaatctttaggttccagatggaggagctgtgcatttgggctcattagctgtgctcactaaagatggacctggagcatgacagcacagccctagctggtctgcccaagtctgtgcctgtccccagtgctcttagctatgtgcttgcagcgtgctgcagctgcatagccacccaggttcttcccaggatcagctgagaacattttagttgcaagtgacagaaaacctcacataaactaacactagcaaaaagagaacttattagctttcacaatcggaaaagtccagggacagggctggctttacctgcagcttcatgctgggcccctgctatattcccaggacctggttcctctctgggagtctctgggcttcctgtcctctgtgttgattccattctcatccataccctcccccggaagcaggatgtctacatcaactccagactcaaaatgcttcctataagccaggcgcagtggctcacacctgtaatctcagcactttgggagactgaggcaggtggatcacttgacctcaggagctgcagaccagcctgggcaatgtggcaaaactctgtctctacaaaaaatacaataattagctgggcatggtggtgcactcctgtagtcccagatacttgggaggctgaggtgggaggatcacttgagcctgggaggcagagatgcagtgagccgagatcacactactgcaccccagcctggacaaaagagcgagactctgtctcaaacaaaacaaaacaaaacaaaacaaaacaaaacaaaacatttcctgtgtgcaagttcatcagggtaagagtgtcccacctcttttccagtggtctcagaagccctgtggtgtcttgccaactctgatttggttgcctgttgtccctgaaaatcacagtgggcaggtctgagaggcaggcctggagcagaaggatgcatcagctcccccaaaagctgatggactgagagtggagtgaggttgttccacaaaaggaaactggggttctgttaccaagagaaaggcaggtgaattcaaggcaacagacatagcacgtgtcctttttatctcctaatctgatttcctcctctttacataaagatctcttggtggccaggcgtggtggctcacgcctgtaatcctagcactttgggaagccgaggcgggtggatcacttgaggtcaggaattcgagaccagcctgaccgacatggcaaaaccccatctgtactaaaaatacaaaaattagccaggcttggtggcacatcccatctaccggagaggctggggcaggagaatggcttgaacccaggaagcggaggttgcagtgagcagagatcgcgccactgcactccagcctgggcgacagagtgagactccattaaaaagaaaaaaaagaaaagaaaaaaaaaagatctcttggtgtgcccctccttcccgtggccttgccgaagcagaggatgaccaaaggcctgtgtccctgtggcgcattcctcatctcataattctcccattgttcatcacggcacttggacacagtacagtatgattttttgtataattcccccgacttttattcatgtatttacttatttattttgaaacagggccttgctctgtctccaaggctggaatgcagtggtgcaatcacaggtgcctgcagccttgaacacccaggctcaagtgatcctcccacttcagcctccaaagtagttgggaccacagacacacaactacacccagctaatttttgttgttgtttaatttttgaagagatggggtttccctgtgttgcccaggctggtctcaaactcttgggctgaagcgacccacctgcctcagccttccagagtgcagggggttacagatgtgagccaccttgcccagctccctcttgggggagggatggctttaacagatattttactgttacttatatattttactatttagatatttactcatttattttactgtttagatatttactaacatattgtaagtaataggatatcctattacttagatatttactaaaatatcgtaataagatatcctattacttagatatttactaaaatatcgtaataggatatcctattacttagatatttactaaaatatcgaataggatatcctattacttagatatttactaaaatatcgtaagtaataggatacctattacctagatatttactaaaatatagcaataagatatcgtattacttagatattttactattgcttatattttattattacttttaacagatatttcactgtattttactgtttgccttttaacaggtgttttgctattaaggccaaacagtttttctgttctatcattgttttttttgttttctctctttgatggagaggagatgaaatgagctgctgtttagcctgagtacaccattgtgctttatatctatcagcaccagaaatacccctgagagctgaaccgtagaaagctttctagaaacaaatgaacttatgaagcattttaagctacaggttttcccactgcagtgcatcatggggagaggtaaaagcgtggaggatctggcttcaggcagaccttagcttaaagcccattaaggccaccaggctgcacatctcctgggggcccccttcacagcagactcagtgtgcagggcacctctggagtagtggctgcatggatgacccagccatgtgcagcagccttgaatcccgtttccctcactgactagctgtgtggccttggacaggtatttgaactctctaagcgctggttgcctcatctaatacagcattaataaatatttattatattttagtccggttgtggtggctcacgcctgtaatcccaacactttgggaggctaaggcaggtggattacctgaagtcaggagttcaagaccagcctggccaaaacggtgaaaccccgtctctattaaaaatacaaaaattagctgggcgtgatggtggatgcctgtaataccagctactaaggaggctgaggcaggagaatcgcttgaaccctggaggcagaggttgcagtgagccaagattgcgccactgtactccagcctgggcaacaagagcgaaactccatctcaaaaaaaaagaaaaagaaaagaaacctaggctgggcgcagtggctcatgcctgtaatcccagcacattgggaggctgaggcgggcagatcacctggtcaggagttcgagaccagcctgaccaacatgacaaaaccccaaacaaacctcaggaaactagtaatagaaggaatcctccttaatctaataaaggatatttacaaaaacccccaacacctaacataaacacttaatggtgaacaactaaatgctttcccccaaagttcaagaacaaggcaaggatatcctacttaacataatactactcagtaattttttttttggaacatagactcacagcagagacaagtgaacatttatttttgtgcctttcttcctatgtgtatttcaagtctttttcaaacaaaggccccaggaatctccagattcaattatgtccctggggttggtcgactgctacaggagtcttagggagccttggacaaatgctagagttactcatttaccaccattaaactctaggatagaagatgcagcaaagcaggactccttcctccatggaatgtgctgatttcagacgaggcggcagccaatgtagaaaacgctggaattggccgggcgcggtggctcacgcctgtaatcccagtactttgggaggccgaggcgggcggatcacctgaggtcaggaggtcgagaccatcctggccaacacggtgaaaccccatctctactaaaaatacaaaaaaaattagctgggcatggtggcaggcgcctgtagtcccagctacttgggagactgaggtgggagaactggcttgaacccgggaggcggaggttgcagtgagccaagactgtgccactgcacttccagcctgggcaacagagtgagactccgtctcaaaaaacaaaaaaagaaaacactggaattttttccttggaactggactgtgatgagaggtgcttgccatgaacataagctactgtcttttcttttttctttctttctttttttttttttttttgagacagagttttgctcttattgcccaggctggagtgcaatggcgcaatcttggctcaccgcaacctccacctccagggttctagcaattctcctgcctcagcctccctagtagctgggattacaagcatgtgccaccatgcccggctaatttttgtatttttagtagagatggggtttctccatgttggtcaggctggtctcaaactcctgacctcaggtgatctgcccacctcggcctcccaaagtgctgggattacaggcgtgagccaccgcacccggccagctactgtcttttctttgacccttcctttccattttttgaagataaagcaggaaataatcttctctgaagatacttgataaaaattccccaaaatacaaaaacacatgcttccacttcattgataaaaatttactgcagtttggcacctgggtctagttcagctggcagatgagctgattgatgcattcaccctgatagccaggtatgcccatctccttgaggaagcccactctatttttggtagcatgacgggccactgagaggtggaaagggcacaagaaccacgagatctcctggaaatgcttctccaggtgctcctcaatcactgtgttgtctgtcagagggatggtcttattcgtgaccttgacttgtccacgtttcaaaatgagttcccagacagacttcagatttggaaatccctaggtcacataagtttccactatacgcagcatttttaggttctggggggtgacttttacaaagacaccactaaaaattttctttgggcaaagtctcgcaatggttctctgcaccagtaaactcacgccatcaatcctttcgatgcgtacaacaaaggccaaggaatgtttatctggcaattccaaggtgtggtttcacttctagtcgtctgagacgtaccttgtcacgtttctgtcaccaggaatcttgtaggaatgattccagttgtttaaacctgagcccttttctttttctctgctccttctttgccaaaagtgcctgctttgcctgggtggctttgagggcttgataagctgtcctcattttcaggagattttctggaaccaaagggatttatctttgctcttgctctgccatctttctagtgttgcagctactactactcagtaattaaggcaaggaaaagcagtcaaagttattcagattggaaaggaagaaataaaacgctccacttgcaaatgacataattgtctatgtagaaaatctacagaaaagatcccaaaattaagtgaggtaagccaggtcacaggacatacggtcaaaatgcaaaagtagattgtatatttagatactaacaatgaacgactggaattttaaaaattaaatgactttttttttttttttttgagatacagtctagctctgtcatccagagccaagctctgtcatccaggctggagtgcagtggcgcgatctcagctcactgcaacctccgcccccaagttcaagcggttctcctacctcagcctcctgagtagctgggattacaggcacccaccatcatgcccggctaatttttgtagagacagggtttcaccatgttggccaggctgatcatgaactcctgacttcaggtgatccacccgccttggcctgccaaagtgctgggattacaggcgtgagccactgcccctggcctatttaggtataaatctaactaaatatgtgcaatgcctgtaagcctaaaactgcaaaacactaacaaaacaacaacaacaaaaaatcaagacctaagtaaatggagacataaataatattcctgggccaggagaatctatattatgatgccagttctcaccaaactaatctgtatattcaaatcaatcacaattaaaatcttggcaggatatcttatagatagccacaagcagattcaaaaatttgcctaaagctataataaccaagacagtgtgatattgtcaaaaagacagatgcacagggccgggcgccgtggctcacacctgtagtcccagcattttgggaggccaaggtggctggatcacttgaggtcaggagttcgagaccagcctggccaacatagtgaaaccctgtctctactaaaaacacaaaaattagccgggcgtggtggcacatgcctataatcccagctacttgggaggctgaagcatgagaattacttgaacctgggaggtggaagttgcagtgagacgagatcccaccactgcactccagcctgggcgatagagtgagactctgtctcgaaaaaaaaaaaaaaaaagaaagaaaaaagaaagacagatacacagatcagtgaaacagaacagtccagaatggacccatgcacatacacagttaactacattttgacaaatgtacaaaggaagttccgtggataatgtttagtcttctccacaaaaggtgctgacaattggacactcacatgcaaaagaaaatgaacttcaacccattcctgcacctttataaaagattaatggaaaatggatcttagacttaagtcgaggctggtgggccacgaggtcaagagatcgagaccatcctggccaacatggtgaaaccccatctctactaaaaatacaaaaatcagctgggcatggtggtgtgcacctgtagtctcagctactcgggagcctgagccaggggaatcgcttgaacccaggaggcagaggttgcagtgagccgagactgtgcgactgcactccagcctggcgacagagcaagactctgtctcaaaaaacaaacaaacaaaaaactacaaaatttctagcagaaagcatacgagaaaatcttcgtgaccctgtgttaagcaaagatttcttagatatgacacaatccataaacaataaaactgataaaatgaacttttagaatttctgacttgtgaaagacattagtaaaaggaaaaaaagactgagagaagatgtttgtaaatcaaatatttgacaaaccacttttattcagaatgtataaagaactctaaaaactcagtaagaaaacaaacaacttgattaaacattatgcacttcaccagataagatacatggatggcagataaacacatgaagatattcatgattagtcattaggaaaatgcatattaaaaagcacaatgaatctgggctcaatggctcatacctgtaattcctacactttgggaggtgaggcaggagaattgcttgagcctaggggttcaagaccagtctgggcaacataggcagacttcatttctacaaagcaaaacaattagccgggtgtggtggtatacacctgtggtcccagctacttgggagcctgaggcaggagcagaaggatcacttgagcccaggaggttgaggctgtagtgaatcatgatgtcaccatagcactccagcctgggaaaaagaacaagatcctgtctcaaattaaaaaaacaaaacaaaacaaaaaacaaacatgaagaatctaaatgcattgctaagtaaagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacggtggctcacacctgtaatcccagcactttgggaggccgaggcgggcagatcatgaggtcaggagatcgagagcatcctggctaacacggtgaaaccccgtctccactaaaaaatacaaaaaaaattagccgggcgtggtggcgggaacctgtagtcccagctactcaggaggctgaggcaggagaatggcgtgaacctgggaggcagagcttgcagtgagccgagatcacaccactgcactccagcctgggcaacagagcgagactctgtctcaaaaacataaataaataaataaatatcatgccattttgttatacttcagattctagctttttaaaggcccatacatcttaaactttgttttttggggatcaagtctcaaaaatgttgtctaagatagacaatgtttcctctggggtgtggagttccatcatttgtcaggcatcatgcatatttcagtattttaccatctagtgacatcatccatctgctgactcctgatgttttaatgacaaagttggcatcactgggctccgggaagcgtcatgctgggcatgcccttctaactctctgaactcccgcatccttactcacctatccacacgaggggctgtagaatagaaaattttaattttcaggtcagatttcctatgattctggaccctaaaatctttgtaatagagtccactctgctgtgattgggtcatccatacatcatcctcttgaccttcacagtctgatcaattcatggtcaggtttatttatctggattcatcagcccctgtaaaacatgccatgtgatttcatccttatgaagaaaaatgtgtaagcgcctggaggctaacgatattaggaatgcaatttaaaattataattgggagctccaaaaataaattcagattaaaacttaaaagaaaatgctgggaaaacatttttttattggatacaagttctaatgtgatcaagaagaattcatggaaaatggatgtctcatattaacatagcaggtggatgttcatctaagcctcttgagtggtgtttaaaatcacttgtaccagttagcatgtgatttaagtatcactggacccaccctcctagaataaactgaattagacacatcattgcttttcttttgtttgtttgttaagagaaaataggatgaaaagatagatcatgaattagtggcgtttgttgtagagcctcttcatggtgaggcagatacagtaattttggaaatatgtaacatgcaaagtgtgtgggcctgggtgagatcagaggccaggctggctcaaggtgaatcctgtactgagtccccagtagggtcacgcagtccaaccgggacaatttccttttcttaataaaacagtggcttggtaaagctaacagaaacttgaagatttcaagatctaatacattgaactttcggaataaaatcacagtgtactaatttcatgcaggaatggacagaccacaagttacgctggaatcctgatgattatggtgggatccattccattaaagttccatcagaatctctgtggcttcctgacatagttctctttgaaaagtaagtatcacattgtttcttacttatggggaaaaaaataaattttttaaaaagtgaaaaaaaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaataaataaataaataaataaataaataaataaaaaataaaaagtgaaaaaaaggaaagtaagtatcacagaagaaaactattttggtcagattaacactaggaatagaaaattctgattcaggcaaaatacttaaaagaaatattcaattttaaataaaaaaattgtttattaaaacagttacctggcgttgtggtagaaaagtcctaaaatagggcagggtgtggtggctcatgcctgtaatcccagcactttgggaggccgaggcgggcaattcatgaggtcaggagttcgggaccagcctggccaacatggcgaaaccctgtctctactaaaaatacaaaaacttagctgcgcatggtggccggtgcctgtaatcccagctactcaggaggctgaagcaggcaaattgcttgaacccgggaggcggaggttgcagtgagccgagatggcgccaccgcactccagcccgggcgatagagtgagactccatctcaaaaaagaaaagaaaagaaaagtcataaaacagaaatagtcaatgctgggaaaaagaacaaaaactagcaggtgctccaccgactgctaaggtgaaactgctttgattgcagtgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtgagtaaactggtattcctgataatgctgccgtaaaggtaggccaaagacaaatattttgacatctgtttacaataaaatattgtcatggtttaaatgtgacgttatataagacatgctttttatacatataacatttaaagcaagccctgacataacatagcgacattagtatgaatttttaggaagtagttcacaaaaacataaggagcaaaagtgaagcaactgttgattaagcaactgttgattaagcattgtttcttataattctatattaaataattcaattacacattttaagttggttagcctggtttctggtaatttatctttcatttttcattggatgataaatatgttcaaccacagtatttagaaataaaagatcagaaagaatgagatttttaaattaatataaaatgtagtgttacaacagatattttggtgaggaaagaggatgtggttatttagtttacagattttttttttttaagtgtgagccaggcacagtggctcatacctgtaatcccagcactttgggaggccaaagcgggtgtatcacttgagtgcaggagatcgagaccagcctggacaacatagtgagaccctgtctctacaaaaaatttaaaaattaactgggtgtgggtgggcgtgcttgtcctagcactttgggaggctgaggcaggaggatgacttgaggccagaattgagaccagcctgggcaataaagcaagaccctcatctcagaaaaaagaaaaagaagataaaagagaaggagaaagaaaagaagtagcgtgggaagagtgtgaatttcagactgaaaacagtcctgggttcagatcataatctgaatgacttaagacaagttacttaacctgagcctcagttttctgaatcctaccttgaaaagtttgtgtgaggattaaatgacataaaatacaaacatgcacagtgtacccagcacacaggggctcagctccgttgtataagcagtcaacaagtgtgaattctcgcctttctaattatcatcctcatccttcttctttttttttttttttttttttgagaggagtcttgctgtcacccaggttggagtgcggtggtgtgatctcagcttactgcaacctccgcctgctgggttcaagcgattctgctgtctcagcctcccaagtagctgggactacaggtacacaccaccacacctggctaatttttcttgaattttcattagagatggggttttgccatgttggccagaatggtctcgaactcctgacctcgggtgatccactgcctcagcctcccaaagtgctgggattacaggcatgagccaccgtgaccagcccattcttctaaacagtccttccccagtggaatgaaaatattatttgacgtgcagatattaagcgtaaaaagtgatctgttgggccaggcacggtggctcatgcctgtaatcccagcactttgggaggccaaggtgagtggatcacgaggtcaacagatcaagaccatcctggccaacgtggtgaaacctgatctctactaaaaatacaaaaattagccaggcgtggtggtgggagcctgtagtcccagctacttgggaggctgaggcaggagaatcacttaaacctgggaggcagaggttgcagtgagctgagagtgcaccactgcactccactccagcctggcgacagagcgagactccatctcaaaaaaaaaaaaaaaaaaaaaaaagtgatctgttgcctaaagcaagttacatattttcaatttatatgagaacttcaatttatagggttcaaatattttactctaaaattgatgaaaattagtgccaagagcctgatcccgtaaacaaactgatgaaagaatttttttttttttttttgagatggagtctcgctctgtcaccgaggctgtagtgcaatagctcgatctcagctcactgcaagctccaccttccgggttcgtgccattctctagcctcagcctcccgagtagctgggactacaggcacccgccaccacgcctggccaattttttgtgtttttagtagagacagggtttcactgtgttaaccaggatggtgtcgatttcctgacctcgtgatccgcccacctcggcctcccaaagtgctgggattacaggcctgagccactgcacctggccaagaattttttttagaaatatccttctacattttctcttgcgttcacagacactgcctcatatgtcctctctcttaacaatctgtcatgtttttcatccacttaaaattgtttttaaaagcactagaaaagtgactgctgctagacaagaaacattcagctgtcaagttgggagaatttttttgtttgtttcttaacatcttttaaaaacactaatacagggccaggcgcggtagctcacgcctgtaatcccagcactttgggaggccgaggcgggcggatcacgaggtcaggagacggagaccatcctggctaacagggtgaaaccctgtctctacaaaaaatacaaaaaattagccgggcgtggtggccggcgcctgtagtcccagctactcgggaggctgaggcaggagaatggtgtgaacccgggagacggagcttgcagtgagccaagatcatgccactgcactccagcctgggcgacagagcaagactccgtctcaaaaaacaaacaaacaaacaaaaaaacactaatacaggccgggtgtggtggctcacgcctgtaatcctagaactttgggaggccgaggcgggtggatcacctgaggtcagcagctcgagaccagcctggctaacacgttgaaaccctgtctctactaaaaatacaaaaattagctgggcatggtgacgagtgcctgtaatcccagttactcgggaggctgaggcaggagaaccacttaaacccaggaggtggaggttgcagtgagccaagattgcaccactgcagcctgggtggcagagtgagactatgtctcaaaaaagcaaaacaaaacaaaacaaaacaaaaacctaatacaaagatttcttttttttccccaagacggaggacatttatttactctagagggatgaggactccccttcctttcagacttccccagccagtcgtgccttgactttgtgtttatggacctgttgcccactctctgcacctccccttcctaataaaggggactcagtttcttgtctccttcatgaattcctgtcttgtcctggtcggttcttctccttggcagcacccttccttctggagctgcagcacaggtggagtggaagaaaagaaagcctgtgacatttggccacaaaaactcttaaattataaacttgtgattcttttcatacgtgtatcaggaagcaccctagtaagatatactggcttcctaagatatgctctgtctcctgggttcaagcaattctcctgcctcagcctcccaagtagctgagattacaggtgcccgccaccatgcccagctaatttttgtatttttagtagagagggagtttcaccatgttggccagctcgtctcgaactcctgacctcaggtgatccccccacccccaggcctcccaaagtgctgggattacaggcgtgagccaccgcacctggcctatagtggctctttattcatgtaaaaatcagacttttcctattctgatcaggaatgttgacatatgcatacagaattctattgtttctattttccttcttcagtgctgatgagagtgttccaagctgcttcttttgggcacaattagcgaagtccctgaaagaacctgagcctgtagtgtggttgggacattagatgcattttgaaaacttaagtaaatgctataaatctgaatgttactcttttttaatcccttgagatgaatacagaacagttgctcagtgtcttgagtgaaaggcatctttttctcttttgcaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaccccgaatgcgttgtctttgtggaaatggaacatctcctcatgggagaaactctggtaaatgtgctcatttgtggttgccatgagagtgagctgcttttaaagaaagtggagcctcctcagacccctgccttggctttcccagacattcagggagggatcataggtccaggcttgagctcacatgtggccagagtgcacaaaaagctgttgctacttggtggaggaacacctcctagaagcagcaggcctcggtggtgggggaggggggattcacctggaattaaggaagtctcggtgtcgagctatctgtgtgggcagagcctggatctcccaccctgcactggcctccttggtg

SEQ ID NO: 129 - DNA, 26889 bp, Homo sapiens
agggatgcaaaagtgttttactaccaggagttcacaaatctgtggacagcacaccagtgaggattccacggtgttggggaggcaggcagggtggtactcatgacccagaggcagagacaggagcaagagcccttgggcccactgcacccacagcttcacattgtgaaggaggccgggagaaggggaacaggcaggggtgggaagcagcccaaccttgggttttggaaaaagattgcatagctcgttaaaaccctgacctcttttttttttttccgctctgtcctgggtgaccagggtgtctgccagcacttggacacgtcagaccccaccacctcctgttgggttatctgcttttccctctttgggggggtggggagcatttctggagtaggaaaggactggggcatggggcggggtgcggagggcctggagagaggccatgggtcccggggctggaccacagcggggctgtgggaagggtcctaaccttcacaggcccccttcctggttaaggttttttttttgctgaaagggccacaggatatatttgtggtgtaaaccccagaggctgccactgctttcctggggagcttggaggccacacccatgtgactgcagggcaggatggtggacttctaggcccctacagcctcggcagtgtcctcagatccggatgtggaaagtgctagaaagagagaaagggcaagagagggtgagaggccctgggtcgggcaggtaaaggctcctcagggaaaagcacagcaggccccagccccatgctggacagtgcctcattagggaaccctgcatagtggatgcaggtaatcaacactgggggaagacggaggaacagcggtgcccagggagttctgcccccacttatcactgaaggggcccccaggtcttcaaccttccccctgcaggggacaaaggccagtcacacgtctagggcaagggtggcttgaacgtgacctcctgcttcctggccgcacaccactgctcacaaatagcgagtgataggggcctcagccccaacatcccggcctgccctgctctgccctgcccaagcccggcccctgtagtggcagcacctgaggaagtcaggggccttggcaatcatgtcctcgaagtcagcaaagcccagcttgccgtcaccgtccaagtcagcctcctcaatgaccttgtcgcacacaagcaccacctcctcctcatccagctctgacttagtgagccgggccagcgtcagctccaggtcctccttgcagatgaagttgtcagtgttgaagtctgtagggcaggggttggacatgttcaagtccaggctgcgtgcacccagggacccctacactatagctcttcctcctagctggccccactacctccaccagcttctgatgtccccagagcatctccatgcacactcttgggatactggatccctgcccccaagagggcttacccaccaggcatcgcttaaacacccacatccaccaccaacaacaaccccacaatgactaaaccacatcctgaagcaggtcaaaagtccaaatctgaggtttcctgagaacttcaggcttaggccagatagcccttcctggccttagcccacagtggacccagtgttccctttagacttctagagctaaggaaactaaggcccaaaaaggccatgcgattgaatcaaggtgggagagccactcggagatggagcagggattctgactagggcctatgggactctaagacccatgttttctaaactgcaccccgttgcctcagtggtgtgtgaccagaagacacggtgggtcaggagactcaaaatcaaaagacccttagagaggggcctgtgcctggcctttgtgcacacagagcagggaacatggtttgattctacccagcaaaaggcactaccactgccccaaagcacagcaaaatggttcagaggaccgagccatgcctggccacatcaaagtgaactctctcttcttacattttgagcccaactaccagatctgcgcatgtgctgtttcttctgcctggggtcccttcccagcaaactcctggtcatccttcaaattttggctcacacatcacctcccagtggcggggctttctagcgataagggtcctcttccccgcaaatgagcttctgttgcccattggcaaactctgacattaatggtagtgacaaagacccatcatgtgagcattatatgctctttctcatttaattttcaaaacaaaactatgaggcaggcacaattgaatctccactatacacatgaagaaacagagaggtggccaggcgcggtggttcacgcctgtaatcccagcactttgcgagtccgaggtgggtggatcacgaggccaggagattgagaccatcctggctaacacggtgaaaccccgtctctactaaaaatacaaaaaaaaaaaaattagccgggcgtggtggtggacgcctgtagtcccagctactcaggaggctgaagcaggagaatggcgtgaacccaggaggcggagcttgcagtgagctgagatcgcaccactgcactccagcctcgttgacagagcgagactctatctcaaaaataaaaaaagaaacagggaggtgaaaaggagaggtacctgcctgaggtcacatcccggtcattgttggaccctagagcccaagctcttggggtgactctgccctgtctatctctgcagaggcctgggcacaactctagggtatgcgtcagggagtattcatctctgcccatggcatgggacatagcaaatctctggaaagatttgctggctggctggctgaattcctgtggccatttaacctgagtaaactgaggctcagaagtgagatgatcattgttgcaaatgaggccccaggcctccccagcgccagactaggagggccctggctgcctctccccactccacccccagcctagagcagcaaggaagccacagttcttccatgtattcctgtgcccacccggtccatgcgatctgcacgcccctgtcttgggcagacagcagcccgtcccaggagcaatgctatggggtccaagaccgggcggatgttgggtggaatctgagaagctttttacatgagccatgtgggcatagtttgtggagggcagactggcaggtattttctttctaatatgcaagcaaaacgtgggtgcacagacagaaaccaaagtcctctgaaataaacatgataactagaaagtgaaacgtcagtctgggcgtggtggctcacacctgtaatcacagcactttgggaggccaaggcaggcagatcacctgaggtcgggagttcgagaccagcctgaccaacatggtgaaaccccatctctactaaaattacaaaaattagccaggtgtagtggcgggcacctgtaatctcagctactcaggaggctgaggcaggagaatcgtttgaacttgggaggctgaggcaagagaatcgcttgaacccgggaggcagaggttgcagtgagccgagatcacacgattgcactccagcctgggcgacagtgggactctgtctcaaaaaaaaaaaaaaaaaagaaaagaaaagaaaaaagaaagcaaaatgtcagcccctgataggccctgctgcctttgggatccagtgtctgatcaaacgtgctgaggacaggagctttgaccttgactcttcaggtccaagttgggtcccagccccttcctaggccttaggcatctcaactgaggtctatctgaggatttgacaccagtccccatgggtctgtcaggccagcagagggggtgagctcgtgggtatgaagttttctccctgtggctgtgggagaagcatgagtccttggctcatgagtgcccgccgccctctggtggctggtgagacagccagcctgagggcagagctgggcggggtgaatccaggtggccctacctcaggcagtattcgggggggctccagaggcccccctgcaggcctggccttaccaccatggcctaggcagcctctctggctcctccattttacacctcaaagctgctgagtgatccttctagaaaacagagctgcccttcctcactggaaaccttgcagtggccctggtgtctggatcactaggtccaaactctgtggctggctcccacagcctggccccagattctctccagactcataccgccccctgtcccaccaccttccaagttcctcccatctccttatcaagctctgcgcttccctgtgtctgcatgggctgcgccctctgtcaggtctgccagccccctcttctccagtccaagcctctgctagtccctgcttaaaggtcatgcctgggacccctctcacactaaccacccgacctgggatgggtgagtccctccctccttcgttctcaggaccctcacagatgtctctcagggactgatcgtctcccttggccaccccactggacaggcactcttcagaggacagatcagcttcactgttcttggtgtccctagggcaggagccagtagtaaccagacagcctaagggccccacatgttcccccaccgcatattcaggccccctcctctagccctggttaccatagatcttgaaggcatagtttgccttgagctctcggggagccgactcgcagagcacggaaaacatgtccacaaagtcgttgaaagtgaggttcccctcaccatcctcggaaaacgccgccacgatcctttctttgaagggattctcctgaagaaaacacacacagcaatcactgtgggtgcaggataagcaggagggccccggagccagactgtggacagcctgtgtgaccctggaggagtgaccaaatccctctgagcctcggtttccccatctgtaaaaagggaataataataacaccttcttaattgggttgtgatgggattaaatgagctaaagtatgtaaggtgttggtaccaggcccggcacatgtaagagctcaggaagcattctactgggtcatgtcacatcattaagatgggcacagccagggacagtggtgcacgcctgtagtcccgctatttgggagactgaggtggaggaatcacttgagcccaggagtttgaggcttcagtgagccatgatcgtcccactgcactccagcctgggcgacagagcaagaccatgtctccaaaaaaaaaaaaaaaaaaaaatgctgagcacagccagtgtgttatcactggaggcactgcctcatctgaagcagaagcagaagcacagattcgtcctgttacccagaagagcacacagaggctctgcctggatgtgtagggctctgtccccagcagaagaagatgacagcccagggcactggtggccctcagctcaggccgtgtcaggccaggatcgtgggaggtggatgtggggtcagataactggaccagtcaagcagcaagagccatacagccagttcaggcccaggtctgctgtcactctgctcctgtgaattctcccctagaccaccttggatgctgcctctcccagggagctgtacacggatgccttcctagatccccaaatcactcatcctgcagcccttccatcccaactgagctagcgcttggctagcgccattccgtgcccagcccaggccagtgcgggaggctcagagacagaccacttgggtcctacccatgagtgtctcacctgctccagcaaccctctgagcttgctcttgagccccttgctgggccagacggggtgctggtccagggctgagcctggggcccattgtctctcaggactgaggtcacaaccagagtgcaggccccaagtggatgccatatagcactctgactccaccttcaagccacacatcccaggcctggcaaggggctactgacgaagtcccactgcaatggggagttgtgccccaaatgccttcttaatgctgaatgcactttacatattatggataaggaactcatgaaacgaaacattcagatatatatggtctgaggatcagcagcatcagtctcacctgggaacttgctcgaaaagcagaatcctgactctactccacatgtactgagcctgaattggcatttggacaagatccctggggagtttaaaattaaattttaacaggtacgttaaagtctgagaaatgatgctatggatgaccaccatgctgacctcagtgagaagccacagccagacaacggggagacagaaaagttatctaacaaagcagacacaggtctgccaactacagcaggcttggggccacttaacaaagggacaagcaaatgagcacaagcccatggcctgcagttgggtggccactgatgtacagcacccttacagagcccacatagcttatttattcagagtacagatgaggaaactgaggcacagagaggttctgtgatctgctcagagccacgcagacacaaagggtggagctgggttcagcctagacctgggggcctctgctgctggtccagaggcacagatcccctgctcgccagcaagaggtcctgcacatacccggagctctggcatctggatgatgaggctcatgggcacgtggacgatggggctcttcctgtagtccattgggacgaggttgggggccagctcatagaatcgcgaatgcagccttggaggaaagcagagaaaaagcgctggagggggtgccatccctaagccccagcagcccggtgctgtcctgcctaggcctctgcctctgcagaacatcctcagccaggaccaggtaaggggccaatgggaggctctctgctctgcccacagggtgtgaagttgggagggaggtgagttctgcccagacctctgtgctgataaccaggttgtgtccaggcctccctatttccaccacacccaccccatcagcaccaccaccatcactccttgggcctgggtccaaatcttttaattttttctcctttgggctctcataagggttttctatgctcaggatactgtgctaagcacttaacacatcacctaatttaatcctcctccacatcactgtgcagacagatgcatcctgaccccagcttactgctcagcaaacagggctgaagaggttaagagtgatttgtctaaggccacataactagggagcatcaagggccatgggttgagcccaagatgggaaatccaagcagaaactcttagccactcttcccccttacactcctgagggtccatcaaagcctgggcccacttcgtggccccaccaccccaacttaagccctgagggttgggtctctctgggagagctctcagcagtcctcacaccctcaggaagcccctatgaatgggtcacccataaactctctaactgggggccatcgggacccaggctgctaccctggtgggcctggccctccctcctcactgatgggtcaggtccctagctcctgtcccagcctccaggaaatcaagcccacctcaacaagctgcatggaccctcaaaggtgtaaggcatcctggcactgtctcacttggaagctcccttcctccccgccccctgcccattattcagtctttctttgccctatgtccacttgtccaggtccctgtcatcccagagaatagccccccatcccaagacaggtacaaattgtatttagatgacattgtgagctgcatgtggtggcctatgcctgtaaacccagtgttttgggaggctgaggtgggaggaccacttgaggcccagagtttgagaccagcctaggcaacacagcaagaccctgtctctacaaaaatgaaaaaaaaattagctggatatcgtggctcagtcatagctacttgggaggctgaggctggaggatcacttgagcttgagcccaggagttggaggctgcagtgagctatgattgccccactgcattccagcctgggcaacagagcgagaccctgcctctaaaaacaaaaattgtgtccattaagtgctgccatgggtgggacaagtgtaaggggcattgactgtgggctgaggtaggtaacctgcctaaagtgatgtcctaggctgctggtgaatggattaggtatgaccctgtatctcccaggcttgggccggccctgccacccccaaagccagatcagcccaggtctccttttaagtggcttgaccctgtgacacaccccaggcccacctttatcaagccattcagcacagccacccaaccttccttgggttctaccagttcttgtggtcctgctgcctactgtccttagcaaggcacctgactacttacccagctcaaacagataataacaccagctatcgtttagcaagtgcttactctgtgccaggccctgaactaatcttctctgtggattgctttacttattttaatccccaaatcaccctgagaggtagatattagtctcccattttcaggtagggaaaactgaggctcaagaatcaagtgtcttccccatcctacacagccaatgagcagtgggaacaggacttgaacccaggacctctggacaccaaccacttggctcctccctgcaagtcaagccctggtaagcacatcatctgctggttcagagcctgtccagggcaaatgaacagtaaaatgccacatgcccactttgccagtcgcacattcctataaaagggtctgaaattacaaggatgtgccatgacttggagacagagcaggaggggaaaacccctaaacttgtactttgggtgggaggaggctcagcaaatgccagggcggtgggatcaagctgagactctccacaagagggcactcaaggactttctttgctcctatttcttgcatagaggaaaactacttttttttttttacactgtccccaaataaggaacaaccacttgtttcaaaattcatgcatcttctttctttctttctttcttttttttttttgagacggagtctcgctctgtcgcccaggctagagtacagtggcgcgatctcggctcactgcaagctccgcctcccgggttcaggccattctcctgcctcagcctcctgagtagctgggactacaggcgcctgccacaatgcccggcacattttttgtacttttagtagagatggggtttcaccgtgttagccaggatggtctcaatctcctgacctcatgatccgcccacctcggcctcccaaagtgctgggattacaaggcatcttctttcataattcatgcatctggtactttgacatatccattgtgcttccaactgctacatttcccacttgaccttgaccccacctcatatgtggcagtgtgatgttggagtgtttctaggggttggcctacacctctgaagttttgtgggatggctgcagcaggagcatgaagtcaggctgaggttggagccctgcctacacctctcattagcagtgtgggtaagtgggttaatccactgaaggataagtttctctatcagtaaagcaggggctattctactgttctcacccctggatgttcataaaaccactggccttcaactggcagcttttagcatgctgcctgccacgtcagaggctccctggaaggggtggactagggagagaggctatgggtgcttggcagggttgaggaggtatcctctggggtgggaaggccagcttctaccctgggacacagatctgttctaaaacagtaactaaaatcacattggaatttttctttaaagaaaaatccaaggagaatttgaaaacccaaatcactgtgaaagaaactctaagcattgtcaaagaaccacatctctgtcacctctcccccaataaagggcactgaattcaagaagagttatatattagtcctactgtaacatccaggaccagaaaccatacttacgctacttgaactgcccccgagtatgaggcaagaaatgtgaaaactctcactttattttacaaagttaacaagaaccctgatacaagaacctaatatgtagcatccagaatggaccaatggcacttgcatagatagatgaaaaagtcttataaaataacatactgggggccaggcacagtggctcatgactgtaatctaaatgtgctttgggaggccaaagtgagagaattgcatgaggccaggagcttgagaccagcctgagcaatgtagtgagaccatgtctctacaaaaaaaaaaaaaaaattaaaaattaggtggatgtggtgatatgcatcagtagtcctagctactcaggaggctaaagtaggaggatctctagcctgggcaacagagtgagaccctgtctctaaaaaaaaaaaagataagtaaagaaagaaaaaaatagcatactggtaaatcaaatctaagactttaaaagaataatatgttaggatcatgtaggatttattccagaatgcaaagatagttcaatatttggaaatctgtggctacaaatcatattaagcaaaaaacattttgaccaatttgatagatgcatttatgactgtatatgtgaatacagaaaaatatctgagaagttatatactacatgtttacactgatagtccctgggaggtgggagtagagaaatgtgaaaagaaggaggctaacttttacttgttatttcacctacttctcaattatttgaaattttagaagtaattatttatttatttatttattttttgagacagagtctcgctctttcgcccaggctggagtgcagtggcgcaatcttggctcactgcaacctctgcctccagggttcaagtgattttctcatgcctcggcctcccaagtagctggaattacaggggcatgcgaccacactcggctgatttttttatatttttagtagagatggggtttcgtcatgctggccaggctggtctcgaactcctgacctcaagtgatccaccacatcatcctctcaaagtgctgagattacaagcatgagccaccgcacctggtcaaaagtattttaaagtatatgttgttttgtcaattaaaaaaacttaaaattcttagtaaaacagaaacaaaaggagtttctgcttaggagcagaaacaaaagggtatctccttctctttttttttttttttttttttttttgagtcttgcactgtcacccaggctggagtgcagtggctcaatctcagctcactgcagcctccgcctcctgggttcaagcaattttcctgcctcaacctcctgagtagctgggactacaggcgcccgccaccacacccggctaatttttgtatatactggggatatacccatcaatgtgggatgcctataatcaccattattatataacatttctccccaggagcactaatcaatgtactattcgccatccaggtccatgagttctgcatatgtgagtcaactgaagacagaaaatatttggaaaaaaaaaattgcatctacgctaaacatgtatagattttttttcttgtcattattccttaaacaatacagtatagcaactctttacacagcatttacattgtattaggtgttataagtaatgtagtaatgatttaaagtatacaggaggtgccgatttaaagtatataggaggggctgggcacggtggcttacacctgcaatctcagcactttgggaggccgaggcgagccaatcacttgagcctaggagttttgagaccagcgtgggcaaaacagtgtcacccttgtctctacaaaaaatatatatatataaattagtcaggcatggtggtatgtgcctatagtcccagctacttgggaggcagaggtgggaggaccacttgagcccaggagtttgaggctgcagtgagccatgatcgcaccactgcactccagactgggcgacagagatcctgcctgacaaaaaaaaaaaaaaattatacagaaggatgtgcaaagtggataaggttatatgcaaataatatgccattttatatagggacttaagcatttgcagtttttggtatccttgggaggtcctagaacctatcccccacagatactgagagaggaatgtaattagttaagacagtaaaatagtacacttaaatactggagaggaggcaagttaccatttactggaaaaccaaaaataattagcttaaagactatttgaaatagaaagagttcagaagcctttctacacaatagtttttctattatgtattaacattagccttttcaaaagtaggatttggctgagtgcagtggctcatgcctgtaatcccagtgctttgggaggccaaggggaaaggattgcttgaggccaggagtttgagaccagcctgggcaacacagtgagactgtttctataattttttttaattaaaaaaaatgaattcacaatttaaaagaaccaaaaaaaaaaacacaactaagtataaaattggtataaaatgtactaattttgaagtatcaaaaaaaccatgaaagtttaacaaaagatataaaaatattttaggtacttagataactattgtgcattcctgatcggaaagacttaatgctgtaatgatgacgatgatctgttcatttttctataaaatgaatatgaccctaatcaaaacctgcaaatgatctatttgggatctagccagcccaattcaaaagtgtgtttggttaagtgtttcttcaagctactggcaaaaaaaaaaaaaaaaaaaaaaaaaaaaagtttgtttaaaagaataaatgtaggagtgttgcaggggaaccctgaaaaaaaagagaaactggggaaacatttttccctatcaggtattaaaacagtttaaagctataataaggacaatgtatgaaacagacattggcatttacaaggcagactagtagaagtggtagatcccaatgtaaatgagaatgagcccatgacacagcatttgaaatcaatggggaaaagattaattcctctgaaagtcacaaaccagcaatccaccattcatgcctagtttccatatagcattttaaaataattaaattacgtcgaaataataaatttagaattttgctgccaccatatacagattgaaagatcttacactataaacctgggtttcttaatcaagatggtctgaattcccccaaggcaacaactagctggggctaaggagcagctatttctgcaggtgtccgttctaaagagttcccacccgactagacagcttcatttatttacagtgcatgctggcccccctgacaggcagctgagcttcagactcttgggttattcactgaatgatctggggtcagaagacaaaaagcatataacagcagtgggaggaaaaagcaaaagtcttaaaaatatccattatctttgatcaggaaatttgttggaaatacccatatatgtgcagttatgtgaatggtaccacaagaatattcactgaagtacaaattaaaatcgtgaaaagctggaaatctaaatgttcaactatacaaattaagaaatatccattaaatgcagccatttaaaatattgtatcagaatatctaatgatattgaaagttgttcgcaagatgttaaatgaaaaaagcagaaggtacagtataatcccattttttttaaaaaagcttgtatatatttatatactcacaaaaagaaagactaagaggaaggctggtcactaaaatgttagtgattatcttgggtagtagggggacagtaagatcttttttcttatctttttttaactttaaaaattgtgataaatggctgggcagtggctcacgcctgtaatcccagcactttggaagcccaaggcgggcagatcatgaggtcaggagtttgagaccagcctgaccaacatggtgaaacccgtctctactaaaatacaaaaaacagcctggcctggtggcgcgtgcctataaccccagctactcaggaggctgaggcaggagaattgcttgaacccaggaggcagaggttgcagtgagccgagatcgcgccattgcactccagcctgggtgacagagccagactccgtctcaaaaaaaaaaaaaaaaaaattgtgataaaataacagaaaatttaccatcttaattattagtttttctaaattgtggtaaaatgcacatgccataaagtgtaccatcttaaccattttgatgggtacagttcagtggcatattaaatatgttcacattattatgcaaccatcaccaccactgatccacctccagaactctctccatcttccaaaactgaaactctgtactaatcaataagttcccattccccctcctcccagcccctggcaaccactattctactttctgtttctaagaatttgactacttggctaggcctggtggctcatgcctgtaatcctagcactttgggaggcagaagcgggtggatcatttgaggtcaggagttcgagatcagcttggccaacaaggtgaaccccatctctactaaaaatacaaaaattagccgagcgtgttggtacacgcctgtaatcccagctaattgggtggctgaggcaggagaattgcttgaacctgggaggcagagattgcagcgagacacagactttaaaaaaaaaaaaaaaagaatttgactactctaggtacctcatgtaagtggaatcgtatatgtcattttgtgactgcttatttcactgtgcataatgtccttaaggtccatccatgttgtagcatgggtcagactctccttccttttgcaggttgaatagtgttttattgtctgtctataccgtgtttggttcatctattcatttgctgatggattgcttccaccttttgtgaataatgctgctatgattgtgggtgtacaaacatctcaagactctgctttcaattcttttgggtatatacccagaagtagaattgctggatcatgtggtgattttatttgtaagtgtttgaggatccatcatactgttttctttagctttcttatctacttttacaatttgcctaaggaaaagcaattttaagcatatatatacttttttttttttgagatggagtctcgctttgtagcccaggctggagtgaagtggcatgatctcggctcactgcaacctccgcctcctgggtcccggttcaagcaattctcctgcctcagcctcctgagtagctgggactacaggaacacaccaccatgcccagctaatttttgtattttcagtagagttggggtttcaccatgttggccaggctggtcttgaactcctgacctcatgatccacccgcctcagcctcccaaagtgctgagattaaaggagtgagccactgcgcctggccaattttaagcatattacaaaacaataccatctgcctttttttttttttgagtcagagtcttgctctgttgcccaggctggtgtgcagtggtgcaatctcaactcactgcggtctcaacctcctgggctccagcacttctcccacctcagcctcccaaggagctgggactacaggcacacaccaccagacctggctaatttctgtattttttttttagagacaggggtctcaccatgttggccagactggtcacaaacccctgagttcatgtaatccaccggcctcggcctctcaaagtgctaggattacaggtgtgagccaacgtacccgaccacaatctgactttttgataaacacatacaaaagaaaaacactggcataatatataccaaaagattaacagccttatttctgggtcataggcttacaggtaattttttttgtcttctcttgactggcttcattttctaatttttctacaatcattatgtatatgtgtagtaagtaattaaaataggttacacaaagtttttaaaaggttgagaaaataaacaataaaataacaagtaggcaaataccttggagtgctggctgggtgggcctctctgtgtaccaaggggacaaggactactgtcccgctgattaaagagcacagcctaattagggcacaagggaagttgaagtgctaagctcttacctataaaaagcaaggtgactgaatagggtgggctgcccactcggcctcaatgtgggaatgcaggagctgtgtcctggggagcaatcggatctacctgggtgggggcagggcagagggaaggagaattggaggcgggctatctgtgactcggtatcactgccccaaagttgccacagagctgggccccaacctgcaaagaaaaacctcctgctcaagtttcctcctagccatctggtcagtacgcagggagcagcttaccaagaaaaccatcctggtgggggtggggagtagcatccctgaaaggcccttgggagcagggaagatgagcatggcctggggctggatagcctggctctgcagctgactttgccctctctgggctccaggcctcagttttgtcacccggacctgagatgtgaacagtggagagggctctcctggaggggcagtcagtcatgctggcctctccacagagaaggctggagaaaagcgaaggggggtgaaactggaattgagccatcatggccatgcctgttccctctagggacaggcaatcccgaatctgtcttgtcttaactacccttccctgagggtggacaggtgggcagcaaactccaggtagctcttttcatgtttaataacaccatcacccagccctcccagacacaggggcctgtgagaaaacagctcctgcaagcaatgtcatccccatgctgcagacggggcctcaggcttgggttttgctctggtgttgaattacagagcctagggtcctgatgcgtgcagaggggtgcaggccagggctgtggggagccaggacgcctctcctcaagccctctcacctgcctggagcccctcattttccaaggggccagggatacccctgatatggtttggctgtgtccctacccaaatctcatcttgaattgtagttcccataatccctacgtgtcatgggagggacctggtgggaggtaattgaatcatgggggcagttaccccgaggctgttctcatgatagtgagttctcacgagatctgatggttttataaggggcttctccccctttgcccagcacttctctttcctgccgccatgtgaggaaggatgtgtttgcctccccttctgccatgattgtaagtttcctgaggcctccccagccatgtggagccatgaatcaattaaacctctttcctttataaattacccagtctcaggcagttctttatagcagcatgagaatggactaaaacaaccaccaaaggcccatcatattggatcggattcccggactggccttcaagctcctctctcctcttccccacacaggcaatcttgctgctgtcaatgagaccacgggaggatgggggtgggagtgggagcaggagaagctggcctgtgtctcacctctgctgctccccagcctggaatgttctccctcagccaatcctacctgtctttcacccacacactcttcatatggtcactggtggctaacaggtgccatgctccctgttagtcctgcctgatcacaagtctggtggggagctgggcccctgggtccaggaacccaaggagcccctaacaggctgttagagcagctgggatagcactagggtggcagggtgttgggggtgcttataaaggagatgattctggagttgggtctggaaggatgcatagcaatgctgtgggcagaggagaggcgaaggacactccagggagtggagatagccagtgcaaaggccgaggcaaggggcttttgttgccagaatgaaaatggccgtgggcctcagaagacaggcagcttgggcttggcatctacaaaggtagggaacccgaagctccctgtgaggctcaaatgaggctccatgccaagaactctgaaaggtaaaaggtgccacaagaatgccaggggtgacagctttgttattccaataccgagagccatcctgtcgaaatggggacctcacccctgacatctctcaagctacagggcaaatcccacttatcaaacactataccccagtgttgctgcctctcggcaatgctatgagggtaggtttcactatccctattatacagaagaaaactgaggctcagggaaggtcaaatggttgcccaaggccacagatgccaggtctactgatgccaggcctggaggctttgccccttgctcagactctctaaggtggtggaagtggggtatcccctgcccatgcaggtgacaggttggaatagcagcctgggtagagaggaaagccgagaggcactgcctgaatgagcagaatggttagggcagtgacaagctgcagcacagctctcttgggaagctgcaatgggctctggtcccagcctgaccatcgatctccagggcaagtgatcctgggactttgctggcttttagtgccacccaggcagaggggcctagtgaggcccgtggggcagttttcttggtattcagtgattcctgctcacccactggtcctggggttctgaggctgccgatcccctttatctttcccatccaggtccacccccacccccatcaacaccaaggagaagggctgtcctgggaagaagcagagccctgatgaatagctcaggggtggtggccatgccctcaacttttagacgtcctaggagtggaagaacatcaaagctagagccaaagggcccttagggacccctggtctaacagacagggactccctgctataccaggacccaggatgcagtgaaatagcaagggacctggagtcagaggctgggtcttgagtccctggctctgtgactttagccaagttgctaagctccatctgtcaaatggggataaatggattctcttgttacaaggtcacaatgaggattaaataagaatgtgccggaaactacccacctgaaagctcatagtaagtagatgttcattccccagcaggaggatctgggccctgggaggagtgggaagctctaactccatcctagcccagtggccgagtggggacctgaatgtggctcctgatacatgctgatgctctgcctcagccccaggagcacagccagcccatgtggggtgccccagcctcaccccggccccagtcccagtcccaacagggtgaacgagaagccacacttacttgaggatgtccttcttattgaagaaggtgcagtcctgttgagggaaaacacacaacacacagtcagtgtgcggctcccagactttcttcctcagaggcctcgatgccacagggctcacaggggatagctccggactggggacagaagagtcactactatccctttccaccttgccctcacccactggggacagctggctctagtaggtatagaaaatgcctcccaaaacctttatccatcctgggctaggcctaaggagcttagtgcatggtggggggctgtagcatgctttagggtacacatgtaggaggaagatgaatgctcacaggtatgcgtggctgatttgagtgccagtgggatacactgggggatgacagggaggtggctgggagacaactccgaatgaggacccacagggccacctcgtgtagctgcatggggtgccatcctcactgtagccctgagcatggtgctaggggggttgtgcagtcccaggctcagagactgagagttccaggcacatagactggggaagcatcagtatatacttggtgtctgaagccagaaagggatgaggtcacccagagaagggagtgaagaggccagggagatatgggagggagaaacgtgggcagggggaaccaggtagcatctggggtagaggtgagggtaggggctgctggggatccccaggtaagcattactccaggtggggggcagcacttggctcctagggccatccagatgacaaactcatctcggaggggtcctgtctttgtttagatgaactgcctctatccacagcttggcctgcccaaggtgagtatcaaccactgggagtcagtgacaatggccactatgccagcccttggtgaaaagtatagaggtgaagaggacccagcactttgtaaaatgcccaaccgtaaagggcttttgtgcacctcccctgctgtttagctcctccgcctttgtccactgttacagcatgaagcaagaaggcctcctaggtctgcagagcccagagcccatagggcctcctggggccataagctgaccagagccagctctgatgaggagtgaatggctgaaactcaggcctgcaaacagccaggcttgccctgaatgagacctgaagccgctggacatcagggcaattggattgcgtgttaagaggcccaaagagaggacgcctgcaggatgcacacaacatctggggtttccactgggtgccttcgggagagctgaaaaggggagagctggtgggaatttccaggccccatttggcccaacaagtctgtccttctaagctgctgctccctgggagttagactaaggatccatgctggcttcttggaaacacgaggggttctcctgggggtctcagctttgcttttgacagtggttcctctgtaggagcccagaaaggctcaggctggggaagcagtgccccctgctcctcacccaacacagacagaaaactccctacttagcaggcctcaggcacagacaggctggagacacagtgggctgatttatcagcaaactccagaaacatggtgcagaatgtggacttccctccaccccagggccgtttccatggtctaaggtgcccagtgagaagggccagggctctcccacctagcctggaggaggcagtcagcagaactggaaatggggagaggtcccaactcctgctctcttccccccgatctgtcctccttcccctcccctcttctctctcctatcccatgtgttggaaaggaactatccaggtcctgattcaagggttctcctgacaaaagatgcaaacacttcccctataaccctgctccctgtcacaattacttacacctccctacatcaatggtcctcacgctgtggctcctggaccagcagcatcagcctcactgggaacttggtgaaaatgtagattcttaggctccactccagatctcttgaatcagaaactctgtgggtggggtccagggatctgcactttaaaaaaccctcccaatgatgctgatgcatgttgaagtgtgaggaagtctgctctagagcagaatcacttgggggactgtttaggatacctgtgtcccccatccctcagcagaccccagacaaattgtagagaaatccccaaggatggatccaggcattggctgttttcaaagccactcaggtggtcccaacgtgcaacccaggctgaaaaccacatcacaaccagtacatgatgtaccatgcacctggcacctggggctctaaatatccaatttttcttaatccttatcattagccaatgggggtgggcattatctctctatcttaaagatgggcaacttgagactcagcaaagttgagtagcttgccttaagttgcacacacagcccaggagggctgggaatggaacttaggcctctgtgcttccctttcccctgccccccccccttttttttttgagacggagtcttgctctgtcacccaggctggagtacagtggcatgatctcagctcactgcaacctccgcctcctgggttcaagtgattctcctgtctcagccttccaagtagctgggattacaggcatgcgccaccatgcctggctaatttttgtattcttagtatagagatggggtttcaccatattggtcaggctggtctcgaactcctgacctcaggtgttcacccaactaggcttcccaaagtgccgggattataggcatgagctaccacgcatagccttctttttttctttttaatgggagtagaccttggggccctcactggcaaggaagcagaggcaagaaaagatcctctgtgcttcttggccactgcctatgactacaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttg

SEQ ID NO: 130 - DNA, 319010 bp, Homo sapiens
aaagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggtacgtaccctttgcctccgctgttcccggagggtacacctgggagcggggtggtgggcacgaggaagggacggcagggaggggcgctggttaggaaagagaacaagcctggcaggtgaccctcacagctcggaggaggcttcttctctagaagttagcgaccggctgtaccctttggctcgaaaaaagtagtgctagagatgtgactgtgagcattcgtgggtatctctgtgtgcgccaggggttcgaatgggtaaactgatccctgctttcctgtatgcaaattgcattctctttccccacccccacttcaccgaacgtgttgaggtacctagcacctaatcgcggtcagttctacctacctcttcctctcaccgcgcccccctcgctcaatctctctctctccctttatctttcccctctatctctctctgctggtgtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtaagtcttggaaggttcggggctttcgcatttttaccccggccgggaggcaaggaaactggggacacgcgggagaagggttacgccgccagttcagtgagagcagcttcctagcagctgtgttggagcaactttggcaagctggtctctggattcctgcggattttccggggttcccaccccattttctgctccaatcccccagtctcctgcgcgtgattcttgaaaggggctagggcgccccagacaccctaaacccaaggaggtagtgagatggggtgctttatgtgatagagggccaacgagaagaagtggaaggcaggaactctcagtagctcatgcacagagtttaaacgaagggaagtgggggtgtagttgggtggtggaaagaacaaatctgcccaggtctgtgagtttaaaagtgaatctacccacccacttccccgatttggagatgagacacataaagaagcgcagttaactttctttgacttgtaagggttccgacaggataagtttaactatcaggggtactgcaagcaatcggagttaggacagagatactccagcaaacatgtccaccttcctctcgtctcgacctccccttttcatcaaataactaaatcccatctccagtgactagtccattattagggaatggtaggccttgtcgccagggagagaattctaaacaaagccgcggtccttgtccttcagtagcagagttttccggggggctggactttgtacactgctggaactcggctcctggttgaagagctttgttgtggtgaattggtagctgtttgtgccatgttgagacaaggagaatgagatatttcaggtctggcttctggggtgggaatgggggaatgggggtaagggacacttgtgccctgctggtgaagttgtgttcagtgtcccgacccccatagcccatcctgggctgcgggagtgcaccgagggctcgctatgttctgtctaggggtgaggtgcgctaaagcagcccgaactctctgatgggctacacctctgattggaggtgatactggcgctcctcaatcccaagagccttagatagaacccataagcctgaaagaattgccatccctacaattgacagcgtttctcggccgttgccctggtgcatgtggctgcaaagctgcgagttgtgtgaattctgtgtatgtgagtgacacgtatatatatgtgtgtgtgaatgtgtatttaaccgatttcagcttcaatccaagaaccctcaatgttgcctgtctttgcccctttatcgcctgaccgtagcagccgcggacgccagagggcgctgcgcatcagcgtcctcgcccacaggacaccttggggtaaacaggtgaaagccagggcagccaatccaaaagaacagcctttctgactctgtcaccgaagtctgtgcctttacccgctggaacgcaggcggaatgcaaaaagtgtccttcccatttcccatcttcaatcattttcacccccacctgtgttcagtaagcccactgacattgagagaccatggatggagggcagaaagtttggccagaagaaatatagaatttttttattgagagatggggggagggaatgcaaagtgaaagcgacgggggcgggggggaggtaattttaaggattcccttgaccatcgtaacccgcttgcccttttcctctgcatacctttacgcctgacctgaacttgaggactgttcttacgtccttgggctgtgctcacacacacggcaagggcttgtggctatggtgcagtttattgcttggagcaagtatttcgatagtctggaaaataatctatcaaaagcagaagtgaaatcaatactttgtgttaaattttaaatgtgtttgttggcagttaaaccgttttccactcattacaacaacagtgctggatttattctaatgcgctgcgttctcaacaacaagcgcattaattctcctttaattgtaaactgggagcatttgaaaaccattcagtgtgcaaattatgctgattcaattaccgtttagttacagacttcattacctgaatgccttttggcaatacagagaaaggagacaatttttccaatttcactcaaaacaatacgaaatgtgaacaataaaatagagaaggctatttagaagtccgttcttttttctccaatctaaagtacttttgtgtgtcggggactagaaaccacatgcaccacaaaaactacagctgatggctgtgacccaaggcagtatttccagggattgtaatcccatggatatttgccagcagaattccgagctgttttcctgaaggagcaaaaagctgacttctaccatggaaatgaatttaaaagggtgaattgggcagtcatttcgggatggttttaggcaaataaagaagtagagagccttgattaaaactctagggcaatgaaccgatcaagaagtgatcaaggcttctttcttcatctatttcattaaataccagatacagttaactggattgatcatttgtttgtagctgcacattggaagatcttatccctttgtaagaacctgcactggatgcatacagattgtcaggagctgctttaagttacattcaaagaaggcaagagtggcaaaaccattattttaattttctcttgaactgacataagccagggaagaatttgatggataatttttgtctttgtgagctcacaccactagttaagtgcctgcatcactctgtttatgccttacctcttagctgatatctcagtgcaccttgacctttaagcccatggtatcctagttatgtttcccagggagtaatcaccacattaagtccatgaaacaagacttgtctagttatctcctaaagaaatatttaggcttctgtttaaagtgaataccttaaatacccccaaatttgagaataacttcttatgaaaactctgcagtaggtcaatgccccacaccaagccacagtttcctacctgtatttgggtgaatgtttgcaaagtatgtttctgggcccgggattctttgaatgctttaggttgaggatttttgtgttttttgagagacaagtctgtcctagttcaaaatagaagcttattttagtactttaatgggaaactaattagatatgtgcccacagagttaccttctgaagcatgttagctggaatactcaaaatccaccacaggacaagctccagccataaatgcatgggggtgggaaactaacttttaaaaataaaggtaaataaaatttcagactattgaatgttatgtattgcagatttaaaagcctgaattcaataggagagaagtctatggttaacaacgcttattaaaaataataaaaaagttttgcaatctttattctcttattattcctggaccaattccaggatattttcagtatgatacaatgggatggcaggatgatagcattttaactttattgaagcatatattgaatcagctagaaaaatatggttccttgctctgaagagtgggggttctaacttgaatcagcctcattggatcaagtagaaggataggccaggacaccaggaaagcatctcccacagggtgtggcattctgtttgggggctcacctgtggtaactctcagttagagaggtgagtctaatgagcactttctgagcatgctaatgaaaaagctactcagaaattgaatccaatgcatccgacaaggcattgtataaagttactgtgactagtcacccatccacagctctattctaatgagaaggggtcccaccatttctgctaggaattaaattgctaataatcaagttgctttttaaatcaaaataggcatgaattaaaaatcctttctaaacttgtgccacattatgagccatctattctctcaaatttgggatatccttaaaatgtgaattctacaccaattgtttaatagagtttggagagtaattaatgtatctatgggaccactacctctgcactgttaaaagctagatcatttgggtgaaatccactcattatgaagatggctgttaaggtatattggagctgggggaaaagcagagggagagagaccagcaatgtcttttctttggactaggtatgtgtgcttctcattctttaaaaattaagccagctgcacactgaaaattctaatcaatttgagcttattactgaaaataaacaaaataaaataaatttcctgacagtggctattaagtgttccctattaaggctagttcttggaggcagtactaaaagtttctcattccactgcatttcctgactcttctactacagaccagccttttagatacatacgggattcagactagatttttggaaggccctctaccccagaagcacagccttagaactcatcagttttaagatgtattcctgagctctgggggacacagaagttgctactattctaggcatttccctgaaatgttcaactttccattgaccaagaaagcagctcgcccaagtgtgtgggaagcacttgggtgggacacttttctgccccatttccagaaggattatcttggtctgaggccttctagtgacagctttagagaagctgactttagtattcggagagaaccaggattgctccaactttctcagcggtattttttcggaaagccattaaattcgtggctcctctgtgcgaagttgatttctatttggctttgaattgttgacggctatttcttccttaatgaaagtgttgtctgggtgaaaaatatatcaggtggctgggaaattggttgatttttttttgagataggtgcccagtgtcctatttttctatctgaggaaagattttctgcagactacagaaattgacagcattgtccgggtaataaccgtcgtcgacaatattttcgaaagggcatttgagtgccgaaagcatttggatattgctttttccaataagaaattttctgccctgagcttctttgattttatagggggtggggagttgactaggggggcgatggggaagaaggagcctcgcattggcaaagagatgccttccccatcctcccagtcctggaataccaaggtgcttgtcagcttcacctggaattcctggatctgaagagccctcaaataattcggctgcgagtcaaaagggaatttcaggaatgaggaataacactcttcttgcgctcctgtaaagcaagtgatggaagctctgaaagtttgcctgctctcaagtgggaagttaggaagtgtgcgttctttctgatttttttaaaaataaaaagtgtctagctttgattcgattcaggaaagctcctcttgggcaaccattgtccgttaggggcttcagatctcattttaagaccttaacagtcctcgccgttctaattaaggaaaggcaggcgagcctgccagccgagagcggttgggtcagcggcttcatggtgcagccgagtctcaaagcgggtctgcactctcgcctccctctgcattctcttagccactatttgcctggtcccgtcgcgtgtgtgcaggaagtttcagtcttgatttatccactagtcaagttcccgaccagctctttttctggatgtcagcactaaccccctcccggagcttggtaaacacagcgcgcgcatttttctgcctcagattggcatgttgacgactctgcttgaaggaatgtgacaataaagtgggaaaccaaagcttggcaagcacttaatcaaggataaaaaggttccgttgtaaggatgtcactcaatttattgtgaaagtcgaatgaattacgtttaatgaaagtgctccccagatgaatattaccagcaatttcctgagttggctctgtcagctcgagatgaggaaatgccaacccagatcagaaaagagcgcccgtctcaattactatgcaagctttccaagagcggctttttattgagataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccccggggtttcccagccgtagtggccgccgccacagctgcgcgctttattgtctgctttcagtcgcaggtgacctcgagcgatctcgacaggtttatggaaacacagatgcagccctctcgcgtccggagcccaagtccccatgcaaaagcgctgtttctgggtaattttcgtcgacgccaccaagcttcggtgcttttgggacagcgggctggatagcggcagttctcgggagaataggccgcgggctataagatttgatcgcgggcaggcgggcgtggggcacgccagggccgggagagcgactcttcagcaccacggccagcgccacaggctccgccccgcctggtgccagcagtagggcctgcctcccccgctgccgctccggctgggtccttaaagtcgagttagcactctcggtttccgcagatacctcctcaaggcccgctcgcgactgtgacgacccgcctaccccttccagctattcggggggcagctagctcccgtctctaggtccccagcatgacctgcggtcagaaactcttgcttgcacccctctccattaccacactcagtggttgcggcgtcacgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctgaggccctggcgagatttcggcctttagcttaagggccagcccgctagttttctaggactgggtataggccccgcctccacccaccgaggtcactgaactgcccagggtcttgcctgctggattacaagcctattcccatttctcctctcttccgcagtccaccctccctggcacagtctttttcacactcagaagttgcctgatgcccccgatggacagctgctgggatgaaacttgtattcctgtacaggtgtcttcgcagttacctgcaataccatagtacttagggttaactgaggtgtgtgtgtgtggtgtgcatttgtcagtgcctcgtcttcatcgtcttcatctagctcgcccctcccttataacagtgaatcaatcgctgcaaagaagataggatgtagcagttttaaaataacctaactcctccttcattgcagtaaaatgatcgcatttataataacattaatgagaacaaaattaaaaattatggccttccaggcattaaagtaatactatctgtcctcttctcttggattttcttttcctcagagcccagcctttttatggcatattgtgattacctgagtgtctttgtttccttgtggtcagagacagctagccaacacaatactaggactgtatgatgtagggcatgatttcctcccaccctcttcatttttagaggctttgtaattaaactctgtgagatatacgtaacttacatccagtggagagctcttttatttatatttatgtagcatgctgagaaaggaaaattaaggaagtgcttatattgaagtaataagcctgctttgatattaacagaattgtcctcttaatttacttttctcaagtctaaaggactatctctctgagatcagaccccacagtcaagcctctttaaagagaggtcccaataaagcgaaaaagacatttattagcttgtactaacttagaggaacaaaaggccaggcttaccactcactggaaatgtacactatggtaaagtgcagtatgatgcaggaagctgagcagaaagaggtgactggaaacagctgcagggccctacatttttctgcctccctgcctctaacccaccacaatgcataaatttacacatagtgtaacggggccttctagagctaagatgaagatacaaattggcaggaattttaatacaattgaaaaccgcagactaaaagaaagaggcactttcttctctaagaggttattggcacaaaaattacgacaaagatttagagaaaatttcctggttttaaagagcctttttcatttacagattacacatacacatatacacaaagcaaagcaaggttatatgtttctatgtattcacctctttagaggattccatggaaaataattgtggagaattcttttgttttcatataagttgttccaacatgggtttgaaagtaccatttccttggtaggaatctgatacctgacattgcactgttgtcctgtttatgtcagtgttttcagctacagaatgaaagtaattttggtaaagaggaactacaatggcatgatagctgaaattttagtcatgcgcactccaacctcttcaactgaactttagaaaatgattcttctccttgtaaccttgtagctggatgttattagaggcccataggtatataaaacagcttatataaaattaatggactgctttacattcacaatctcttacttgtgaagcccttgtaaaatattgcatctacttaaaataggaagaatataaagttaggtttggtgtgcaatcaatagttgtaaatggttcagtgaaatatttgattgttttgagtgagtttgacaatgtaatggaaatttattgtctgtcttagtgcagtgatatgaacactggtatgctaatcatgggttgtcccttcttttatgtacttgacgtgttttgaaagtgattgtaagagtccaaggtaacatctaagtacataatcaaaattttaggaatgatgcattttcttaacttaccagatacaaagaaatttatgggtcacaaagaagtcatggctaagaaagaaaaaggcctgtctaacattgctttattattttgcttaaaataatcaacaatatatgagttatgtattgttgatattctgtatgcatttttgaataagtaaaggaatagaggttttgattttagcatcaaacataataaaaatgaggctttttgaatgtagttaaatcattaaaaccaaatctcttcctgttttccacaggcacaatttgaggtccttatttttttcttcctccaaacagaaattaaaactacattttctcatttattctgttacatagtgtatagatctctaagaaatgccataaattccactatgatttccttttttcctcactgtatatttatattgggggaatgaagcattttttttttcttaccttcctggactgagaattatacacggttaaaaatcatggtgacattttaaaaagctgttcccctccccatttcattccaatgataactagaatagtaatattcttttttttttttcttataagaatgaccactgcactatcctgttaacatctcctctaaatcagaaacagtgccgtgacttatcaactggctagatgcactgctgatgctgcccaatacttgatggaaaactcttaaaagcataagctgggctatatgagacctgttatattttctgtttgagaaattttaagtgaaaattccgtaattaatcctaagtttaattctaaagcctgtttgcagaatgatgagttgtgatttgttgttggaacagctgtggtgttagtaatagagctgtctatctaatctctgaaattgaagatacaaaacaactttactcacatatttttttccagttatttgtgaatagtttctttcaccagggcaccatcatttactgtgttagagaattaaatgcagagaaagatgcaagccactgcatgtgaaaggaagttattcatgcatggtcagtgtagtatttctctggtcttgatgtggaacttaattgctattgatgtggagattttgcagaacatggcagagtttttgcgtctttcacaagaaatatataattgaatgatgagtgcctggtgttagcttttcaaccttatttcttttggtttaacaatgcagaattgtgaacagctgcagcaaataggcagctacaatatctagctattatcaaataaatgcagatctggcatatgagctgagctaccacttttggatctgcacctcttgaataaacattctgaagtgtggaagcatgaaaagtgaatgatttgccctgaggtgtttaatcctgccttgcattcttgactgaaattcttcacaattagggtgactaacattaatatgtggccagatgcatttgcacagattgatggattcccccccacccttgatgttcctcgaacaagtggttaaaagtgtgagaggctttaaaggcaaagccacgtgcctccaggtggctgatattttcccaaagaccatcatcaaacttccagccaggtggataatatcatggcacccaaccaggtgtcaacactgaattcacttggctccaacgaggacctggccataacagagagcaaacaggcctgttttcagttatcccaggacctctgtctcagatccctcactgcaattcttaagggaagcagcattgtgaaagactggctaggagaaaagagaaggtaatggcaaagtatttccttaattctgtgactttgggcaagcttaacttctcaaatcctcaatttccctacttgaaaaatggggctgacaatacctcccacccattagagttattattgagaattcacagagttaatgtattctaaagagcttagaaaggtgactggtacaatgcaatgatgaactaacaaagaaaaaagtcttgctaacattttagaaagaagggtttccggaccaggttcccatgtgcttccagcacagtccttatgaatatgacacagaagggctgattctatcctagggccatattttttgtttccttctttcagctagttgatagctatatagttgctcagtgctgcccagaaagccatatgtatttagagtggatagttacctttacgattacagccagaagaaaatggacatttggctgggtgcggtgactcacgcctgtaatcctagcactttgggaggccgaggcgggcggattgcttgagctcaggagtttgagaccagcctgggcaacatggtgaaaccctgtctctactaaaatacaaaaaacgagccgggtgtggcggcacatgcctgtagtcccagctttgggaggctgaggcaagagaattgcttgaacctgggagggggaggttgccatgagctgagattgtgccactgcactgcagcctggaagacagagcaagacttcgtctcggggaaaaaaaaaaaaaaaaaaaaaaaggacatttctacagcaactagcgaattgtttatggaaatgaagagacaagtcatcaataggatcaataaatagattgcctaattgagatgagaatccttgtgatgttttaattccatgtggcaaacactatggccatttattaagatgtgattttaaatattaatttgtgagtagtatttgctttaaattacttttaacatttgagattatcttaaaatttgcacacagtataatcaaaacttataatagcctactgggtttcaaagtccaggggcctttggccagggggctttttcctattgaagttcattctagctgaatatctgagtgtgacacattaactccctggaaggacttgtcgaaacagtttggtggaatgagagccacagtatccctctcatatgctgctaaaaatatcttgtataggttaccctatgcccccttccaaggcattgccctgggtatccaagaaaagttcctacacaaaaacactattttgttttatatttgacattagagtggggaaggtgtaaagactactagaaaggataaaacgttccatatttctgtttatattttgaggcaagcactgtgccaggaccttaacatggagttttttccatttagttattttaatgaccctataagatgacatgtactattaatattaggtcatattaatatctttactgttaatatattaatatgctcatgctagtgatatggttgataatacccattttatagatgaggaaattgaggcactgagagtgtgtctggtgtaaggtggcaagattctatctcaggcagtcttattcttgaccagggcttttaatcattaacccatgttatgtttgtgttggagagtctcataaaaatatttcaaaagaaataactgttgccttccatttcaattaagagttctttttttctccctcctttgggcagatcttatttggggaactggggtctgcctaaattgctgttggcactactgtagttaagtagttttattagatgcagtttttattctttagggacttcccatcaaatggggatacaaagttaagaaatgcaagcttgatattgatgattgtgactgcagcttctgctcgtggcatgtgggacacaagcattttaggaagtctgcatctattgacctgaccaatatgaaaaatgatccctgggtctcagggtaaggtaagaagcgagactgggacataaagtacaaccctcagtcatctgtagtagatttaaaaatgatacataacatctgtatctcttctaacaaatcacactcatgttttttgaattatttgccatgtcttggcagcaggaggtggggagagaagagcagagttcacttctaagggggaaaccatatatacaaagcataaactctaactttcctgtggcatttaatctaatgagtcctgccatgctgacagcttactggatttaaaaggggatgcaaatctacactctttttaaattaaaatatttgcacaattatacaaactatgaaacttcaaatctgcttagtttaaaaccttacagtcaaaagagtttcagacatccaactaacttagcacaggtctttcattgcattctgcatgtgtaaagatgaagtagaaaacttccttgacaatattttatagaattattcagtctatgttggatctaggaatttatctatttctgaaaaataaaagtagatccaagacacttttgccccaagtggaaatcctctggtaagagatgagggaggagagtctggcttcatttcagtcttgtactacttttgaccttgggagagcttagttatgccttggggcaaaaaattaaatgttccattttgcagcagtatcatctttcacctttatgtggatttaaaaatgtaaataaaattgctttctgtaaatggtatacatgaaggtcatattcatattctccgcaagaattcaaaatgccatttgacccatcattggctcaatagataataatgtgttctattagtttctagtaatctactttttaagcattttatgacccaatattttaatgcctagttcctagtttgtgaaataagtcagaaataaaccttttagcacttcattgtagatttatttatagaatgtgtgctttcaactttgaactttaaaaaatgccaaatcttcccagaatatatttccttagttataaaattggtctggatgaacatctgcactgtggaagaatatgcatttgaaagattttgagggatctagcttttttttttttttcaactatcatctgtgttccttttgcttattttttcttatagatcccttaggaattagggtttaggaatcctgataacagagtgcagccaacagacttgggaagttaagtgactgttctgtctttcagagagcgggtgtctgaattatttttattgcaatttggataataagaccctgatagatccttgtatttaattgtcatgattttgatcgctaatgacttttgattgcttcttctggagacacctgtcagccgcttccgaagcacagatggctttatcagcagcagtaggagtttctttttcttactaaccttgagctgaacaaattattttgggaatatgaacataccaatgtcatcccaagtttttctgtctttggaacattattttgtttattgaataacgaattgagactgctctttttcaaaagcttttggattttgtttgatagtaaaaagcattagtcttttgtctgagtaggtatgtgacaattattcagtggccaaggccatacaactatggtgagagaatacttctctgtttacttggaacagttctgttttatgcccattgcctatatcaaaaacaaccctcctcttatattcagaagtatcctggtttggatgattaaattatatcatcgtcttacatgtgattcaatgttcaaatggctgactgagaaaggtcgatcatgagctatgaaagattgctgcataggcaagaagagtatttccatttctttttcatgatcctttccccattaggcattcagggtcctcatggacttgggtgcatagggttcaccatggtatgtctcatggaacatagcccaaactcttttccttaaaaatctggtaaaatttttgaatgaaaattgggcagtacacagttagttactggaaaagctgacagaagaaaactgactgattagccactcagatgtcccgcggtttgcatcagcctggtgaaattgatttggtcccaggcccggaaatggaactttgtcagtgattctagagttaatagatattcagaaataaactgactctcaccagaatacgtttttgatatacccttttcttgtgagaagaatatctgaaacattagagtactttcctttctaacaatccaataaccgaatccaagttttctatgctgacaaacccatccagtctttttgatatactctttctttaaatatgttaccaccactgatgaaacttcagttaaatagctgtaccatggacctgttgaatattcctcctgttcccatttttgatttattatatccactgaaggcatttttatctcccttaatgccttggttccttgataggctagaatctcattgacagccttgatttttcatcatgttttacagctctctttgtaaggagatgtaaaggccttgggagtagaactgtgaatgtatgatgctgatttaataggtcagattattcatggtggggaattcaagcaattaattaggatcctaggcaaagccatttaggtatgtggtggaaagaggggaaaagaaagccttttccatgcttctattcaaatgtttgacttgtttttctagtgggcatcctaaagacatatctcagttttcctaaatttcttaggattatagaagttggtgcctgataaagtattaaaaagaatggggggtagggtgaggtggtcctggggattgatactagagccacttcacaaatcttctgtttttgtaaatatattggcaaaaattaactggatccttcttggtaagaagcatcaatgcagattgctacttctgacagcccagaagatgagtgtacttcctagtttgcttttctggggaaagtctcatcagaacatgtaccccaggaatatagtatctgcaggcctctggcaagaacagagttaataatgataacataccagaatttcactccagtttggaaactaaaatggtctaaaagacagaaagaattaagtttactttcaaagatacttttttattttttacagaagtagaaggagagggggaaaggggagagagggagaggaagaaagaaatacttgtatttgtatttatactgtattcagaaactgtcatcataaacgtattaccctctccaatgagctgaacaattgacatgcgatcttgccttcttagtcaccgaacatctgaaaatcattctaaatattttaattggcaggaaagagacaaaaaacccacccaaacatcaaacatgcacaatcaccaaaaatgttatagaaatgcatcattggttgccaaggtggctgtatatgccaaacacggcatttttatttccaactgtggcattttgcagtggggttgttttataaacttagtatatgaacaaatacgctcttactcatgagttgtaaagaaccattttctttaagaaaatttaatatgttttatttattaaactgccttagaggaatattgtgtaggttattgttgatctgaggactaatgatattggtactactgcatctcagaagtgagtaattcctctaacatgctttacacatagtggttttaagatatttgttggttcactaaggataacggcttccagctctacccatgtccctgcaaaggaaatgatcttgttcttttttatggctgcatagtattccatcttatatatgtaccaaattttttttatccagtctatcattgattgggcatttaggttgattccatgtctttgctattgtgtatagtgcttcagtgaacatatgcatgcatgtgcatttataatagagtgatttatattcttttgggcctgtatccagcaatgacattgctgggttaaatggtctttctccttagcaaactaaggaacagaaaaccaaatactacatgtttgcactcataagtgcgagctaaatgatgagaacacatggacatatccaggagaacaacacacactggggccttttggagggtggagtggggaggagagagaggatcaggaaaactaactaatgggtactaggcttaatacctgggtgatgaaataatctataaaacaactccccatgacacctatgtaacaaacctgcacttgtacccctgaaattaaaatgaaagtttaaaaaaggaatttgtcgaatggaattttgtaagagaaagttagtggactgcctttggaacccagtagtttagcagtgaactctgtgatatggttgaaataatgggtaattttcaatgtcttaggtgttcagagtttaaaggggagatagattttaaccactacaaggtctgagacaaagcatttatcctctgctttgtgcatcatgcttctccttctacaggatgtttcagttttaccaagccctttgttcatttgtaaatttgacttgtattgattgggaagtgtcagaattagggccagtcatggagctagatgtagaagattttctgatgacatgcattggccattagccactctttctggcccccaccgtatctttcctcctctatgatatactcaaaattacaaataagtgcaaaaagcctctttaaaaagagaaacgtggctctagaggaacattggtggcttgtcgtagagttagaataagtcaacttttccagcaatcagtgctcaatggaatcccgtgattgaaactagagtccacgtacctattgggcaatatgacactcttagtgaattataaatttctccattcctggggcttactacattagacagtcatctttcctaggagccactgcattatatatatgtgctcatagtaagttgtatttcagagacagaaaatggatgaagagatttcaaaagaagtatgttttctttgataattgcaaaagatattaaaaaatagtctagaagtctaatttatgatgctgtttttttcatttgtgtagccattaacagtagagtaaattgtggaccagagggctacatgtttgtgtcttagattatcagaggtaaccttgcaatcgtatgccacgccattattttttgttagactgccatatgaatcaatgaattattccacccactatattgtcagttctcctatatacataaatctaataaaaggagattaaagctgtgtttgcagaattgtggcatacggctaaaaagaaaataaattggcttaaattaaagagcaacttgtggccactttaaacgactaatcctgagactttaatcagttgtcatgatattccatgtatgaagaaaattgatgtgcagtgtattgtgtcttggtgcataatctctggccctattttcatctgtggtgccattgaaaaaggaaatgagtggatcttttaatggaaatcaggactgttaacagctttagcagaagggtgaaaggtaaagctttatttcctagccaggacatttcagctcacaaggagaacagacttccctctttctgtacaccatctgcacagcctcgtggcctgcattgccattactgtccagagagaatgttaattcccagaaaggatcagaatttgagcaatgttccagcctggaatttcaactgtcataggctgtttgtgaagacaagttgggaggaaattgcctgctgcttatcagcatcctctcttcgttgcttcttccaaaagggtttcagccaatattcaatatcagatgctgttggagccactagcctataaaatattaagtggcttgttaaaaagcacattggcatacttataatttgttcaaaccaaatatgagatggcagggttttcttcccatgtgtcctaggggatattttcttgccaatcatttatttcctgacccttatagagaaggacaattctctggaatggtacacctgatccttgcaaggtcattaggcaattttctagatggagcctctgctctgaaaatgggaagagaggaaagccaggcatgggtaagtcatttgataagtggtgaatatgaggcatagggtagttaattgtcttacctgggttacacgtgttggaatgagaactctagtctgatgatttccattttgcccatgacagaaattaaagccacaggattttactgcttccccatctacataaagttaaagtctaatatgttactaaggagggccttacctaacaacactatgtttttaagggaggtagagttctggtttgtcttggtagtagctgattaccttgttgatcactgaattggaaataataatgaatgcatattataattgttcatcactatttcttgattctaatgttacaataatttcagcaattttacaatataatctgtctatctctgtagaattcacagaggttgtgggaccttgagtctggtccaagtggctctgtgtgctcagcatgtgacaaaaatgatgaatggaattgcaggtttaaggaaacagaggtcttattggaatgacatctgcttctcttccaggccagacatgacatatcaggggtcagtgaatcatggtggaagagaaatttgacaggcttgaaaacgtaactttttttttgtctatttgattttgagctgaaaaaccaaaacaaaagtagttgaatttttctattatccataactttttacatccaaatccataaagctatattcaaataactgcagtaagaaacacatttttgactttatgagccttacagtttaaggcatgttgcccttttatatctattccatgggtaaagtctagcttggtgaaagagacattttgcttttgatttgtgttttaagtttattccttgccagtgatttctaactccatttataccactgtccccactgcagcctagataaggtctctaactctctatccttcttagattgtcaaaatggtggcacaatatcttctaaacattgtccctggcgtctaggacaaagaacccctaatgtccacaaaggtcaattgaatatttatgcttgatacgagggtttttaaaaacattgtgtaggaactgggggttcttcccattttaaaatggcttttaagtggtgttttcaaactctttacctgtggaagaggcattaattcttggcttttccacttaatttctggtggccttgaagaaattctctttactgtgcaaccattttacaacagttggcaactgacacaagggaaataaatgtctacttctctggtctatgtagcctaaatgtctcagacaatcagagagcctcttcctaaatgggggaagaaaacaacccagagatgcaatctgtggctgggtcaggattggtacaccgatggagaaggcattgtcaagctatgcagcaaagaatcagggtgcctgtgacagctaggcctggaggcccacattcttaacatagttggaaaaccgagggtctagtcacatacacttctttttttgccattggtagaatgcttttcattgccctaattcttagtttttttttttttaattttattaaaaaaaaacttgaaaggagcctcagaaggcaggtaagacaacttcattggtccatttggtctcatatagctcctggcattctcccattgttcatacttgtattttctcagcattctccttgactggagtgctcagttcctggctcacctgaaatatttgcatacttatcccttgcttctcagccttctggcaaagactaagtggaggctatgtgtgtatattgatgtgtttaagatcaaggttggcatttctgtcatctttgttgccattgattaaaataattgaaaaaaaagttagagctataaaaaattagcaacaattcagcccaatttcttcatttcaagaaccaaggccaggaatggttcactttcttccttcaagagttagtcacatgccagaggcaggttcccaaagcaattcttaataatgtcatattaaatgtttttattgaattatttgagaaaaattttaattggaactgatgcatttcaaaaattatgaaaataaatgctattccataaaaataaaatgttagtgctagtgcaattgagatttaatctgattgcatatattctacgcttcttcctatgtaatctgtgggactgtactgatgtgaaaagatgaacaacggtgttgcaaagagacgtggagaatcattgactttagggtctctggaattgactagtaggaagaagaccagatgaggaattttctcaggcagttccataacctctttctaagtgggggaaggaaacaacccacagattcatgctgtggttgatatatactggaccataattaacacattgatagagaaaacattctaatacagattcctaatataccctgatacagattctctcagttttgggtaaggcttagaatgtagagctgaaaagtactttggagttaatttacttcatcccctcatccttattccttaagaaaatgaaccaaagagtgatgaagtgactaattcaagatcacatagctagttttaggggcacttaagaagagaatcccagacttcgactttatgtccttcagtatttctcctacaataaaccgctctcagtcattcagtttcttgaagtctcagttttctaatatgtaaagtgatgattgcggcatttggttaactattcaatagagttgttgaaaagaataacctttaattaatgagagagaagacaagatagagggagaaagagagaaaagtagggtttaccataacttcatagagtaggaattatgagtaaaacactgcaaatttagtaggttgaaatgatcttgatagaaggaatcactttacacaactgtttgaaaagatccctcctggcatggaaatagaattttggggtgaggttaagaaggagcaaatgacacattccattccttaaactaaatttataaattgattattgtcttgggagcattcttactcataaaactgtaattacataaagcattccccttaccataaagtagctttttgattctgatctattcatgatttttccttgattttttttttcttccaaggagaaggagttaacttaatgaacatcttgggttgtctctgtggtctaataatttaatgcttatctaagaattttagtattttgcatggaaagtggttaatgaggacataaaattattcatttttacctgaattccagatgaaatgatatgagagaaggatgattaattttatcatgtagagacttcactggattttacaaattaaaggcaaacacccttcacaaaagttcttggagatgtgacaaactgatttatattccattaatttaactctatttaggcagaatcatggacttctgtaataaaacacaaaattaattaaattgcccaatagtataattacagtttcatcagtagagaaaacaactttgagtgccagagtttaaaaatgttaaactgcattttcagtttaatttggttaaaaatgtgtaattgtactctgccctgccatcttctttcttctagaaacattaatgcaaatgcagtcactgctttcccctactaatgacttcagctttgattccagtctactaaacttttccactgtgggtcctcaagactgaaagagactgaggttggggcagcaaaaacattgaaatggaatggaaagggtaaggaaaatctaggggaaaagagtaaggatgtgcagtagatataaaatcccattatgaagtctgcatgtctgtaaagaatatgacagaaagcaatatagacccagatatgcaataaatatttgttgcacgaatgaattcgtgaatgaacattgcagggctgaagatcccttgaaaataaaagcaaacacgagttatatgaaacatgggtgcttagccaaactgagctatgctgtgacaaccccaaaggtttaattgaataagtgactttctgtaggattacatttcaatgtgtgaccttccttgtttccatgttaggtcttctgttagttttgttcagatgagtaaatcaaaagcttatttttatacaaaagaagctcaataaatatttaatttacaaatgtaaggatgatataaatatatcatttttccctaggctagatttttgaagttaaacttttgttaattttatataaaatttgtgcttgcttaagcagcacataaagtaaaaaaattttacctgaaatttattatttactaattttgtacctctgatcttttttattcattctccctaatggccttagacttcccattccaaaagaagatgaaagtaaagagggactgtctttatatctatctttcctcgtccatttagttgttgctgttttggactatatttttgttaagaattaattttttaaaatcaagcagtagagtacaaattcaggggtttgagccttgatagcaaacttgactcctctttgcatggcactctccttaggattttcctgaagcaggtttgtttagttagtaatagaatgtgatcaatgggaaggtttggattcaatgagaaggctatcttttacattttgcattgaccattggacatgcctagctctgatccctctagatgagtagaaagttaggggaaataagccaacagtgttttgaatggttattgcactccaggcttttgtttattgcttaatggaaagtagaaagaaaaaccacatgagccttgcaacggacatgcttgagtgtgaatctcagcactcccaattattgaccacctatctttggaaaaattattcaacaacagtcaaacatctgttggctaactataaaaaggaagattggagtgatcatctcctaagactttgtgaaaaatcaatgaaataatccatgtgaaagtacctggcactcactcagtagggcctcatcacatttcctcaacttcatttcccttacttttggctatttgtgtttggatcttttcaatattaggtattaaaaaactgccttacactgatggataagtattggatggactagaaatgtggtagccattgtctctttggagggttatgaaaatacacaaagattggagaattgcttggagaagatctcagcactgggttgcagaggaagagaacatttggggagtgaaccatgcccccttgcattcagtctctaattgttcagttttcaattctccatcctccctctgtcacattacatggttaggaagagattccagttggcacaaatccctttctcattctccaggttgtattttttttcctttctctcttcttttgcttaaaacaccagttgaagaaagagtaacttcagttactcccaagctctaaggtggagagagaaatagaaaacataaaagaattaaggagacttgaagacagaggaagcctttgtagagactctgaagatggtattattaatgtgaagtagatagcgttatctaggtcactgtattttcctcaaatccaaatagctttgttgttttgctcactttaagaataaacacacggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgagggaggagaatggcgtgaacccgggaggcggagcttgcagtgagctgagatcgcgccactgcagtccgcagtccggcctgggcgacagagcgagactccgtctcaaaaaaaaaaaaaaagaataaacacacaagtgcatacatgcacacctacatatactcaaacaccatttaacacaaatggagtcatactccacaagctacttggggtttatatgtagtatattatttttatattaatatagatgttcttttcttaaaaacattactcttttaaatgaccacactgttatgtatatctatatatctatatctctatctctctgtctattttttgagagagtctcactcttgtcacccaggctggagtgcagtggcgtgatctcggctcacagcaacccctgcctcatgggttcaagtgattctcccacctcagcctcccaagtagctgggactacaggcatgcgccaccatgcccagctaatttttgtatttttagtagagatggggtttcaccatgttggccaggatggcctcgatctcttgacctcatgatccacccaccttagcctcccaaagttctgtcattacaggcgtgaaccactgcacccgaccttgtattataatttataaatattttatgtatttaaagaacatatatgtgctaggcactttacaaatgttaactcatttaatctagataacagctccctggtaataggttctgctattgtcatcactgagaaatggagaaaaaactgaaggatacagaggtcaaatagcttcccacagtcactcagctaatgatgacagaactgagattcaaatgcaggaaagctggctccacagactgctcttaactgctaagctatgctccttccagtctcctattgatgaacatttacattattttcagttttatggtttgtatcagagaaaatgctgatcccacaatgtatagatatctcaaaacaacatgttgtacatgatatatacaatttttatttgccaatgaaaaaataaaacagaatacttgagatgaatacctttgcatatttcatttatccttttactcttatcactgttatttatctgtgtatcattttgcatttacttagttatttcctttggataaattgctaaaagaggaattgctggattgagaggcttattttatagttagactaataaaatctcaaagtttgaagagacattacagactaccatgttgctgcccagcttctctttaatctcttacttgaggtaggtgttacatagattcctttctcttttgtaatctcccttctagcccagaaaattctttactttttaagtaaacattggaatttactgacaaatataattcataagtttaggggtaattcttcagtcatagccaaggcaatggaaaataagccttttataatagatctgaaattctcaaaagtgaaatacatactgctcctttaaaacacaaattgaggcatatttacatatactgacacttccttctttttcacttaccgtcttggaggtattaccaaatggtatctataaatgtatctttttttttttcatggccacatagtattttttttatcatgaactgtaatttacttattgaagtcctcaaatagacatttatattttttaaccctttgaaaatataaacagtgttgcaatgactacatatacactctttcatgtgcagttatattagtattataaattcttggaagtgaacttgctgggtcaaggatatgccaatttaaaattttgatagatatttccaaattgccattcaaaagttttgtcccaagttatgtttccaccaagaatgtatatgagagctgtttttcatatcctttccaactttttgattattagtattttcttagattaaaaaatagctacttatttcaattatttgcatttacttaattttgagtgaggttgagtaccttttacgtgcctaaggccatttatattgctttgttctatggactgttcattccctttttgagttagtcacttaagctttctaagtttagtttccttatctgtaaaatgaaggttttgagggattaaagattatctaaggggttttgtacagtgtctggcagaaaataggcaattaatataaatgttgactattgctggcattatttctcctactccatatttgcatctttgtctgtcatttggacctttcttaggagttcctgattcatatttctattcacatattttgttcaaaaccatatgttcccagagacgtctctcctcttcctcctcctccttttctttgttctctaccttagtggctcttaagtgctcctgcataatcaggtttgacaattctcagtgctctttgtccttcactcctcactcttccttctcccccatatctaatcagctgccaaattgtatcagttccactttaataatctatctccatttaacctccttctttcttagccatccctagacatctttatatccccccgtaaaaccttttaccaacaatgtatgagaggtccttatctgtgaccacttgccacttccatctatcattttcactcttttaggaatatttctttatgaaaacaaagatgctagtatgcatctttttcaaattatttgatagccatctgctgctcataggttaaagtccaaactcctgagtcagacattcaaagcatcttgcaattttaatcttccagtctttttaccccactacactaattctttcatgatcccaaaatgtcttcctgatatttaaccatcctaatcaatcttttgtctgctccctacacatgctcaaggcacctccttaacatatatcacttgcctgtaggagtcaagaagatctagatttgaattctgtttagttctgttaaggcaacctagaaaagataaccaatttcctcgtttattaaaatctaggacaataaaggtggaatgatgcttctacagagtttagtggagtgagaggcacagagcaaatgtgtaatgcgtgtagtgtttttttttgtacttgaatactattattgatagcttatctggaaatgttttactctcctaagaattcatatagcaggtgtatcactcattgggatggcatcctttatagccaaggattcatatgcccatgttctggaaggcctgaaagttagcctaagtagtttagactgtggacttttgatgtttttttgaatgagggagagaaggaccaaaatgtgctttgggaaacaaatctggcagcctaaaataatccagatgggagagaaggagacacgaagacctattaagaggcggatatagataccaggacttgggaaggagaacaattctaactagaaacagtgggacttagaaaggacaacaggaaaatttatagtataggggatctccccaaaatctaaaagaaaagctttcaattgcacaaggaggtctcagtttgatggagaagtatgggtaaaatccagctgaaacccccagaggattattatagcatctttacagaaacatttttctactggaatttctgttatagccccctttcagtgtgatctatataaagaatttagaatagtggaattttctactcgctcctctatgctcaggtgacattggggattgtgtctcctgaaggattaattaccttttataaggcctctcacccctgaaaggcttccttttaggtcatggtccagctcagcctgggttgagttgggaaggattgtatgtgggatgcctgcagtgtccctgacaagtagatagatgagctctcatttctcatattgtgctattaggctcccaagctagtgtagcgcaagataccaggaaagtattgcaaagcagggggcattttcacggtcgctttccagctgttggctgttagcaacaacatccattctgctgctgacactctgctctccctggtggcacttacacttagaaattatttaaaccacttaaagacagtagaatatttaaaagtcaaaatgcctgctttctaattattccctagacctcacttagcaatagctggcttcatgtcacacaacatgactctcatggggattacagtagccccctgaacagaagtgatggtgttggcatgctactaactaaactggagactgttgtgtccacagccttgaaaagcaaagagaatccccttctgtcccccatgtactgcaaagtctctaattcagaggatagggcaatttcaatgggttgttcttaggtggttgggggaatcttgaggctattccttgactcgctttaattcactcaggtcattcctaatgaaatgatctgtgaaaaatgtgaagtagtgtaaaggggatttggtactgttggcttctcttgaccctcactgacttttgtgagtaccttgaaaagtcattaaaaaatacaaaaggattaatgagttaaaggaaatcaagactgggaccatgatattatcaggaagtttgttgaatgagcttttgaatttgctttgttaaatcttgaaaatggcattaagcagctaatggagttgatatattaaatacaacgctagtctgtatacaagatggacactagctaatcagtgatgtgctacatcaattggtatgggaacgatgagctctttttattaggtcagcagaaccagtgatgtatggaagcactaaaatgaaggaacagattaggctgctctttgcaattttaattatgaatttttatgaacagaaaaatgtagacatttttgactgcaagaataaaggtgtctgcaacatttgctggagttctgatctattcatgttcttttttctttagcctcacacctagataaagactcgaagggacattgtaaattaacgtattcttagtttttagtatatcattaaggaagatggtgtggggaaaatcctttcatctgatggcttgtgatattactcatattacctatttttaaaaaagtaaatgatctaaaactttataccttgaagaaactttgggaagtcaagttctagtctttcgttcccttgtcttgaaaatttacttttctttctgtttccgacctgcccctcccaccctgcccagctccattttgtggttgggaggtggtataggatagtggtaatgagcacagggtctagagtcattagagctgatgggaatgtggactctaccacttgctaactatgtgacctgggaccatttccttaatttttccaaaccatagtagtttctgcatctgtaaaatggagataatagcctcccctccttccagggctgttgtgaggatgaataatataaatgcaagaaatatacagcagctagcacactgacactcagtgttcagtgaatttaaaaaattatttggtatatgaatcttggaaagtcttcctattatagagtactttcttttttatatgaaagtccgtcactactttgggtctcttggatttttctgataatgatacttaaagtatgcccaagtttaactaaaatctggtttaaaaggtcaatgtattttatagatctatgaaagggtattaatagctaaagactgtgaaatgaggagccacagaaacatcaggtgatgaagcctcttctggaattctccctaaggtcatatcatgcacatttgcatatagttggcatatgatttacagaagcttcctgtctgttctgagatatttttaacttatgcttttattatggctccccttaggacactaatttcctgagtttccctaatcttctttcagactatcttacatcttacactctttatgttgttaactttctaaaaacatgagcctgagatagtagatatataagttaagtgagggatatatagcggtgggggctagcacatacctttgactgggcttcttaacctgtaaatgaaaatgttgcattttgggtctagcatctttagatcttgtgagaggatcttggaagttcaggggaatcaggttgaaactatgaccagttagttaatacagtggtcagtaacaagatagcaacctctttcaatttagaacattttatttaaagtgagtaatcatgaatacacatttccttagaagaaaggagttatcaggtgttctgcctgttttcttctagaaaatttattatcaagcatggctatttattttgagtcagcttctaagtttttcgggcattgtatactatcagtattattgattgtactctgtaggaatgcctgtaatttgtatgcagttaattaataaagtttattgagcatttagttgtgagataaattgcgcaaaaagaaaaatttgtgatccatccatactccatttaaataaagcaagaaagataaggaaaatggtttgtgccatgttttaatatactttcaccaaaatttctaaaacaaagcaggctatagaataaataatcaatataaatgcttccagaatgtagcatatgagatattctataaagataaatctagaacttggctagagcattaaaaataaagtcagacaaatgtcagacaaatggccaagtaagaatgatctttccttggagttttcctaaaatggttacataggtgagtttagacagttgaaggggatttaaacccagttcagaaatttaaagcctattcacattttatcttgaaaaatgtcttctttgaaaatgctgaccgttagataaaagctatgcttgcaacaatctgcatctgttttactatatctcattttaagatattttgtccatgaatataaaatcttttgctttgctttttggttttgaatttgtgttgtgtaatcaaagataatatcccatgtcctgctatcttatttttcatcaatactcaaccaatgatcaggaaactatggcctgggattcttttctgtaccttaggatgtgtacactccctggaagtctccaagataatactggctttggaaagttcaaagcttggggttaagtttctatgttgcttgcaggtgactgattgaaaatgctttttttatttgtaagtttttccctaatggttaagttgttatgatagttcagttcttagatttgagcgactattctagttgtgctagtgtaaaagacagtgtaaaaaattacccaagataataaaattatggaaaggtagtttcatctaaaataatttattttcttctatttctggaaaagtatataaggcaatttttaagagtgttaaatttttatctgtgattttgagaccatttcttttccatgcaattgatataacaatcttgtttttaactgaatgctcatgttgaaattcttatttttaattcataaatttgaagtttacataaaaagtagatttaagtatctttaagatacagaaaaaagaaatattaaaatgtagaaaaaggatgtcaattttcttagagtcccatattatacaaagaaaggggtgaatgttatttttttaaaaaagtaccattatagtgatttttttgggaaattctacaatctctgaaatttaaattcttggactattttagactttcacatgaatttatctagactttgaaaatgacttctatagtgacccatggactttctgtgataatagtcacatgaacattaaaaaaaaatctttatttgctaacacatttttattgagtatttaccgccaaacactgtgctggatgatttagctccagctcagcagctctcagttttgtgagtataatcaactaggatctaatgacagagagcgtcaaatgtatatgtgctctcagtttcttttctaagtcctgaacaatcgttccctctcctctcatcctttcatgaaactactagtcttttatctctctctttcaaagtatggtcccaggaaacagtcagataatcagataacttacatcttatattgaataagctaacttcattatgaaggttaccagggatctttacactttaattctatcgaattgtggattgaaatgcacactatgatgagggtaaaatacacactattactattattgctaactatagaagtcttccatatgtatgataactaccaaagactagacatgctgggcatttaatatacattgtctctaatccatgcaacaatgtttgtgaaatgtcattatccttactctcagtttacagataaggaaactgagcttcagtgatactggcttgctaaagtccatatggctaattattagaagagctgcaattctttcctaattctgactgcttccaaagcccatgtccctctcattctactaaactgacctccaactgtatcttaacattgcatacattagacaatatggattatatgtcttgtgtatgtagttgacatgcatgcactacaggaatccagctcaggtatggtcaaattggttgaaagtacttttgggctgagtttagcttaagcatctagagttggccatggcccaacatgtcaggcttacaaagaaaagtctatttcccatttacactgtacttttatcgctggatagattatgcagagatctacattgactattaagttggctgaaatgtggatttctatcatttgatgcacatataagtgatgttaatacatgtcaaccaagaatgagagggaagtttttgatatgtggtcaagagtaacagactaacattcttgaagacgcctgaattttttgaaataattttcctacaaagggaaacattttgctttgttcaagttgtggctgttccctagattctcagaaattcatattttgcttgaagctgaatcacttctgaatattagaccatttagggcaaactttagctttgtagggaaaaaatgcagagtaggaacagatctcaggaaaaggtagacctggtgcctggctaagccagtggtgaagtgtcagacctttactggaagttcatgagagggtgagcatgaaataaacacccacctttaagactcttgcttaggcatttcatagcctggtttacatatgtattagtatgatggctgtttatcaaattctttaaaatgtcctgtcaacttgtcaccataaaaacattgttgcaaaggtcctacttttgtagcatgttttcaaggctggcaattgtgaacagtcttcgtcttcaccagctatggctctgcgatgatgaaaattgatttttttttttaagaagaaggaaatagcagaatggcctagacatgggaatgggatcttataaaattctatggttcagagaggatcttacaaatttttctggaggttagggcaagaacaggaaaagtgaacagctaattggaacttcttgggtttcatttttttgggtgattggggtagtgggcagatacaaagtgatagcatttgggttttcagtgagtttatatctgaaaatcagagctagtgcagtaggcctggttttacccaaattgcatttgaatgacttatgtggaactgccgagtttagcgtctcaaaattaaagaaaacaatgggatgtggtcacctttaaatgttactctttaaggcagagatcaggccaatgtggcggtactctacaagaaaagctgtgcttaagggaatttataagtggaatgaaccctcactctgaggggaaggatttgtgaagagtaaaaactctgggtcacacgaatatcattaacatagaagatatattcttataaaactgacctttagtttagaagagggttggaaggacagagggttaaggatgagtattaaaaaatcacagtctcaattctgctacttaagatggggactgctgaatcaatggctgctttggaaatgggttgtaaatacaacagcagacaacctcccttaggaactcattttgttgcttcctacagaaaagatcttgacttggcatggaacagtaggaggaaggattcatccatggccttcaactaactagagaaatcactttttacctttttattcttgaactatctatatttatttttttcttccctggagactagagcaaaatctttgtgaaggtttttctttactcatgaaaacaagtacgctattactcttacatttctcatttttaacatgtttcactgatgttcctttgttcaactatacaggagagcatcttaaattcttttcatttaaaataacaagttacaaaaacagtaggtagagtataatctcatggtaaatggtgtttaccataaagctaacattgatatttttcctgagagagacattacgggtaattttaattcatttattatttttttgatatcctacacgatggccataaaaatttaaaatataaataatattattttatcatatttataatatagtagcaataagccattatttcatatcccaaacacagtagctattattttatttccataggtgatgtgtcttctttttgtgctaaggatatataaaaataacttactgatataggtatattcatattggaactgtacaaatttgtaataattgtgctttgacttgtacaacagctctgcttctgtttgactttgttcaagtcatttaagcccttggggattgtttcctcatctgtataataagagactgcaataaatgatctctaaggcccttctaaaattctgtgatttcatgagtgaacacattcttcaaagtactttgatattcatgatttcatttgattccttgaccacctggtgagggagataacaacattgccattttacaaatgagagactgagccaacgaggggttgggtggtttgtccaaagtcaccctgagttggtatgagaccctgtgtgaggctatggctgtccttctgtgggcccaggctttttgcctctagtgctgtcagagactccaggatctggatgccacacttccttggtggaaggaagggcccaatttcctggtagggaagagagtctggataggataccacaatctgagttccctaatggcagagaggagatggaataaatcccaggccaagtcagggaagctgttggtttcaaattctccttctcagtcttataaagagttaaactaggctgctgaaggaattgactcattagctgcaatagattcccacttgtctaatgaaggcagaagcctcaaacagaaagatctagactaaacaaggggaactcacttggttttagcacctagtcctggcattcctacaggcttctagaagtttggaaaagccattactgttctgagatctcagtttctctatagtccaacaatatggccaatctaccttgtcactgaaacatctccttgtgggccttccataagaggcacatattactaccagtgttatgtgctgctctccaattctaaaaacagaccaagatctgcacccaagaaccacttttctggttatggggtttagacatggcataactgatggtcttttaaaatctttcttaccattttcgtatctgaagttttcagggaacacctttcagattaattcttcaatgtagggaaatggccattgtcaagtgcctaggactatacatgctttattgagcggctgttcccaaccaaggcttgaaaatcattgacaaaagcaggctgtattatctaagttagttgtttcaatgcattacacccaggctatgttatccatcataaatgtacaagaaagcctttttcccactgctattgattttcgcatggtgactatttgtttgtattcttgacaggatgatagtcagctgacattgctaagctctagtgtcctataccccctgccatctaaaactggcatgcgggtgtgaggcttcagattaacacctacttaaataattgctctcttattggaggttttccatgtaacttattattgtactgtattatcagttcaacatcttttcgctcccacacaaacttttgttatattttttcagtttccatctctctatgctgtgttttctgtataaataagcttatattatcatttgctagattctaaaggcattctaaggcagtacacagtgatttgaggtagacatcagaatgctgtgtgtgtttttttttttttaaagagaaggcaaattgccaaaagatagaccagcaatgatagaccttccatttagttaatttcacagcccaatttgactagtctagatgaatctacccccaaagaaccgacggtttcagcttgggcaggatgtcatttctcttttataggctactcagatttcattttccacttgaactgctgcaggtatcctgagctcccttcaaattacccaggagcttgatgaatagctggactcaccagtgagtggacagctcattagccaatctacaagagcctgctgtgactactctgaatcaaaaagccagtttctaatggtggatagccaattaacagcaaaatataacctcgtgaattttaacttaccctgtcaaaagtctgagtttgttctcttcatgatgtttattttccttattgtaattaggaatgtgagaggacatagaatcaagaatgaggtgtataaaaataattttaggattgctacacatattttgtgttttttttctttctcttcagttggtgcaaacaattttgatcagtttctatcaaatgggtgctgagagaaatgatacagaaaaagaagtagtaaagctttcttgtttttattaataactattgttttatatatagtaccaaattgggaaatatagagaagtctaaaaatgaagataatcacccacaatatcatcatgcataatagactcatgctaccatttgattatacatctttctgtcttcttggcctttgtctctactccttactctctcacacacatctaattaacacataccaagtacgtatgtttaaacacatttacaaaaaacaggttgatgctctgcaaactacttcgaaatctgcttttatagttgatcattatattgtgaggatccctatatcatatatctgacaaaactttaatagtcgcatactaactctcaaggtttcactcaatctagccctgatcagtcacctttttcttctagttcacttcatcgaggtctatactttttcatgtctcttttttccaacctcacttttatacccctctctccatctctagtacattatccacttcccactggctttttcttccctctcacctggaatttaagaggaacacatcatgaagctgcggccatgctggttggttcttctaagtaccttctcccagggtgagcagaatgaatgctcctgaggcttatgtgtgaggacagtcccaggtctgagagcagaaatgccattaccaaagtcccagccctggatatcacccctacttgtgggaggccatcctggtttatggagaggcactctgactggggggtgggaagagggtgttgagaacttgttttcctgcagtgtattattctctttgccttttcacctctacattcctagattccttctttagagacccctaaacttcagttgtttaactcttgtgtaaagagatcaagggtgtgaagcctgattcccaatctggcctgtccctcagaggctctatttgaaccctgctgcttggtgtccccagagagaatctcagggactttgtttcctttgaggtttacctttaataggaacctttctgttctataactaaaccataaggttgaactatgtagctctggcctaaaatcaatggataatttgggaaaatttggtattaggtatgtgagggaaaattaggacttgatttacagttgaataataactaaacccatggaatgaagatttctaaataaaaaacaacaatagccatgctgaaaacccaactagagcagaaaagtgatcctctgtgaattgcataaagtggatgtcttcatatgactttcttctctgctaactgcaacaagggaatcgggactgattgctggggaaagtttagtgttcaaaggttttcttctttggtgggaagctcttttttttcccctttcaggatattaatgctagtgttttctaatttttaaaatccttttacctcttcacctcttctattcttgtcttttgctcctgttaaaataagaaggatataatatcacatatataattattgattaggaacactaagccatttgattgaagtaaaatttagtcatattaaaaatgttatcttgaactggcatttgaattctgtaatctttatctctgttttaattccagataatacccatgtctgccacccctgcacaacctctccaacttccactcaccttgccagcaaggaatatttttgtttatttttaaggcaatgggagtggaggtagggtgaatctgaaatgatgctaatattgctcttacatgatgcaagtaatgttctgaaagtaatttgataagttcttctacagtaggtttcttaacattttggggaccataggcccttttctaaatctgaaaatatttatggatcttccattttaaagacttaattacctttccctattctgtgtgtatttaaaagatgcccatgaatctctggcctgttcttggcaacactctgagcggtgcaagtgagtgtggatattcacagtagaatgccctgttctttctctgtcagctgacaagtttcttccctcaaacacttaacctactttttctaatctttttctgttctttcaggcctgggtttgtatcttcatgtccccagcacacacatgccttttgagtctctcctatagaatcctcttaccctatctgagtttagacgcaattcatttttttttttcctttctaacattactcaaaccttagcttgtttttcttttccctcatattcatatgagggattcatatagattcatatttggtgttctttgatatataggtgttatgttgttttttaatgatgcttttacactaaccttcctgatctgacatccttaaatgcaatgctatacattatttattttttctaccttagctatgaagtatatgattaaaaggcttcatgttaataaagataaaaaaaataaaaactgtaatgtgttatacaaaataagctaaaactgtaagaaaatggctcaatacatggattaattaaataaaaatacccagcaatgagagggtgtaactcaggaaagaaccagaaattttaaccaggcacaaccaggtattgttgtacttaaaaatctaacaaccatatagaactattcccagagctgactataggagatcacaatgtacctatttccttatacttgccttcaaatttattttaaattgaagactagctgggaatcttatgccagaagaagacacctaagtacaaatatgttcacgtttttgtgagacttggggtttgtctgtatgttaagcagtacccaaaaatacaccatgtctgtgtagttgggagagtaagcaaatgaagaattccttttctccttcttggttctaaaatggagacaaccatatggggcatgactctataaaaagtacttccctggcggatgacctgggacagcaaatgtccacagtttctataagcaattaaaggaaggtctacccaaagactgatatgcttgtatacattgtgttttacttactcttacttgttcccctccctaccaatcccctgctgttccggagctgtatttttttttaaataattgtgttgctagagtgcaggtgattgatggctatagatcatcactccagtggtcaagctgagttgttaatccagctaataaacatacattttgtggacatgaggatgactgggaaaatggcaataaattttctttctttcctagacttttgcctagcaatacatacaaatgtacaataggatagagagagctatgtaattaaaaaagaaatatgcaaatgtgcctaattttctcacaagtcttaatgcgcctcttaacgtaattctagatttaatggcactttggtgcttgggtcagaccagtgattcttaataggaatcacctcctgctgcagggatggtgctgggggaggatggctgcatcaggatcacatagatgagtgtttaatgtgctgccttaaggaaacatgctttctgagctgaaaaatcatcactgtctagttagccattattgctattctatttcttatgtgtcttattgtagagaaagattgagaaccacgtaagctgattgtccagggactttattacaattacgtgtttgaatttctgactcccttatcagcttttaaatctgggatttaaaaggcctgaatcatgtctgcctcattaatcattcttgctaatcattaataatcttgttaataatttgattcccattgctacacttatagtaggtgctctttggatatttgctgaatgaataaaaagatgaatgcatgatgacaaggagacattgcagttggagatttctctgagattggattgtctagttggaaattaccttgcatgagaacttgcaaaaatgtgtaactgtctcctttcctccaaaagccaccagaaaaacatggtgtaggtttcttaacatttgataagttcttctacagtaggtttcttaacattttggggaccaaaaactgtaatgtgatatataaaaataagctaaaactttaagaaaatggctcaatatatggattaattaaataaaaataaaaatacccagcaatgagggggtgtaactccagaaacaatcagaaatttaaaaaatatcagttaagaaagaataaacataaaaccaaataaacagaatggataattccttaaaagaaatataaagtaaaatggacaaattttaagatcaaaaagaaatgaagaagtaaagtttttgtaaagaaagatccaacataagtataatggaaatttctgaagaaataaaccaagagaacagaacaaattctaaaaccataattcaagaaaactttccagaaataaaaaactgatttgaaactacatagtgaaatatgtagctgagaaagtccatccagaacaacaaatgccaagacatgttctagcaaaatttgatacaaaaggaaacaaaggccatttgagcatattgatcaaaccaaaagtgatttgtaagtgaaagaaaattagattattatcagacttttttgatagcaattctttataacagaacaaaatggagtaacatacttaagaaattcaaagaaagaaaatatgagccaaagatttttatatctagaaaaactgacttacaagtataaagggctcagactattattggcatacaatgacccaaataatgttgttcccttgagaactttctgagagatctactaaagaatgaacttcagacaataaaaaataactatggagatattgtcataagaactggtgataagttaaaaatactgtttgttaactggttaacatatattgtttaactggttaataactggttaaacatatagttacttgtagaactaagattaaatgagggttaaagatcaagtatctataaaacagcagatttaataaaatgaatataaggaataatttattaaagtggggatacaaatgaggtaagcatgttaaaatgtttaaaagctattctcattaacttcattggtggtggtagtattgtattgttattcttagacagttatgtaactaatatgggaaaagatgagtaattatgtgattttctaattctgtcattcctgtgtatctttgagcattagaatttttgttgcagaagaaaggagatacagatgtaattcggaaagggctgtattcttgaatttaaattggaagtaagagtatgaactcaagacgtctttcatatgtataaatgtatatctttgtatatctgtctctgcccccttaaaggcttaggaaaagtgagcaacttagtgcaaaaagcactcctagcatccagatcgtggtggctttgaaataatatttctcattaaaagaaacaggacttagagaaatgactaattccaggtctggggcaggaaatgtataagatgaatctggaacattttgttaaatcatatagctaggaagctatcagaaactcctgtggttatgtcaaaagaaactcaggaatcaattttaagaacctccaattgggacaatttaagcttcaaaagagataataattgcagtggaataaatccataaaataagttaaatgtgtgagtagataacggtattttaaaaacctagttaccttcagaagacgcaagagaactagttcgttgtcttgaaaatgggtaaatagagggaaagaatgtaacattgatcctgcctttccaataagataaaaaataattaataaataaaattagagatgtctagaaatgtatacaagtgataaaactataaaaagtgattgctataaaagttgggatagtggttacttttgggaggagggagatgtttgagatttggatggggtacactgatgagatttcttaggtagctgacataggtctatattttgatataggtggtggttgcaggaagttggccttataataactcattaaactatacatatattttctgtgtggttttctgtatttgttttatttataattaaaaatttgaaaacaaaagagaaaaaaaggttggatggaatttttattttctctcctggatgaattctgtgactcttcctctgctcatatatgtggcctgagatcttattaaatgcctacagttcaaaactcttgaaatggaaggcaaatctatctttacctgggtatgcccaatgctccagagaatagccatgattcagaatggacaattctctcttggaatccagaattattctgcactttatttgcctccagggaaaacaaggtgacataggctcgttgtcaccagtgagaatttctaacacttggtgtcaggaaactgggcaataaatctcagtggactaaaccactgccctaagtggcttagtcatgccttaacactccctgaatagcctctaaaaatgactgcaacagctgtactttccagaacctagagttgatctttatttaatttatccatctatcgtgtgaactttgccacccggcaattgtaagaagaaaaatgagtcaccaagatttgtacattgtggaaggcaaacttccccctccccaccaagcaatcctggaaattaaatcttttattccttagtgattcactaagtgtttgcaatcatggtccacacatttagttgttgtcaagatggatatttctaaaggtattattttttcatttcatggtgagactctttttatcttccagacacttcaattactgacagaaactaggcgtgagaggctcaaacagtgaggtttcatttgtacatcggtgctcaggatgaggatcacacatgtactatattgtgttcaatgtctgatgaaccacagcagcctcttttgtggatgttggttgagagttctgaagctcaattaaaggtctcccttttcagtcaatatcttaaaatataaaggagatacctagtgatgattatactggtcaactcctttttctcctttgcggaactcatatagaagaagctgcatcatgaataatgctggagtgacttgagaggtcagaaggcaaattattcacatgaggccatagtgcatatttcagagatacctacgcagagatgtcatttatctggttgcagtggtaataggatgggtatagaaaaatcttgggaaagaaaaacacctccatgaaaatatttgttagtggttgtgaaagatcttttgatttgagggtttgagggtattgggaaataaaataaatactatgaaataaaacacagaggtcagaagtgaaatagtgagcctgttttcattgatcttggatttgttcataatttagagacatctaccagattgaagttagcattccaagtaagtgatgtaatttataaaactgaaaaaaccctaaatacccaccaaaataaaaatgctttatcttgctttaataactttaatttcatcttattttttcatttttatttcattttagattcagtgggtgcatatgcaggtttgttacctgggtatattgcataatgctgaggtttggggtatgaatgatcccatttcccaggtaatgagcatagcacctgttagtttttcaatccttgccccactccctccttcctcccctgtagtccccagtgtctattgttaccatccaaatgacttctgagccctctggagttcttgcatagatcacactcagtgctggcagaacaggctgactagcacctgatgccccctctggactgcttcacttcaccttggacctgacgcacatgcagccttgttgcctttttatggagcttcctctaagactgacttgggaggctcagagcatctggtcaatgtaggcaagtccgtaggctgggattacgcagaagctgtggcccaacagagtgaaactgctgaacttcagctttctcaccagtttgcttcactttaaagagcagcctcagcttgaacagctggggctaaattgcagggaaagtgtttccgtgagctttgctggctttcccaaatgagtgtgtggaatctggcccctgtcagcagtgccaaaacacagccttctgattgtgcctcagtgaatgaaatgagggtggcttcatttccctttctaacatccatttcccacacagtcaagtctcctctagccaggcccacttctgtttttagcaggaagctcttgaggccagggaaatctggaagtacttattgtttatatggcactgggagtctttaggttctcttttgggcttccaagcttaaactgacagatttgtggctcaaagtgaaagctagcctgccctagctcaggattcaagtctcagcatttcaacctttttctctctctggactgttctctattttggccttttaaatcaggggtggagaagacttgacaggtatgcctccatttctccctcctgtacaaaaggccaataatgctcatggtcattgacttctttctgctaaatccatattcaacctcagaatacttaatactatggtcaatcaatcagttagcccacatgttgaatcctgtttgctgtttggtaggagtgacagtggagaatagtggcccaagagactgataagcgggccttatcccagcattgtgatggatggtgtcttggatagaatggttagaagaattgtcactctagctctatcacttaccagttaactacagctacatttgatttcttgaagcttagtttttgttatccaaataaacgaaatatcttctctaaatacattacattttgttgtcaatatacggaaataaacaaatgggtgtggattcctttgcaagcagcctagtgtgacatgcatagaagctgttagcaatgtaatattaatacattgcaaattcctgcttctctatttcctagacttacagtaacagttatatactaggtgttttaagaaccaaaaattccctattaatagtgctgtgggaatgtacattagattgggaatcagatttttgtttctgtgctacaagtaattgcttataatatcttggttgtttgggctctacatccatatttataaaattatgaggttgaattagaagttttaagcattgctcttagcactcaaaactaaaattttattttattttcttttttttaaaagacagggtattgttcagtcactccggctggagtagagtggtgtgatcttggctcactgcagccttgacctcccaggctcaagcggtctacccacctcagcctccagagtagctgggcatggctaaattttgtattttctgtagagactgggtttccctatgttgcccaggctggtctcaaactcctgggctcaagcgatctacccagctcagcctcccaaacggctgggattacaggcgtgcaccaccacacctggctcaaaaccacatttctagtgaaatcatatgaaaccctgatatgagacatataaaagagctgtgctaaatcatgtcagagtggggtgtccagaggcctgcctgtttgacctcttctgaaagtgtcccagaagtactcttgtagcatcttgggatcccctgaaaatttgaaaaccactagaccagatgttctccaaggtccatagaagttttaacattctacaatgctaaatgtttaaggaagattattttctcattgcctttattaactttccttttatatggtggaaataactggaaatttatggccattcctatgcaagcacagctagcaactagaataaataacactccccccacctttttttttttttttttaagaagtagaccatagaggatgtcagaaatgttttttatagtcttgtctgggaagccatttgcttcagtaagccttgaatcttcatatgctctgcatgcaacaaaccaacaaacaaatttctacagaaatctatttagtgtcttccatgtgccaatcacaatgttcatactggggctacaacggtcactaagacactgccctacctcaaaaatctcacatagtcatagttgttttcaaactgtgctcagcaaatcacaacagaaacctcatattttgggccttacatatcaagaatttgttaggtttctaagggctggcaccataacatagcttgcttttttgtgctggaaatacttggtccgctttattcaccgtagctggtctaggtctacaccatcaagcaggatgatggcaatgcctgtgactgagagctcagtgatagcagctgtcaaaggatatgtaattttgacaaagcacttagactttcttttcaacaaaaataagacaagttattttaataacacattttaaataatcctaggatttacattaatgaatgaaataagattagccctgtaagttttaaactgtatgcaacataaccacttcataagttgcttaagggttatttatttactgaacttgtttgagtaaatgtcataaaatcgagcttttaaaaaatgatgaaaactcaaggtatcacttttgagaagtagtaataggaaaatggacgtatgtaggtgtatttaatttcctcctttctttctataaaaatagtggtatcctttctttaatcagggaaaaatattgcattattcagtaatggatcaaattccagcaatgacattttacctctgttattctatactctatttagatacagaagccatcacttaagcaatttgcaaaatatgtaagcttctaaaaaaatatacaagtgaggtaattgtgagtctggagcatatttgttagggcactgatatggtttggctctgtgtccccacccaaatcttaccttgaattataataatcagcccatgtgttgaattcccatcagccacagggaacaaaatggcattatgcctcttctaacgtaagaagaactagaggagacatgtcatgggagggacccggtgcaaggcaattcaatcacgtgggcaggcttttcctgtgctctctttgtgatagtgaatgagtctcatgaaatttgatggttttataaaagggcagttcccctgcacgtgctctcttgcctgcctccatgtaagatgtgactttgctcctcattcaccttctgccatgattgtgagccctccccagacatgtggaactgtgagtccattaaacctttttcttttataaattacccagtcttgggtatgtctttattagcagcacgagaacagactaatacaccaagccgaaaactgaagccaaactaaataaaaacatgtcaacacatcctccagagggtcttgttcgtggatatctcagaagttcctcagaggaacttctaatttctcattatctttcctcactccacagaaggatggcacaaacaatgactctgttcttctccgggccccatgagctcccattgtcttccaggagataggtaggggtggaggtgggatagactagaggtatagtattttgcttaagtggaggcggggagggggctcaaaagacttctcatttgccaaagttctttgcagtctaaatattatattaaaaaacaactatttttcaactgtaggctaataagtttcaagggagacatcagaggcaataattacaaattattttcctgaagagaacattttggattcaggtattgattaggaccctctgtgaaaatgaaaagaaaaccaagatgaataaacttaaatcaatgtcataaaaattagaacagcagctgccagaaccatttgtgggttaaacttcattggtgttcatctggcattgactttagttataaagatcagtttcaacttacctggtgttccctttccagcctgacttatgaagataaaatgcctagaaagagttactcttgggattttaaaacatatgatgggatttgaggtaccccataaatgccatttctttccccatctgaataagtcaaaaatattttatttctgataaaattgattttggagattgtaatttttatctgcttgcaagtagtttccctccttctgaaggaagaactagacagaattcccttcagccacagggagcaaaatggcattgtgcctctcctgatgtaggaagacctagaggagtagagcagaatatattctttaaggaagtagaatgttctttaaggataaagctaggaagcaaggccttggttctgactgcctgttttaccttccaaactcagtctgattaattttctcctctgcagcagataaaggctggcctattgttttagtaagctcctttacttgtaagaatcatttggaaaggaaggagtattccctcaaaggatacattcttcttttaataagactgccttctgccacagacctgctgtgtgaactcagacaagtcatttaacttttctcaatcattgtttcctcatctgtaagacaaggatcataaagacctgcctagtagattaattaagcgagataataaatgccatgctggatccagccctgcctgcctctccaaactcatcctgtgctagtctacacttatttctaatgttctggctttcccatctttctttccattcctggcatacataatgttctttctgacctcataatttttggtgtgcagttctctctatctggataggtctcttctcattatttttgatctggttaattcctaccttttaatcagttctcagattaaatataacttccttagttaaaccattctaatctccctcatttatttaaattacaggccctttattatttcttgcatatagcccttgtaagtaataatttatctttctttgattattagtttaatctctattttccatgatcagatattatgcatataagaacaagaacctatgtttttttcatttatcattgcacattgagagcctttagagtacttaacataatagtttctcagtacatatttttgaatgaatatgtaatctacttatcatatattctataaatagtagtttccttttgtttctcctcaatatgttatcagttcactggtttgtatgatggtagatccatcattagtgatatggtttggctgtgcctccacccaaatctcaccttgaattgtagctcccctggtgggaggtaactaaatcacaggggtgggttttcccatgttgttcttatgatagtgaataagtctcacgaaatctgatggttttataagggagagttcccctgcacatgctctcttgtctgctgccatgtaagatgtgactttgctcctcatttgccttcttccttgattgtgaggcctctccagtgatgtggaactgtgaatcaattaaacccctttcctttataaattacctattcatgggtatgtctttattgcagcagtgggaacagactaatactgtaaattaatctagcttctctcttgtccttccattttatcactctacttccatactacttatgcattggtactgtatctctctaatcactgtaacacttttaagtgtcttgaaatataaatctttttacttcattcactagcttgctctgaaacaagtgactctactcaaaatagaaagaataaaattttggaatttgtttaacaagggaagcttccccatttggagtgagaccgtgggacatgagacagcttcggactgtgggaagggctcacagtttaatattagaggaggtgttttgaatttctctttcaacaccagattgccttattaagtaatttaaacttccgaaacttaatttccttatctgaagaattttaagggtcacatagaataacgtattaaagagttaaattataaaaggccattacaaggcttacaaaggtcatcagttgtaacttggcaggattaggtacttatcaggctctgccaccagattataagccagtttagggcaaagtctttactcattattttgtcttccatagttcttgctcttcatttgtttaatggtgataacaatatctaacttatagatctcatgaacacattttatggaaagcattatcctacagtaggtaacttttctttttcttcttttaccactatcccataccatgggacacatactatatcttacatattacatcttacatactacatcttacatactacatcttacatacacatttatgtatgaccataatgtgatctgtcagtttataaatcatacatccattagttgtgatatcaggcttcaaaaaaagtaatgacttccctcttaaatgtttataacatttgaccatttaataactctagagattaaattgattaagtgattttcccagaagcataaagctaatcttatagaaatcaaaatgactgaaacccaggcctcatctcccttggttttgtaattctttctccaaccatggccgcttatagtgctaccagaaggtacataatgggaattttattttgtgccttttattctaatttgtatgtttttggtcttctgaaggctaatcgaggacttgcctctttcatgttcgccttcatataggaatttctgacctagatcaatcacctatagctgtggaaccaagaataaatctacattgagtttctacatctgtaaaatgggcacaatggtaggactcatgtcaaagcttctgagggttaaatgagataatctctgtatcagactgtgtacagtttctggaagatagtaagagctcaataaaaacagctaatgccattgcttctgttaagatgatgggttttgtaactgtcaacttcatcttttagcagcctactgaacttcaacaactctgttttgaattctgcagtaagttctcttaatgtcccaatactaattgtggttgaagagtctttggactcaaacctttcagaggcagataattttgttccttgcatttgcaaatcatcacgtatggggctctgatagatgggatgtgattacaagattcgtgtccaagagaatttcatgtgattggctgtttcgttgtcagggctgtgacgggagggtaaaataacagcaacgtctgtccccacgtgctggggaagattcggcctatctagggatgttctcttccttcttcagtgttctatacagaactctctggaaagggggtggccttctcatatcgaaaaggacccttcttcattctagggagtctgaattttcatagcaccattgagttatctgttccagttccagaaaattctggtggtataatacaggggatcaagctactaaccacaatgaacaaagagaaaggaactaaaatttactaagtgtgtatgatgtgccaggtacttcacttgggtagtttagagctattctcacatttagtgtcaccaactccactgaagtctgactggggctaatggttgagtgggtggtgctcttactattaaacggttgattcattcatgagaccctgggctgtgcagactgaacattttcttagccaacattggcccatctgaaaataatgggcaaatattaggatactgtgatttagaaagaaaagctcaagattcctgctttgctattccatttgacaaaactactcagactcatggcatattagtattatgaatgacatgttgaaaggacctgccttaacatacccttaattcccttagctggacatttaacctccaccaacaaattcaaacctgctctcagttaagggaccaatttaatggatgtatcaggagaatttctctgcatctcaatagctttgctgggtcatgttttggtctgatgccctggttcaaggtaaattggttcttgatttaattaagccaaacaaatcttactctattgagcctatgtcttggtccctccaacactcaagttctgcggtatcttcagtggaaaagccagaggctattgtattcctgagtcccagccttaaaaggagtgtccttcagtatcctactgacttagtctggctctttgaaatatcctctcaaggcatgtgcttgatttgtgcattcaaagtccacagttttccaaaccaaatatttaaatgcttttctgctaataaaaaataatttcatgaatgctacttagagggaaattaaccaaatcattctggcagtaattcagattaattttaaaaaacacaggagagattaaaagaatgcatgaatggtaatctaatgagtacagaaattactagactaacttaaatccatgtattccaatgttacagtaggaggtctggggagttgcagagaaatagctgcttgtagttacacatacacaggctgttttttttttttttaagcaaattgtaaatttaattagctgattacaactttgtaaccaaattgtttacttggtacttcatagaaaggagtatagttttcattctcatttaaccttctctgagtgaaggaatgtggaagtgatgattcattttttgtggtcctacatttataactggggagcgctttgcttcctgtgaagcagatcggttccaatgtttgtgggaacattttgactacaactgtttactagtataaaaatctgtgttataaaatgtgagaatcactgttttctatgtaagatgtcaatagttttaaaatggcaataaatatttaagggggaaggagacaaaatatttaagtgattctaaagcttgatatcccaagcgatataatttaatcacaacagccccaccttccaggtctttaatgttttaccaaatacattttatgaataaatattagccaagtacttctggtgtttgtgattaaatattaacagggttatttttacaaaatgcataagaacatttcacaggactgtgtctatgaatgtaaataggttgacagacattttgacagatgcttatgatttcttgtagtgacacctgcgacacctgctttggttattatttactattagaaaaacatttttttttgcctaatgttcaccagttgccttcttcctcatcagtgtagcttgtagtttattatcctctgaaaatgtaattttaccagagcaatgaataaaaaattttgtaatttatactaataagcttgaacgggaatccacttgctttggacatttccagccaggcataatttatccctatccttggctgtgaaacagtgcggattttcttaactgagtccctgacagatggtttcagtgttttcaggactccatttccaatcattttgcccatattgcaaaattggccttgaaaaagggtaaagagttgttatgctgcattaacatcccttcagaattgcttgctgtgaagggcatgaagaaatgaaggaaatcaagacagtaaggtttgaaaaatatgctcccggaagttagaaatgttagtgacatattgataatcccagattacatcacgatctccatttgattttgattgtaaatctcaaagacacattaaatacactagtaaaaacacaaatattcagttagtgtggctcataagccattctgatggtattcataatgtggaaagctagaaagggctatcgtttaggctggcttcccatcatcttaaatcctgctgataggtaccaccacggactgttagatgaacagggattctcacagtacttttcaagtcttgctaccagctcatgatgaaagcactgaaatatctacattcattttccaagaaacatgaattgatcacattcagcatgccaaattttcattttcttttgcagcttcagctgactgacttcttcatctaaagtgctgttcttttcttttcgtcgccttttagtttatgatcaaaatcaatgaggactgaagctttccacagccatctataaaatgcaattactgtatacaacacacagtaaaactcctgtggtgtgtatgttgagacataatttatgccacttacctccagaggtatcgatctttttctgtgaatgttttacaaaagggtctcttgagtgcaagcacaaggaaatatgtggccattggagctgatctataatttgattaataatgaccaatcttttgaacttgactccttactgcacttttattgtgatccgacattagaattttagattttttccttttgtcattctttccagaagcatagttattcctacgttttgacgtgctaatcttgttacttgccttatccatgatgtcactcttattaagtttggcagcactacagggtgatgaatactaaatttggagtcagaagatctgagtttgcttttgatttagccatgtaagagctgtgtgattgtaggtgcactgcttacatacctgagtctcagttttaaactctgcaaaatagaaacaataatccatttcaggggatgctgttttctgaggagtaaataagatatttatttattcaacaaatgtttatcaactaggccttttgacaggttttgggggacacaatggtgaataaaacacacatgattgctgacttcatggagcttacacaatcaactggtatgtaaataaacttcatatgctttaatatgttatacacatggaagatggcgccatcatcatcactgctatgacacattgtggttgttgtcatgcctgagagtggaaagcacaataatgctgatgctgtttctgacagtgggtcccattggtggagggagcacttagaactaatgccatggaaattgttctgaaactgcacaatgagccttcttaatgctccaaagcttagcatttactagtttatccccttaagtttggctggaaactctatttattgattatttcccttgtagccagagtgttctaagtgaaagagacagaaagaaaaagaaggaaaggccttttcttttgactctcctaaaatgtaatctattagagtcaatgagcacaggaagttcattttcaaagaacaaaccttcctgattcatccacggtccctcaggatcttatcttggggcagcatgtgatgaataatccactctcctctcgactatctttgtgaggcagggtaaatttgtgattaaggggttgtggccctttgacctagaatatatttgccattgccagggttatattatgggattttctgccccccaaataatgtgaggacaatggttagttcacctgaaggaatgtctcctgctaaggctctgtaccagccatggaaggaagtatgttttaaattacttgcaattttaaccctatagctctggctatttcatcacggctggaggaaatgtagggttcaaactcagtacttcgctggcatagaaaatggcagcaggtaagtaattggtatatcagactgccttatgctttgactttgcttactgctgtgcccagaatctcatactttgctggaacatttggactatgtgaagaaagaacattttgtcctgctagaatgagagaacagctcaggctaatttaccttgagcagaaaactggagagtagtattaaacttcattgttatatgactacaatatattttctctccttgacctggagtaaatgtccacttacgggattagaagaaaattaattgcctacttttagctcactgaagtcagggacataataaaatgttcatgtatctgtgatcagaaagattgtattgtcaagaaaatgttccagtggcacatggccactttttgtcttaagcacaaaagtctggaagaaaccacttctagtcagatgcgatacttgtgagtacatgaaaagttagctctttctctctcggtctcattttctgtaagttttaagtgccaggaaaaacatgggtactattgggctaagatccatgggatgggatattttatcatgtttttgttcactcaaataagaaaagggatccaaaaaataaaatgagggtaagcttaagaagaagttagttgatttttataatcatgttttaaattagaaaagttctttcttatgtatagtatcctagattttttccgtctcaggatattgaaggcctttactgggaatcaagctgtcagcaggctcacagggaggtactacttgtcacactctgttttctaacttgatttttcaaattagatttcttgatttttcatagtagagtgatttttcataggagaatgattttttttggcagaaaggcataatttcttatgtaaatttttattcctgcagaggaaaaggaattaattttcattgactatacagaatgtgataaatcccatgattagcatgttacacatatttttcaatttttatctctttgtatccacctgtgagataggtagtatctttttcttttttactgctgcgggaattaggagttaacttagtttttctgcaaccttatttgacatcagtaaggctcagtttctcatttgtgaagtgacgctgatcatgccttcttcatagatatttaatgatataatgtgtgtagagtgaagatcacaatcacatagtaacagtttcagaaaattgttgctttttaaaattttcattattattactatcatatttttccctacctccaaataccttgacaatgccaataatggagtcaatcatctgaatggtgtatctttgtgcagtacaaccaattggttctatcgagttgacagaattatcctgaacttaagtcactgcattaattgttcttattccaggtacacataatttcatggatgaatctgcatatgcatatagaatacaactcaactggtttagtggtctagcttttatgggcacagagtaatagattgtggtggtgagaacatgatcctaagagtcagagacctgagttctaatcccagaggtacatcctgattgtactcccactaaatgctgtctcttggttaagttcatgcttttatttcctcatctgtaaaatggggataatatagatttttgtgaggtttaaaaagggatgttaaaatggaagtttcagcaagatatcatggattagttaggtttctccagagtaatagaatcaataggagataggtaataggtagataagtagatagatagggatttattttaggaactggctcagtgattgggggcactggcaagtctggagtttgtagggcaggttggtagcctgcctactaggattgatgttgcagtcttgaatctcaaggtagtctggtggtagaatcctttttcctcagaaaacctcatactttgctcttaaggccttcaactgatttgatgagacccacccacattatggagagtaatcagctttaatctaagtctactgatttaaagattaatcacatctaaaaaatattttcacagcaacattgaggcttgtgtttgaccaaacaaccgaacaccatgttaggtaagttgacacataaaatttgccatcacacaccatgatgccatggatgagaaattctgaagctggttttctgtagattgacttcatagagaatatgacttagagccaattccatacttttctagcattttttttcatattctaaaaatgtaagagggtctatggagaaggaagaggaatgatttaggaggagatgtaactgaagagaggcatattattttgtggatatgcagaggaagaaagaagtgggatgggtgttacctcctctgcctcaagctttgtgaatgagatttctataggaccactcagagaatctgaaatatgttccttgcatgtgggagaaagacttagaggactggggcttacacaggcatgggagtggggaatgggcctatggcagcaggatagacatggctgccacggtatttgtttgcattcttggaatttagtggggcaggcaaagcatgtattgtgtttctggtgaatcacaggagagagaactattgtgggcttgtcatgggtctttctaatagggcctcctgaaggcacagagggttcctgtggaaagaacttaagtatgagcactggatttataggggcttaagagggactaggtggtagctagtttgaatgaagttatatcaaatgagtggcagcattaggattctccaaacagcacactaaaagcccactggagagtcagcttcaaaatctgccagacctggagagtgcaaagattattacaatagtaccatttcatgtcgggcctttctttaccccttacctctcttcacacacacaagaccccttcaccaatctcagaggagctggtgtgtgaagggtgagcacaaggtagacaaatccagaagccaggcatgttcctctttccttcctcattgttttccatccagctggaggagaaagaaggcagaaattttaacattaaataaaattcagacttttgatgaatatcataatcttgacactctaatttctaaactgagattgtgttcataatttacagcaatagtaattgcaatttaatataatccaagagtgggcagaagagccttgagacctgcccaagtctttaattggagtcaataagagacaaaagagaattgtgtcatgagtacttgaaaatggttttcaaagggtggtccccagacaggctacagtagcatcgcctgggaacatgttagaaatgcaacttcttgggccccatcccagaactcagggagagggagctcagcaattgcaagcccttcaggtgactgtgaggcatgctttactttgagataacttgtcctaaaacaatgtctcaatgtctcacaagagaaaagtagtttccttttcttatgctcagatatatctatttaatgacccatgcttctcataataaatataaaggaggtaggtaggtaaataaaaacagattttttaaaaattatactttaagttctagggtacatgttcacaatgtgcaggtttgttacatatgtatacatgtgccatgttggtgtgctgcacccattaactggtcatttacattaggtatatctcctaatgctatccctccccttaccccatgacaggccctggtgtgtgatgttccccaccctgtgtccgagtgttctcattgttcagttcccacctatgagtgagaacgtgcagtgtttggttttctgtccttgcgatagttttctcagaatgatggtttccagcttcatccatgtccctacaaagaacatgaactcatcctttattacggctgcatagtattccatggtgtatatgtgccacattttcttaatccactctatcattgatggacatttgggttggttccaagtctttgttattgtgaatagtgcagcaataaacatacgtgtacatgtgtctttatagcagcatgatttataatcctttgggtatatacccagtaatgggatggctgggtcaaatggtatttctagttcaagatccttgaggaattgccacactgtcttccacaatggttgaactagtttacagtcccaccaacagtgtaaaagtcttcctatttctccacatcctttccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtatctgctcatatccttcccctactttttgatggggttgtttgatttttttcttgtaaatttgtttaagttctttgtagattctggatattagccctttgtcagatgggtagattgtaaaaattttctcccattctgtaggttgcctgttcactgtgctggtagtttcttttgctgtgcagaagctctttagtttaattagatcccatttgtcaattttggattttgttgccattgctttggtgttttagtcatgaagtccttgcccatacctatgtcctgaatggtattgcctaggttttcttctagggaataacaacagattttaacctgtttccttatagcagtagtattaaaactgaagtttcctcctctgtatgagacaatcatagggctctgcttattttgtgagaatattgaatcaaatgagctaatatctgtgaaaatgctttttaaaccatgaagcattgtacacacgcaagttattattattacaagtactttatttagatggacatcagcttcattttgaaaggatatccctggggtttgctgatcatttaactttcattatcatacctgtcaaccagtttccaccgctaaccaattaagtatcaggcagaagagccaaatcagaggggaagattggtaaaatcagtgctgaatgctttaatttcagtgggaaaaagtagagttgatagatttttgtcttggctgaaattggatatttagagtaacttaatgactactggtttatcagtccctctattttttccccctacttttgaaaaggtttctgccagttccatagacccagccttggatgaagttaataaaatttgcaaaccagaaggaatttcaggatgagattgattgtttttgaaatctccacttgtggaaagttcttttcatattgaaaatagtctctcatttttttgttcttattggaacatctctttttcagttctattgggaaattatagcatgatgggtttatagatactgataattgtgtgttacaaacttcagcatgctagcagtcaatgaacactctattttcaggacctattatgagcaaagtcctaggggaaatatctaatgtgtccttgttccaagttgttctaagagcttagtaagagggataagatttagacctaggaaagggaaatgtgatgtcagtcaaatagaatgtaggttagagttgggtagataatgcatgagtgtgggtggcttccttgagaatttgagaatttaactctgattaaataaatgtcatatattttatgtaacatttgagtataaagtttggtatttgacattccaggagcttggacttgagagagtgtttaacatgaagtgaacagattctacatagtgtaaagcctcctatcaggtaagatgatgcgaggcactacaggtgcctgggtgatgatcagtggtgttggacaggaagtatctttgagctgtgccagtggagaattcttttttggttcctataccaagcaggaaaggatgatccttaaggaaagtactttaaagtctcttctatcaccactacaaaaaagaacagtttgtttgagcataagaatgctccttccagctgagacagcacagacagaatgcccaggtgacccccagctgtgacagctgtacacagccctcccagggttcatagcaaacagccagtgctccaagactactttcatcaaatactcagccaaagaccaaggctctgtaataagggccctgatacaaacagcagagatcccagctgagctataccagcctacaaaggctagtctggatttggaaattagcaagaatgagacttggattcagcctaagtagcttgtagtttggttaattattgagctacaaaaacagacagtgcaaaaataagggtacaagtaagtgagtgtatgcagcatcttcccaggacctcccaggttccacacagaaatgctcccaaattcggtaatcaatactcatgcctagtgggaaactcaccaagtcagaacaacaaaagctagactcccagtggtgaggcctaaggagctctcaaatgtctattccccgctatttttgaggcctttactgcatgccatagttgcacacttctgagcattggcctctgcagctggacgagccatggctttccatagaaccacagattttacagagagggaaggactgggccagcaaagagcctccttgtgcggccacattaggagttaaaggtgctcaccacttccctcatgaggaagaagcatgtacggacagaaaaatctcttcatatcctttatggtttgttttgtatggattctgtgtactataaagcgaataacatttttataacagaatgtggattgcaatatttccaacaaatctttttgttcttttcatatgtttgtgagttaaaatactgcatccaggtataaactcacacaggcagaagtttcctcgccatcaggtcaagatcctggatcccaaagagggcaaaaatgacaaggctttttggtgtctggcatggacttaattagtggtcacttttagattctaaatctaagttttacttcagcagcatcaattaccttttgtctagtagtccctcaggtaacagtattggatcagataatttctttatgtttggtgttttagggaatttctgaagtttggttatctgagaaaaggcaggatatcaggatgatgaatagcacagactttagggtcaggctgcttgagtttgaattcgagcgtggcattttctagctgtgtgaccttgggcaggttgccaacctctctgtgattcagaaatggcatctgccttatttggctgttgtgagcattgaatgagttgctgtgttttgaaaattcataacagtgcctgacatgtgtttgctattattatttccaaacacaagactcttttgtgaagggcacagtattatctagactgctcagggtttgcctgcttctgtcatatagaatttttgaaaggagcttgtttcttaactagctttatggcaataacactgtctgtaaccactggaaccagctgatgcattatccataatcctaatagcaaaatacagattcaacgtcttttactttcttaacctcatttttcacagtgttacacgattttgatgcaggtcttctcagttggtcctcccatttttcagacatgtgatcaatggttaaataatgacgtaggggtcccttagcttgtggttgcagcctgaatttgaatatacacgtctttaggcacttagctctaagaagtgtccagtaaaacataatgttcagaagtaaatagcatggaagaggtctctaactcaaatcttgaaaggtctggtctgcaattgtggaaggtgtcttatcctttaatgacacttgtttatgagttgggatcttcagcatagttttggtttttgcttttagaactttgaaaaatctatcagctgtcacagatacgatttttgtcatctagctcttttgagctctagggatctgccttttctaaatttcataatataatgtggctatcagttctcaccaatgaattgaaattaggcttttcatgtgcacaatgcaaacatgagaaaccgtagtttgttactgagtaatgaaatggcaaataatcagttcctggaagcttttaggagttgtaccatgcaagatatgactacaaatcatagcctgagtgcctggacacagtgattttcatacccagccatgtatcctgggtagagcctttaaaaatgtggattcctgggtccattcatgacttgggaatccatatgtcttatgaacagaattatgtaaaaaatttcatagtgattctgatgaaccactttcccaaatgacacattaaaataatttcaaaactctagagtcacatttcaaatattaacattaaagcatttggacactggtaggaacttacattctaccattttacaggtgaataaattaagactgggaatggtgtagcaattttagggtcatagaggtttagagcaaggagcaagtacaccaattatctgatatgtcattggcgctttataaatgaagaaaatgaaaaccagtgcagcaagtaaagatagggctgtcatagctccccaatgcagcaacgagagctatagcaagaacagactaacagtcttacccaagagtcgtgggtacatcaatgaagacggcaattagagggtaaggcctagggcctatatacccatccagtggcctacacagatattcgaaagttgtcttggaatattatacaattagagaaaaaaattaatctgagatgtcatctgagtttggagtgatcttgttgcttgttaatgggggagttaacagagtggagggaaaaaacatttggctgagagctgggagatctgagatctcttctcatgtctatcattaattggctctgtggaaccgtgtgtaagtcacttaacctcttctagcttcagcttccctatctcagaaattacagtgataatgtctttactaagtatttttcagaattgttgtgagtatacattttttaaatgtacagaaattttagattttattgtactaagatgtgtttaatggcaaaaactaaaaggaaagcaaatattagtttttcttttcccaggattccctatcaagggaacattttgatgaggaactaggtctaaaactatatttatttcttttttttcctggcccttatgttaaagattaatttaacaaacattcataaaagtgcatattatgtacaaggtgctgtcttgcactcaaggaataggattttattaatcctcttacatcagtcagagtccaaccagaagacagaaaccacacagtaatttgagtagggtaaatacaatataaagcattagtggtgtgacaagggattggagtaatgagggattggctagtaagaagtaaagagaactctgaagaatagaggagtagcaagtataggagcactcactatgcccaggctgagatagagctttcaaggaagaaataggtctcctgtacccaggattaagatccagaactcattaggaagtgcataatcatggctcactagatggtagaggagacatcaaagtacctcactggcagaagttactgcaagcccatcttctggagtgctggagaagctgttcacagagatgggctgggcctccgaatgtgcagcaatactgtctcagaagttttggggaagctgctgggtgctaggtggggctggccacttcatgatgcacaaggtagtactagagaacccatccatggtaagggctggatcctggaaagaccacatattgcaggagcctgttgagtgcagtgtcttggaactgggtgggaaaccactgaaaatgtctttttagtgccctttcatgatggtgctttgcttacaccagctggcaaagagaaatatttgaagggccccgatctatttgtgcacaacagacaacaaagggtgaatatggagcttcaaaatcaaaacattgataactggaacactttttaacagttctgtgaaataggtactattattatccttattttatagataaggaaactgagacacagaaaggtgaaacaacttgcacaaggaaggtcacaggagtaataaggagcagagctagggtttgaacctgagtattttgactccatagtctactctgaattcctcccctgtgcggcctctttgtctccttcctcaccggtgatgcatggtcagtgttatcttgcattatcctgtgactttatatgcaagtcccactacacttgaagattgactcttacatttacagacatctttaaagtcctggaactatttagcacaaagttttcttgatactttttctgccttaactatttcttctgcttgtttttgatgtttcttcaatttctgctacaatcatgtgtccaacccaaacctcaaacctactttctttttagatttcctgatgcaggtaaggaaggaaatgtgaaggagtggtttgatcttctctgtaacatttctctgttttctgctatcttgccacactagttcagacccatagaatttcttgcctatgaacacggcctgcctagcagtctgtctgctgcccatttaaggtccggttcatccggaacaccatcactgcattagccttcctgaatagctgccctggtcacatcaccactctcctcagtaatctccaatgcttccttaggcactgctctattaaagactattccctcagttcagcctgcaaagccatctacattgtggtcctaagtagacagctttccagccctagctctcctgtcttctactagtgcctattcttctgcctgaagttgctattcagtgtttcctcaactttgtttctgccctgcccctgcttcatttcagggatgcattatgccaggggcttttctgtccccatgtgtgtccaatgtcacccatcttagatgtccctctttccacaaagcctttcccatttccaaacaatcttgttctcttttgaagctctagaatgctatatttttctcttgtagtattgcttcttaggatagcagtactattctcaacctccaccctattattagatcacaaattccttgaagactaaggcaatattttactagtttttctttctttcttgtttcctttctttcattttgtttatatataattgtatttttttcagtctgagaggccactaaaataggtttcaaggtgtggattttcagtcaagttcataagactcaattagatttactgagcagaaattttacttagaaaaaatgtagaacagggaactcacctatgtaaagcagcatcatcacagaaactgcagccactcaggagcagtttctatctcttagtcatggctgggacatgtttttgtctaagattaatagtaaatgaatggagaacaaggcctatcagagaaatcacatgctctgcattcccttgatgctatggactgaatgtttgtgttgcaatcctaaccccctaaagtgatgatgttaggatttggggtatttggggtaattgattcatgaggatagggttctcattaacaggattagtgccttttcaaaaacagacatgaaagcttgctcttgttctctgctctgctaagtgaggatataatgagaagatgggcaactgaaaaccaggaagcagatcctcaccagacaccggatctgctggttcattgaacttggacttcccaacctctagaactgtgaaaaataaatatttgttgtttgaaccaccttgtctatggtattctgttgtagcagcccaaacttactaaggcattcagtttgaatgccctgctagctacacagccctgcaagagtaagggacattcactaccatggtatcctgcacacagtaggggatcaaattttttttaaattcaattttttgtcattttttggttaaatgtctgattttacagtgcactgaaggtcagtgttttcctcatattaagtgaatgccaggtctctgacctactgctggcttgatactttctatacgtacccttaactctctgtttctaattctcagccccattgagacctccagtcactgcttggttttcaaaactttcctaataatttggactcattttcagtgccaacaaccttcttgatctttgaaggcttgtcttaacctcctctccagttctgggtcctttatattgctctataatttgccccagagtagcctgactggccaatatagtcatttgtgagcaatataccatgagaatacctatgcctagaaataaataatagacctcaacattgcagactggatttctgagccactcagcaggggttcctggtagaagcaataaaagaaaaacagtcttaaaatcacattttttatattagcaaatctaaatctaggggatatcagagtgtgtacttatcagataatttccataatactttttgtaaaacttgtgcccattaggtttcttatgtgattaattggagatttcagtttgcattaaagttttgcatacactgaacattcaatcattcaataaaagttagttaaataactatgttaggcacatgatgttctgttctcaattactagaagtgtcattgtttgctagaaaattgactctgaggagcatgcaggtgtttctgtgttctaaactttgttgtgcataaaaaccacttcccatgcaaattaaaagtgtacatttctgggaaccattttgattcagtagagacagaaatgggcccagacacctgcatttttatagtgtccatatggttctgatgtatgtgatctgaggaccatacttgaaaaaacaataaattagtctttaccaaaagcattcaagagtttcacagttttagaggtactttctgagttgaactccaaaatatccttgaggaacttagagagatttttaaaaacaattttattgaagtataatttatctattataaaatttacctattttagtgcacaattcaatatttctaatacatttgttgagttgtgcaactgttgttgcaatgatttttacctcctcttccttgcctggattgaaggaattctgttactccaagggaagaccaaagagtcaaagacccaagtttgagttttggctacatcatccagtgtcctgagacctaggagcaagggacatgggtctttccatgtcttagtcacctcatttataaaatggggatgctattaatatttcctttataggatacttgtgaagattaagtgagaaaagatgtttggagtgcaatttgtaagtttattcaactatctagtgaatgaatacctacctttggttgcttacttgctggtctaggaacagactattaatgagtaaagacagataccatctctgctctccctgagcagatagccagtagggacagtgtgtgtttgatgagaaaatacagcaaataaatttgatttgagtgggaagacaggatcctgtttaaggaagtcagagaagttttactgaaggaggtgatgtttgagataagagctaacagattaactggcattaattaggcaaggagatggtggtgctagcatatcagggggaaggagtgagggccaatgcagcagagggtacatggaacattacaagtatctgaacaaatgctagggtagctgcaacatgaggctcaatgaagagggtggtgctgggggcaggcaccagaccctgcatgccctgcagctcatgtgaaggtttggttccaatccctgaagggctttcagtgtgtgtattttcatgagcatgggtgtgacatgatcagatttgcatgtcaagtgcccaccccgggaagatgaaaggggagtaggatgagggcagaggtcatcagaaagccaaatgggaagctatgcaacagttcaggtgagagacaatgggctaaggtagttgtggcagacctggagagaggtgggtgcagaagaagcagatttaagggatgaaattgattgggtttagctatgggttatatttgggggtggcgtggggagaaggaagtgtctgaatgactattagatttctgacttacataattgaataggtggttgttaatacattagggcatggaacacaaagatgaagaatttgaaggtgaaggggtagatcatgagtgaaacagaagcaaagcatttacaccagtgtttgacataaccagggatagccactatgatgatggtgataattttaagatgtcattgaagcatcctagtgaacatcttaagctgtaatgagctatactattattatcattactttggtcataaaacttggcaagcaatattttaattcatgttttaatttcttaccgcatatacatcaaaatcacttataacatgaatccttctagtagttcccccagtggtataaaagcaggattttaccgtattacataggtgcacatgtttcataatcttctaagtttattgattgaagctgaaagctgcagctagatcattcctcagagtgcctctagggagtgttacattagaaagataacagcaggcttgtaaattagtacagtttaccaacccacaaacatttgtcaccctctcccctcctcacaggagaaaataagcagtctttcctcagcacctcctgcctcatgatttgtttggcataaattgctacctgccttgtggctgggcagtaagctaatttaaaggctgaatgagaaagctcagaaaacagccagagtgttctattgaagtagacggtcagtcaatagggaaaaaagggaataagctgattaatgataaaatcaggaacaccctttgaaaagaatctttatgctttgtcaagctaatttcagtggatctcatatcactggtcacctggtacccatccaatattcctgatttcaagtttagacagttctcagtatatcactgtcaaatcatgactgatattcctttcagtggaacaatactcagataattgcaatttagcttttctctctattataaatttagttgtctctttacctgtgcaacaaaatcataattagatgaatacctgcatatttataggtatatttcaacccaacagacggtctagacattttctgctaacaaactttgattgattgttaagggcatgtggaatcagtagttggctatgttgagtacatctctgagctttgctttttccatctgcaaaatagaaataatattatctccctcatagggtaattgctggaactaaatgaagcaaatatctgtcgcatatatctgtaaaattctttgaacagtgcctcttacataaaaagcattcattcagtgaaagctatattatcgttaaagagttccttctagctcagcctggggagatagtgtgtaaccatttctccatccttggataaacactgtgggtggagtttgagtcagaccaaaataaattgcccttcatttgtgagatctcatatttgctaagcatctttttttttatgtcttgaatgtaaatcctggagttcagaggctacagctatttcttctataaccccagtgtctggcctcatgtgctgcaaagggtctaagttcaatcactgtttgttgcatcaatgaatacatagcacagtgatctgaagtcttttcattggccctcaagtctctgtggaaggaagttagggtcttgtaaaaggaaagatatcagtctgagactattaattttatgcctatggtcatttggggaggcgggcacattagaggaaataggactagatccatggccaaagataaagctcaaacacaatttcttgtggcataatccaaacaagcgatattcgtaaaaacaactccatatctgtggatattttcttgtttttagatgaccaaatttgtctgaaggaggcatgaagcaccatgaagtaaaaattctaacacttggtgtaattttgatatctttattaaatgacattatccattagtgcatgactgctgagcctactgtttaccagcttgaggtgaactgcaaaacttatatatcttatttaaaaattaaaatgttgattctacagggttatcaaagaatctaagacatgatgatttcatattgcaagttatgtaaatggaattaattttggaagacattttgtacaatttaagtagcttatttccacattaataaatatgatgtggtggctaggataaacaccttgctttggaagagcacgtttattttccaaagacagtgttaacttgtgccctgtcatagagagtaacgacatatgtggaacatctattctctttatttctttcttcttttttctctctctggagactaacgtcttcatttacctaaggtctccagcaattggaggcaatcgtaaggaaattggtagtcctctgattcttctgctccattgtattcccccttctttttctgagtgtgtgcttgttagggagcttgcaaggatctacagtgggcagaagcttgtgtttcatctgagagaggagagtgacaaaaggggactaggaaagtcaggcgtgacatgtctatttggtgtgatctgagtttcttcctgtgtttttcactatgggcttcactcacacccatgaaacagttaacacatgttccaacaaaagcaaaaccaatgtgaaaaatgtctcatcaatgcctttgtgtggtgagcaatgggaagctgggcaacaacattttttcatgtagctgagaattagcaatgattatttcttcttaaagcaacatctgcttaatgacagctcttttaaacttcatcaggaaaaagtgagtgaaaaatcctgttataaatactacagtgaaagattctatttagatgttcactgtttcaaagtcactagctctgagctaatcctaagcttcagaagcttactgtgcaccctgacatgctgactattcaaatgggtctctctcaagatggctgggaaaattgttcatatacaaaggagctcagctttagcacctagtggggctgaaagccaggtgtgacaaagggtgcctggggaggccagagagataaacttgacattttgcccattttcaacattgaaatgactgtttataagtcaatgatgaatgtaatcatagtcttaattagtaattactaatgtttatcattatacacaaatattaagtgaaatactttcacaaacattattttatataattttcacaactaccttctgaggtaactaatatgcctgtctcacagatgacaaagttgaggcatagggaggctgagacaattatctgtagtagaatttgcactcgaatctaagattaaaaaaaaaatctacatgttctgcacatacaattctagcattagccccactaacatatagggccacaggggaaagtaaaatgttttaaaattttttaaagtttggtgactgaaggaatattatattttggttttaggtagaatgagaagtgtgggcacaaaagcatggaaagcctgctcctttttgaagaattatacaaatacatagtcatataatgtataggaataggtaacttttaaaaatactttatatgcgtatgttcataatgtatgtatttataaccactatcaatattaatttaaatattctgttataggttcaaactgagggattagtatatatttaaggcatttgccactctacactgaaagtatagtctctctcaataggcacttgctttttggctccaattcattttaagtttgaacttctgaacccttccattggaagtttccatttattttgtcatgggctcttgggaaataaatacctgtagtatgctgctactagtctgatcttctctgcttccctgaccttggatcaataaaggaggggtcaaagtagatgttctccactttgcagaaaaaccttattttaagtagaacaatagagcttggtttaacctggaatccaaaaagaataggacttgaattacaattacaggcaagtcttctaaaaaaattaatgcattatgtatagcattaaagaattattctaacccttagtgataacaggcaatctggggcattactcatatctcatttgtaaatacttgctatttttccaggctttgtgttggtgactttctgggttaattactgaagagtctgttttcttttccatagaggccacaactcttgggacagaggctgccagccacaattttgcatttcctttctgcatgtggaacctgtcctgcctatgaatgttgtcccagcctttgatttcagatttctgctgcatgcggcctgggctccactgctgtctggcaccctgctccctctctcagatgtgaggctggtgtgtacagtatagactgaccctcattcaactagagaccttgacatatctccttcactctgtaaggagtggagatgaacagcctaatagtagaacaaaagaagaagctgcacattgtacccaaaggatttggggaagacttttccacctctcttccaaccccctggccccagtgaacttgtagactatatgtcaccatgcgttacttttctggcaccagtatactacagcaaataacaattatttctgttctgatgctgaattagattcttagctttaaatcctctcacacacagcaagtttgtagaccctactgaagattctggcacaatttcagtcctggtgcaggcagcttcaataagacatggtccaggggactgaattgaaggcatattttcttttatcaaggttgactgaaagaaagtagccaccgggaggttctgacaactcaggaatggatgaccctgcccagtagctctggcccttggcgctcagccagggcagatgctagagatgagtctcactacagctgcagatgccaaagctcaagatgcataatcctgagcttgacagctgccaaactagccccctgagtgtccaaatgagttggctcttctgaaggagatgacaggaaggaaccagagggattgctgtggctcctctccaaatacagcattaaaaggaagccaagagaacttagcaattttgcctgtattgtaagaagcgcaaagaatcatgtgataatcttaaccaactgttatttcagtggttggaaggggttatgagctagatcccttatatttttgtaaccctttttgaattttaaaacattcattaattccatcatttgacaaacatttatgaaatgtccactgcatgacaaatagtgagaacacagaggtatataaaggtaaaggaacttaccttaaggaagtgactcttaatctttttgaacacagtctaattagaaggggacaatactgtggctcatcaactctagcctttccccttttggtaggggatatttgagagggtgattatgatgaatttactttaggattagtggttcgtatttgaatcatagtgcccagtctagtaatttaaaaactagaggctaaaatgattttgatgcaaatacacatttcttcatactataaagttaaccaagtagcacaaagtaaattaacaactagaaagttaaattaatagtatttcttactaacggtaacaaatacaaaccacccccaatttattgtacccataataaagtgttttctcccaactgcaaaattctatctgcttatgcatgtgtagaaaaggagcgtttccatgttgaacagaattgcatggcagccagacttcttagcagaaaaccaaattagaattctaactacattcttagaaacagtaattttcatttacaaacactaaatgttagaaacttatgacacactggatatattactagcaagtaatccttagtggtacaggaagatgaagctatacagtatcgaccctcagtctctctaaggacctggaaaaaggtgttctttctgagtgtgtacagagtcaatatgagaattactaaaatagaaatatgcatgtggaagacatcatagaagaaggagggaaaagtgcccaactacccaagtaatgagagaacgttacttgggactggtggtctttgaatggggtcatgaacatggaataggaattttacaggtggatgaggatgcaaaaggaacagtccaggtgcaggaaacagaatatatagggatatcacagaatagaatgaagggatatcacagaatagaataggttctcagtctcttacctgcaattctgaattccccacatctttaaaaactgaagggttttcttaactcatgtggcaacaaaattgaccttacgtgttgtgaggctacatgtagtttctacttatcagcattaatattcacatatttggttgcagaaatattaaagtgttgattacaatgtataccagtacatcctgctggaggttttacttaatagatgctacatgcatctatttctaaaacctgaataattttgaattccaacacacctggccctaagggcggcaggtaagggattgtatacctttgagtagctaccaacattgcattatggtttgggggaacaaggaacatttggagatgtgattagagataggatgaaaaaggtaaggaggagtcatctgaacctcttgaattccctttgagctctccactaaggctttcaagagaaccacctatgtcctatggtttgtcagacttgcctgcgtcttgctccatgtattcgttttctagggctgccgtaaaaaagtagcacaaacttggaggcctaaacaacagaaacgtattgtctctcagttctggagactacaagtctgaaatcaagatgttggcaaggttggttctttctcagggctatgagggaaggatctgctccaggcctctctccttggcttgtagaggaccatcttctccctgtttctcttcactttgttttctctctgtgcatctctctgtgtcccaattgttcctttttataaagacataacagattggggtctatcctaatcatctcatctttgctaattacttctgaaaagactctgtttccaaataaagttacattctaaggtactgaaagttagaacttcaacacaagaattttggaggtacaaatttaatccataacttaccacatcttgcctgccttcaatacattctgctttttatattagtaggctgaagctataagtgttgcttctccttcatagactctctctctccgacatttttaaagccttattatttgggaaacgtacaagttatttttctcatttaaaaaatcctcacttctaaggatgattcagagaggttcagtgacatccttgaagttgcacagcgaatagcagacttgggaatcagtctcaagtgtttctactactatggacaagcatttggcttttgcccaatgcattggaaaatggttaaaacaaaaagaagagtccattccctgatgctacctcaggatggtagataaaacttcatatcccccatgtgctgtgtgtgtcatgattgtggacttatgaaagttatagggtctatgttccaagtgggtagatcccatcatctcattggtcttttagactcttagcttgtgagataatgtaagttctgtacatctctctgatccaaacagacactgtgcaagactgcatattaattttttaaattgcatgctattctttttcaccaagcggatgtccatctccactccacttcctgcccctccactcacctccccttgctacaagtcagtagttcagttgagatgatttaacccagattacacactctaaaggaaatttactttactgtcttagtttccaaatgttttacggtcagtttaattcatatggcccatatgtcttctgtcccacacagaggcagctgcatacttagtgccttttctcccttcccaaagaacattagaataaacagagcgttgcagaaagtgatgcctgtgtgtatgtgtgtgtgtgtaagagtgcacacatgcaagagatagtgagactaagaaagagagattatagtttacaaaatgctttccagctaaaatgaccttttaaaggaatttctaatctagctgggctgaaaatgtttcccatgggggatgattgtaagtgaggcaagaagtctgcatttctgggcagatgtgtgtctaggtgggaggtgggataaattagagaacagttctgcagcatgtccaccagtctgtgtgattttgcttcatcatcatcaattaatatttattgagggatagatcatgggacacatggtactgtatgctgctccaaaggctaatattttatctcctgccatggattcctggagagcggctacatttcacagctaaattgtggatacttgaacagttggttaaagggattcattcatgtgttgtttataaaaatgcttcacattctttggaatcaagaaaagcttttatgaatcagtataattttagctgattatcacagagaggaagagaaatgtatatattgcaccaaaagtagtttgctttaagaatagattaataacacaactcatgaattccacattactttttaccatggtgttctaaagggctgtaaataagacctaatgcataaatttggaatcattgttgagaaacgtttttattgcaggtgttatcattttcctcattcaacaattggtaggcctgagcgttttaatcacgtctgtaaactcacatgtggaacatgaatctgatcacatcagccctctgagccaaagcaaattgaattaaatactaatttttcttctgtatggcccatgggttactcattactctgctatcttacctaactctaaatcttcccttcttctgttcttaccacctcatgttcccgcagcctctcacacactcatgcatacctatctggtgtgcatgcaccaacttctgtcttagtcatatatttttctgccaccaaaccttcgatttgattgtttactcatctgtaacaccataggctattattcaaatcctgcttgcttaagtcttggacatctttaaggagctattcaaatatcaccagttatcaagaccattttttgatgtcctttcctttccatcattagtaacctctctatttttacctctttagccattactcatcagttggatcgtctactatatctctttcctcccgcctccgcaatttctcatgctttatctacttgggatttgcttattagttgctgaatatttcatgttactggctgggtgctctcgtaccttaaggcaatagaatcatcaatcaataagaaaccagttactcagaatatttgtttcgttgtctactgtgaagtaataaacacaaagagcattacagtgagcatcaaatgatgatttaatactgtttttgctgattaggaattaaattgttttgtatgaaatgtcatttgaaagtcttcagatatcacctggtgctcaaggatatcttgatcctgctggggtttccattaagttgatcaataaaagtgatggttttgtcctcgaggaacatacttgcccaaggccaacagcagaatgggggaattgcttcatctaagttattcttgcctttattatatactttcagttattaagaggaggtagaactctggagccttttgagtttagaactttagtgagaagtggagagggagagaaaaagaatgaatctcttgttacttattcccactcaaacaggtttgcaaagctgtttattaacaacaaaatcatgaacgactatagagagagccaatgcccagggtgcagaaggtggatggaaagaaagagggcagatcttttcccttcatgatgtgtggtctggccatcttaggggcttctgtttttgttttgtcctttagggtttaattagataggattcatcattgaacatctaagaaagcatgtataagtcaataaattataaacaaacattaatcaatggattgatccaatccacaaatgtactgagcacctactatgttccaggcataataaagcaccaagaacacaacagtaaagaagatagatgtagcatttgcctttgctgagctagcaaactagtgtgcatagtagtgactcagcagtgagcaacagtggcgggtgactaggctgttacaggggaaggacagggtgttgcggggccacagagaggtacctcacccagatttggaggctcagaggtagagttgtctagaaattgggactaaagggtaaatagcatttaactgatcagagtgaggagaagaggattgtaggcatgtggaggacatatgtggaggactgggatgaaagaacatggagtgtatgactgttgacatggctgaagcatagaagctgggggcacagttcggtgctgtcagatgtaaattttgtttctgggggagcccatctcctaggtaggggagtaagaagtggagtctggagtgatccttgcacatcagtgtttggttatgttgcttaagatctgactctgagtttgaagcagacagatacacaaggactgaagggatatttctctttaaagagaacatacggcactggattactgagccctcccagaagagatctctcctcatatttgtgcctgggcttctgtttacagaaatggtggagcggaggtcagggaagtggggagaggaacaacattgatttttcttatactctacttgggacatttacagaggcagttcctggcaattctttgagataatgtaacataatgcactgggagagagctagggagataatccctgacatctctgaagaaccgttaggagtgaacagagttgcctgggaccatgttttggtgaacagaattgtttttgaaattgagtttcacataagcttgatgtcctgaagcagtttctttccaccactgcaatattcatcaaacatgcagataaaaggtagacaggaaaagcaaattcttaggtgctgaattttagtagctatatttgtgaaactttgtaggcctgaggtatgccttcatctaaattatgacagtactttgtacatagtaagtgtaaaaaaatattattagattgaagttaacatttgaatatattactaaagggtacaggtcaatatgaaattcaaggaaaaacccagacttattttcttccatattaagaacgatttgtttacttcttttgcattattcctacctggtactgatcaggggcctgggtatgtaatatttgttgaaacatggaaggagtgtagtcccaaataagagtagcataaatgtcttcatcatcaacaacatagttattatgtctcacattttcaaggtattttattatatacctaacacataaaattattaaaaaagaaaatattgatggcaaaaacagaagaatatataaagcatacatttatttcctagctccaagtagctttccgtccccttgtttatagaggcaggtcttgctgtgttatgcaggctgggttggagtgatgcaatctcactgtaacctcgaactcctgggttcaagtgatccttttgcctcagctccccaagtagctgggactgcaggtacaggacaccacactcagctaattaaaaaaaaattgtagagatgaggtcttcctatgtctccccaggtggcctcaaactcctggcctcaagcaatcctcctgcctcagcctcccaagtagctgggattataggcgtgaaccactgcacccaagtagctctttctaatccatgggttttggagccacataagcttgtgcttaaacctaacagtttccactgttgaagtaatataggggcaagttcttaaattctttatatctccttccccagcttcccccatcccctgttcattttttttttctccccaaaggctggagatagtgcatgctgattttgtagttttgtgaagctatgaggagattgtatctttatgtaaagcatgtagcagagtgcttggcatgggtaggctattgttatttgtctcctcaactttccattaccctttcctttgttctgaagaatcaagcttctgagcagtatggctaagcctcattagtattatctcatttattctgaatttgttattttgccaagaatagacaatatattttgtatactctataagggaagatttccttaaataaatgaatggtgtaaaaaattataaaaaaggtattacatttactcaaaaaacacctttagaaagtgtgaggcaaatgacacaaacattaattaaagttgccccttcctatgtagacagtccctaaaagaactgagtaatatatattctgcaattcacttgtttaaattcaggatagcttagccatgttgtttgatttagtaaaatttcctacagtgtttcccaacattaaaaatgctattttgttttcagcaatgaacacatttaaactgaagatacacttaaactaagggattccaaggaaataaaaggactaggttatacaaggaaagagttctaatatggaataagcattttcattgctttttttgctgtgaaattgaattgtcagttttcctatcttcataaattgcaaaacagcattcatttccttgtgccttcttctctctctccctcaccgctccttatgtttttacctttccgtatgcgtgtgcattacttgaaagccatgcatgggctgaaggatgttgcagtagagaaaaataagaaggcaaacaaaagcttattgaattcactgtttgttaacaagaaaaaaatatatatacacatacatatatttatacacatgtatacatacaaatacatgtatatgtaggtggacatgtacttgcatagacattaatgtatcatttgaaatgagaaagtttattgatgaaaacctatcatcttaaaaatctcactgccacagtagctacagataaatttctagtgtttttcactatctccatcataatgtttataaaaaattatttatataaagatgatgcataatatatatattttcattatacaaaaagaatggggttataaaccccaaattcaaaaatgagaaatacggattgaaaaaaactccttgatcatgtgtcacgagaatctggaataatcttccaatctttcatgctgacctggattaggcactcagaaaatccattgccgctatccatcctctcctgccagtagtagctagacaacccaaatataaggtttttttgcaagtcactgtctgactttttcagacaattcaacaacttctttttaaggggaaaagcagcagcatttgttttccttcaaagcattcttgttctatgattgagatgacatggtttttggactgctccctgcaggaggagaagccagacggaaggtggctttctctcagctctggcaattatagcaaagtcataaaaccccaggtaaatgggaactctttaaacatttgcagatataagtccgacacggtaggaaagtgacccaaagggaagtgcttattgatccatttccccccaaagctgtcagtgatgaatgaacatcatctaatttaataggaacagctctaagcctgcaaccttgcaggtattctccctggtttttcttgtgtgactgtttgaccatgcccaagaaacttaaccttttcagtgtcactcttcccatctgttaatggggataacagtgtttcagttctgagccttcttatctaaggtagctcaggagaaatatgctgttgagttgcattgtatcataaacatatttcatgccgggttttgtcacttcattttctctttggtaaggccttgtccatcactgcagaattcattctgtccttataaagcagtgaagggggacatttcaaagttgtggcattcacatgcagttgattgagacagccacaagaaattctgacatccctgccaaattcatttgtcttgtaagctgcactttttctgcagctagatgttggagcaaagagctatggaagagacataacttgatcagatgatgttttctctgtcagttttcagattaaatccatcaataaatacttcctagggtgattctagtatatatgaggtgtagttctagaaactcaagcagaatcctgaagatggatatgatgaatgttttgcacttaaagactctagagtgctcagacaagttagagccactaccaaacaatcaaagtgcagtttaaacctgcttggcatcactgatgtcccagtccatttgggaaatatgatgtacactcactgtgatagagagtgccggggctcatctacatccagttttcctattctcttggaacatttgccagtgctatagttcccagcccccttgctgttaggtggaactgtgtgatgaattctagccaattgcatagtagtgggtgggatgtatgtcacttctgggccaaggcattgaattgctgagaaagctacctccaagcttgctttatctttccccaccatggtatccttgaaggccaggtgttgagatggcagcattgccagatggagggagctgggatctctagttgttgaatgatggagagaccctaataatccccactggactttatgtgagtgagaaatacacttttgaaggggttcgcaattgagatataggagtttttagacatcattgcatagtctggcctattttgactgattgaatgttaaatcataagaattaaatggcaatgtaagacaatggcagtgtaactgtcacaagcaggtagaaaaataattaccaaaaaagaattcaggtgaacaagcttcctcagcacatgggaagataaccagtgtgggtggaagcgatttgaaggatatggagatttggataggaggaggacagaggcaggaggagagatagcctgagaagaagacaatgagatgatgttgtgagccaagactacatggctgcaagggagagtaggatactgacactgctaccttggaaaagggaagaaaaaagaaagataaactttgttttattgaaatactaaaagctataaactcatacacatataggtagttattgttcttaagaggcattgtttcaaaatttaggactacaatgcattactgacattcagggtggagaatatcacagttgattatttgaaagagagcaagacaagttacaattgaacaaagaccataagaatccctgggcaataggaggccgttcttgtgaaatccaggacaccaagcatgagtctagctctatcccttggtcccattttctgctgggctagctctccagttgtgtgcagtgttgacaatgcaggcatagcattcattgcacagcattgaggcctgtaaatcagctagttcatacaattgaatgtgatgactaattatgtccaacattgctaaaaagtcccttagaaaatggatctaatttgttttatgtagttaatattattttattgagtatgcattattgattttatagagtagacaattctttgagagacatgtttatgaatttgtatcagctctagcaccgtttttttaaagcacaggagatgccagtgagggacttaaaattcaagtcctcattttgtgattgttaattttattccattgtcatttagattaatttcctcctgcatttcagaaaactaattttcctatttaaaggctgaattgtgagcccaagtctggttccctcagcctatatcttccataaatgccaaagctggattcattcctgcttcccacctctaggtccagccctaggtgcaccctgtccttctggtggagacagtgattatattatgatctgagttcaaaggcctgcaggctctgtagagtctactttgtacccatggggcttccccttagaaagtgttacaatgtgtcacagagcattggctatggagacagatgaacctgaatttcagtcccagctctgtcatataccagctgtgtaactttgggcaaatacactttttgtgctcaagcttcctcatctgtaaaatgggaatatgcaggtatactagttgtgagaatgctaagagaggatgtgtttcatgtcagaagataacaggcatgcaaaatgattgttggatgagtggatataaccagtaatgctggcacagtttagtccagtacttcctttgactgcactggacctgactgaggtccatctcaagcccatatcttccagagttacagcagagagcctattgttacctttcacacttggtgcctcataacaggcacactcagaatttctaatattgggagatgttaatctgacctcttctggcacctgtatattgaagctggggtccccccaaccaggttttcactacatgaaaattcttagagtcttttcttctctcatgattgtacaaaaataactgaaggatttgataaatatgactgtacatttgtcctttatgagaattaagtacaattttctctacactagcacttctaaaactgtgtcccaaggaacactaattctctgaatgttctaaatgttcttagagggaaaagaataggattctaaggattagatacatttggggaaacttgggttaagtaatctttttttctttttgttcaggatttcttaaagcgtttgtaaagtaatttgtactaaggagctctaaaagacctgacacagactaggcatacaacaaacatttgttccatgagtgaatgagtaaatgaacagctgagttaaacctaaatttctctttctggatccagttttgaagcctcatcagcttcccctcactcctcacccttcatacattctatatcatgggtctggacatgattgctgtccttccccactaaccatttgcttttgccaacctgcatgcccctatccagaaaatcaagcgtgagagaaaacactagtgtttctcgtgtgtcaaggatacaggaaagctatcttcagccgggcacggtggctcatgcctgtaatcccagcactttgggaggctgaggcgggtggattacgaggtcagcaattcaagaccagcctggccaagatggtgaaaccccttctctactaaaaatccaaaattagctgggcccagtggcaggcacctgtaatcccagctactcaggaggtcgaggcaggagaatcgcttgaacctgggtggtagaggttgcagtgagtggagatcgtgccattgcactccagtctgggtgacagagtgagactctgtctcaaaaaaaaaaaaaaaaaaaaaaaggaaagctattttcatacttgtgaatccttatagaatgaatgtagtgaccccaacaaatcttggtcaatatatatcctcttaaggcttggctcttttccccttgagatgctatgctcttaaaaggagtacctcaggtgggacttacaggagtctttctgcaggatctgcttcagaggttcagctgtcccattttttccttccttacttacactgactgacaattaccttttggaaatcatagcatggattgttcctctctcctttgcccaattaaggggacttttgtttaaaatgacaatgccaaggtgtctgatatggtttagctctgtctccacccaaatcttaacttgaaatatatctcccagaattcccacatgttgtgggagggacctgggggagataattgaatcatgggggccgatctttcccatgctattctcaggatagtgaataagtctcatgagatctgatgggtttatcaggggtttccacttttgcttcatcctcatttttctcttgctgccaccatgtaagatgtgacttttgcctccaaccatgattctaaggcctccacagccacatggaactgtaagtccaattaaacttctctttttcttcccagtctcagatatgtctttatcagcagtgtgaaaatagactaatacagtaaattggtactaggagtggggtatcactgaaaagatacccgaaaatgtggaagtgactttggaactcgtaaacaggcttaggttagaacaatttgaagggctcagaagaagacaggaaaatgtgggaaagtttggaacttcctagagacttgttgaatggctttgcccaaaattctgatagcgatatggacaataaaatttagggtgaggtggtctcagatggagaagaggaacttgttgggaactggagcaaaggtgactcttgttatgttttagcaaagagactggtggcattttgcccatgccctagagatttttggaactttgaacttgagagagatgatttagggtatctggcagaagaaatttctaagcagcaaagcattcaaggggtaacttgggtgctattaaaggcattcagttttataaaagaagcaagaataaaagtttggagaatttgcagcctgactatatgatagaaaagaaaaacccattttatgaggagaaattcaagctggctgcagaaatttgcctaagtagcaaggagcctaatgttaatccccaagaccatggggaaaatgtctccaggccatgtcagataacttcaccgcggtcccctcccatcacaggcccagaggcccaggaggaaaaagtggtttcatgggttgggcccagggttcccatgctgtgggcaggctagggacatggtaccctgtgtccaagctcctctagccatggctgaaaggggccaacatgtagcttaggctgtggcttcagaggtggaagccccaagccttggcagcttccacgtggtgttgagcatgtgggtgcacagaagtcaagaactgaggtttgcgaacctccacctagatttcagaatgtgtatggaaatgtccagatgcccaggcaaaagtttgctgcaggggtggagccctcatggagaacctctgctagggtagtgcataagagaaatgtggggttggagcccccacacagagtccctactggggctccacctagtggaggtgtgagaagagggccactgccctccagaccccagaatggtagttcaccaacagacagcttgcaccatgcacctggaaaagctgtagacattcaatgccagcctgtgaaagcagccaggagagaggctgtatcctgcaaagccatgggggcagagctgcccaagaccatgggaacccacttcttgcatcagcgtgagctggatgtgagatctggagtcaaaggatatcattttggagctttaaaagttgactcccctgctggattttggacttgcatgggccctgtaatccctttgttttgtccaattcctcccatatggggtagctgtatttaactaatgcttgtacttctattgtatctaggaagtaactagcttgcttttcattttacaggctcataggcggaagggacttgacttgtcttagatgagactttggactgtgaacttttgggttaatgctgagatgagttaagactttgggggactgttgggaaggcatgattggttttgaaatgtgaggataagagatttggagaggccaggggtggaatgatatggtttggctgtttccccacccaaaactcaacttgaattgtatctcacataattcccacatgttgtgggagggacccaaggggaggtaattgaatcatggaggctggtcttttccatgctattctcatgatagtgaataagtctcatgagatctgagaggtttatcaggggtttctgcttttgcttcttcctcatttttctcttgccactgcctcgaaagaagtgccttttacctcctgccatgattctgaggcctccccagccatgtggaactctaagtccaattaaacctctttttcttaccagtcttggctatttctttatcagcagcatgaaaacagactaatataatgtctcagcagaagtaaggcacaggtaaatatattgtcgtgcataaacttctgtttcttggaagacaggggctatcatagcttttaattcctgttcttgtaataccagtcaggaccactctgatgataatatctcaccagaaattctcctatagtaatttcccagcagaatttgccccttaccaaaaaaaaaatgggtagaattttcctattaattggtatttgggtaaatcaggtttaatagcttcctcttcctctctcattagtggccaaagtaatattaataactgacattgagtaggagaaggcaaggccattttgagtggccgcttcctattatgtggagattctggttcacgctattgttgcaaggaaccacgtagtgacgtgtcgcctcccatgcagcctcagcttttgctttcttggatgcactccagaggatgaaattctgatccatgcatgatggctggacagtaggcagaagggggcactcagtgaagctcagatggcctctaaattgctttcagaatcttatctgcagtgtatacaactcattttccagctgcaacattttgtctttttggataaaactaacatggctcctccttaaaaaatgacagcattatggctttggcaaacccatagaggggtcaagttagatccacacaatcagaagggggagaccagtgcaattagttgggaccaggacttaaatatttataaatctggcaggaattagtataggtgttccatacttttgaatgagacttttccgtggacctgctaaatggatccagactctggcaggagagaaatgaacttgttgaaattagctgaatctttgtcatgtcctccaaatggctcattcatccaggatccaatatgaaattgtttgacagacattttcctctcctgaagagacctaactattgtaattcaacatggcaaaaggacacccacaacttgatacactttttagtgtgagagatgggaaaagaaggaacatgggatgtggaaattgatcagatagattttaatccactgtcaatgacccgtgacatgctatctatttctaattgatcatttggtagaaaagagtttcctcgggaagaatcttctctctgtagactattttcttcgtgttagttttctttctgtagctgataaaactcatacgggtggttctttgacctagctccaaaagcacaataaccgatggttcgaatgagagagaggagctgtggaagtggggagagaggagtggggaagtggtttcatttacagaaaacagaagctagagaagggagcaaaggcttatcttgcaaagcccccctcctcccctgaagggcaagctttggggcctgtggcagtgcccaccagcagtggcacagattgtgcccttctccatggtacctgggctgcttgctgaggtaatggctctggggggagccagagtgggtggaagtgcccatgcagcttggggctacagcctggacattgcaggagaatgtggtggaatttaggcatgactttggtttgcagaaatgcttttgtttttccgacagattgcatcccacaagtaaacaacatgtacagacacatgattcattttaacatgaaatctgcacagatgaagtgcaaggcataaaccatattgaatcgtctgtcttgttttaagagtctttatctgaaaggatgccttatttgcatatgaaaaatatgttcctttttgcagtggtctcttctccctcattcttctttgaaggaacagctttagtttgctactgacaatcataaggtttactttgttgaagagtagaaagagaccttaggaaaactgcacatacttgcttcatattttaagttttatattaaagttgagacatctgtttttcttgtcccaggtggaccttgaaataaaagcagaagcttatgatacagaagagagtacatgagttttctattgctctaataacaaatttccacaaatttagcagtttaaaacaacacatatttgttatttcagtttctgtaggtcagaagttcagcatggcagcacttgcttctttggttaggtactcaccagactcaatcaaggtatcccatgtagttcccatctggggttcagtgtcctcttccaagttcaccagttgttggcagaatttagctcctggacctgtttcttgtaggactctattcccttgacatatgacacctgtcatcatcaagttaacagtgatgcatttactccttctcaccctggttgtctctctgatgttcctctctgtcacatctctctgacttcttctgtcctttgattttaaagactcacgtgatcacattgggttcacccaaataatctacagtaatatctattttcaggtcactaataaccttaattatatacacaaagtcccttttgccatgtaaagtgacgtagtcatagatatggcaccagggggccaaaattctgcctgccacagagagggattacagcaggaagcacagtataggcagctgtgtgggtgcagtacacatgggaaggtaaaaggacatatgattaagtgttttagaaaggacagtagagataaggagacttgatgggagtcatgataagggttcacacctgccaagatctattgttcatgctggcaagaaagggctccattaccagtagagtacagtggctaagtgtggatggcaggatcaggcagcctgcattcaagtcttggctttgccagttattaaatttattaactcaatcaaattatttaattatattaagcttaaattttcccatgtgtataacaaagataataataaagcttagcttatagggatgccatgcagattaagtgagctagggcatagtctggcatacagtgagtggtcaatacattttgtaatttttattattacctccttttcttcctgaattaaaaaaaatggtccagagtaattacattaagctgagaatggcatgaatttaatttctggcctctctcttctaccagctacctgggtgatctttctttgtctcacaattttgtcacttttaaaatgaagattatgttaattatgctaatcattccaaaagtaagttggtgattttagagcactttgaagtaatcactagttatttttgaaatgtgtatgataatttaggggaaaacaatcctgatttcttttagctcattctgtatcagagtcaccctacaactaatggtagaggcccaggacacttaccacgggatgtagagaaaaaccaatcatcatgaagagcctgttggaagtggacttaccctatggatgggcagggtagctggttggctaaggggtatgagttgtgagatgtcagaaagacaaactgccctcaaatatgtgtgctattaacctgtagcaaatgcctcaaatattaattttagagatcttatcttttccaatattgagacctaaaaagcaacgtgttagaatacaaagaacatttcgctcacaaaaatctagattggttctaggactaattagccacatatcatacatcctttgtgagtcccatttgtgaatgaaggaggttagtctagaatgatgtttgaagtcttctccttcttctagattctgtgaactagacatctaagacctttgatcttggagtataaaaatcagacagccattctggtgagcagcagttgctccagaaggtcgtctctgaggagatgagcaagaaagacggttgttgtagggtttctgcaagtgtcagtgaaaacttgcctggaggggcatgagggaggaggtgagtcaacagaggagatgttctcaggggtgaggtgagagcagagggtgccatgcaggcccttgcccaattgtcagccctgctgaggagctctgactacaggcatcatctattcagacatctggtttgtactataaagttactagcctgtttcctgggctgattgaactctgttggcaaaagctttgtctataaatgaagttaataccaatttatttgtctgaagggagggggttaaattatacatgtttttgaggttcagttagcaatgaggtatatttattctgggatgtacattatctcttttgcttcaaaagaggacagaatgtaacctaaggttttatatgttgtagtttaaggagaactagaatggggatcagaaaacattattttcatctttgctctggcactgaacagagacacaaacaggggcattctgaaacccatcaagattctgttccttcttggcaagtggagataataatatctgccctgccagcctattaagccatgtaaagtgctctgcacagtgtttcacttagtaaatcctccataactatgagctattatttttccagccctggcacactacctgaaaaatttgaaacagtccataaatagctatagagtgaatgaacaaaaaaagggtatagtgaagttcaaagtaacttagtgtgatgtactacataataatgtcatactctatttgttgaatgaagcaacagtttttacatgtacagaaacattgtagaaaaattctttaaacatctcttcccaagtgaggtggatggcataatgtgtcacctaatatcagcgatctcttctgtgagcaccctatgtaactagaactcccttcagttactgtactctctattctctatcttgccttattttccatctcagcacttacttactaacacctgatgagcatttttttgcttgtttattgtctgacttcccccactggaatgtgacatctataaaggtaggttctttgcttgcttttgtaaattcttgttgctgtaaactacattggtagaacaatacatggcacatagtaggcacataagaaagatgatgagttaatatattttggggatgcctccattgtgacaatgacttctcttaaataatcaagctgttttcactctatccaccattacttgcagcctacaatatgttccatctggtgttaaagcagtagcagtatttttctgtgtctcatagtaggtatctcacatatggttggatcttattaccaggacctggaaactatttgtatctgatccttcgtctccttagggatggtcaggataactacttcccaaatggaggtaccctcaatcccaacagctacagtggtgtctaagttagggacaacaccagtaattctgctctgtgctccataaaaaattaacagccataaaagtcaaatcagcttcctctctagcaaatgaactttacaacccgctttagcttacagactcttagtaaccaatatgtaaaaaataccaaccagggaaagatattttcctgctttataggctttaaaaaaaccatttaattcaatctggcacccaggctgaatgtaaaatagctgcaaagcagtattgatggaacaacacaggatataattaaatctatgtatcaattcatccagtgtaagataaaaatcaatcccgctcaaacagacaccttcaggcaggaaagaaggaaagcatttgctgcagcctgcccctatgttgtaccctgttggtttcttattggagcaatactctcacctgctctgaaattatcctttcatattttttttgggggggggggagggggctgctttttacagggctctgaataaaatatgagtttttgagcttccactgcggttttgaagttactcctttctggaaaaaagtgacagaaagcgactttcctatgtagaccactcaggagcaaaaatccatgatctgaggtctgagaccttcctggggaacttgttaaatgtgcagactcttgggctccatcacagagattctgattatgctggtggtggtcctcagaccgtagcgtcatttgcgccctgggtgagaatccggaccctatcactcaaacattctatggccttgggcaagataattacatatttttatacctccgttttctcatttgtaattcaagcttatgcatggtaatgtgctctgggtacattctcatttaatcctactttctaggttagtgtgggggtaaatgaggcaatgtatgttaaacatttagcttagagcctgataaatagtgtactattgccactgccagcagccaggattactgagtgcttgctgtctgaggggcactgttctgagtgctttacatgtattccctctttttaaatcttaggttggtactgctattatacttattttatagttgagaaaacaggcacagagaaattaagtgacctgttttaggtcacacagcattgaggtgatagagcaaagacgagaatccaagtttgtatgacttcaaacaccacatattttacccactatcattatgtattttcagctatagatcacctatctttttttcttctagctttacatctggttgtcatcagcccaatactgaagttgtcttcctggttaatctgttgttcttttataggttctggcactagtatactttattagtgaaaggactcttaacctatgcttttagcatatattctaaaattagaatccatatcataaaatgtaagaagtgcaaataatctgatattctgtctccctcccctataaagatcaacattaggtgacatataggaaaacttagcatttttaaaaaaattcaggttagtgttcatcctcaaggggaatcatgaagaaaatgtttaaaaaccaattgaaaatttagtattgtttatggttatttatggctagcggtattataggcaactcgcctatctctttacattttctgctttttccaaattttgtactacaaagaactgatactattaatacttttataatcagaaagaaattctttctgtaaataaaaagcaaattaattacaaataggacccagtggcattggtcccacgtttcttcagcctgctgttcactcctaagcatgcatcctggtcatctccataggacacccagagaagagctgatcaatattttggtgtcaaggggaggaagaaggagctggtgagagggaatattttgaaattctttctgtgagctctgttagaagtatgcctcagttcactgacgttgaaaattaacctagggtgatcagaggactaagccccagaataaacaaacaagcaagataattcatttttaattttgaccaaatgttaacaacatattgtgcttccatgatgccaaaacttattagtttaatgaaaaacaacatcagttaagtcattggaaacacacaaaaatcaatatgggtgttattctatagatcaagctatcactttatagatgggatttctctaccattcatgtatttgtttatcacttgacatagttagaggtcgctctgagcagatgctggtgcctcaaagacaacagttatgaaaaaatgaagtcggagaaggaaatgtgatgaaaaagtctctagtacccttcagagccataaaggaaccactggaaacattccattttctaataaagtgattactaaattttaaaaaatagcacagtggaatctatttactactaggttgaaaacgtttgggtataaagaaattgtagactgtgtaaaaacatcttccacaccaataataatctcccagccacgctgatgcattaagctactttataataagagttgctgggtagctaaagggataggaggctctggaatgaaggtatttcatatctcatataaaagcatagtatgtaaaatagggagagatgttattgtaagttcctaagaatttggagaagaaaagccttttatttatctgtgtaagctaaaaaagaaatatcaaacaataacagtatcttacatttataaattatcgtactctcaaatatttgacatgatttcaggtctcttttatcactctattcctgctaacagcgctgtgtcaggtaggcattatcacccctgattgatgaggaaatgaaggcattgttaagtcatttgctcaaagttactggtagggcaaaaactacaacgcaggttatgtacctactaaattggagtttatttatacactgcatttttttgtctgtcttgagcatttgtcatcatggcacaaatgtatctgaatgaaacatgaaagaaaataagcaaatagacaaaaagaaaaaacccagtacctaatttgctttgtttacatatcatttaatatttagacatgcccaaatcaatgaaagtaaagtgcagtgttccaaaaaatgtctaggtgattgactactatctttccttgtatccagatgctatagcatcatttagacccagataaagttaaaatatagacagacagacatgaacaccaaaaatctgaatcaaattatgcatttggtagtagtcctatctttgactcaggtttgaatatagctagatgcctgtcacgtttaggtttgtaccaacaaaaaaaaggaaacaatcagtggaaataatggggacaaatttagagatacataatagaatcttatgcttcatttgggattttttgaaaagatttgttaaaagaatgttccaatttaagcccttgatgatgtacttctgaataaccttggctattaacaaaaatataccctgaaattagatgacctggattcctatcacgtgagactgataatggatatgtgctgacactgtcttggtgactgggattaattgggatatggaatatagcactggaaaaaaaaatccagacaaaccaaacacaagaacaaaccaagaccctgctgtcatggtggtcagagtctagtaagggaagaaagatagaaaataaaaaatcctaactatatgccattccaaggggctaggatgaaaaataaagcaaggtaagaagaaagagatagagagtgactggggtgttcttttagataagggatcaggcaaagcagtttgtggacaaggtaaaattttaataataaatttaattcaatttacaattttgaaaaagctggatttttcaaaggtggttgatgtgaaaatattaaggcaatacgtggtggcagaaccatgccatgtttaccttttgttcacctgctgtttcctttgccagaagcatctcctttgttcccatatcccacccaggtatctcctttgcctaggtgattgtggtaactcctgtttatttttcaggtctcaacttgtgtgatcctttgctcagatgggcattctcttcaattccccctaaacaccttgtacttctacttttgtaataggaatcacatttgtaattgtgtgtttattatcggtcttcccacttgattgagttataagagtgctaagatcatgttgctctgttaacctttgcattttctttcttctatccttgtggagcttgcagataagaaaatatgagtttatctcctagttggggaattgaactcactcacatgtatcaacgcatataataatagaatgtttgaagctcaatgctgatcacatattgaggggagtaaacatgggtgtcagtaagttagattttggagtgataagaacatggctttagaacatttctgtttttttgtgattgcattgtgtagctagcaatgtcctgttgttgtttgctgttcttaagaaaggtaccatgtaacaaactctggtaactgaagtcacgaatggctctttttgctagtagtttgcctagttaactggtagctgacaagctagttgtatttttgggggttctttggggaaagtgcttaataagctcagctataaactacagaaaggaggctattgtgaccattggtagacttaaaaaaaggaagtgacgtcattggttcacttgctcttagagacattctggttgctaggtagaaaatgtattgtaaggggcccagagaagaagaagagagactgtttagaaatctatattaatatcccagacaagagaatatggtggcttagagttgtggaaatggaggagagaagcattcatatttaggttgtgtcttggaaatcggatcaagaggatttgttttatggatacagggtgagaaggaaataaagatgtctgctgatttctggtatgagtatccagataaatggtggtgccattcactgagatggcaagccttgatggtggccaattgatagtgagagttttattatgaatagttttaagtttgagatgccaaattacacatacagctctatgttctgggctaagactacaaattactgcatttattatgatgtttggaaataatttttaaaccttttctctctgaattgtgaactccttctcagcatagcatgcttttgtattccctcttgtactccttatttctggagtctctcaattacctggacggatgaacggatggatgatgacagggacttctacactgcttactctttatttctctgtatttcctctccctctccccctattcactttatgtgccacctccctgctttctgaagtttaacagaagcactgtattaatttgttcttttgttgctaatacaggcatacttgagactgggtaattcataaaggaaagaggtttaattgacaatttggcatggctgggaggcatcaggaaacttacgatcgtagcagaaggggaagcaaacatgtccttcacatggtgacagcaaggagaagtgctgagcaaagggggaaaagcctcttataaaaccctcagatctcatgaaaactcattcactatcatcagaacagcatggaggtaaccacccccatgattcagttacctcccaccaggtccttcccatgacacatggggattatgggaactacagttcaagatgagatttgagtggggacacagcaaaaccatatcaagcactaaactgggaattatcacatttgtgtactagctgtgtgacactgggagctctaattaatatttttctgggcctcagcttcttcatctgaaagatgaggcagttggacatgatctctaaatttcctttcagcttgaaaattctgtaattggtatttttttctctgagatgttcaaatcaaatatgtacttttagaccttactttttatattttcaaaggcatgcatttttagaaagagacaatttagagataatcagttcaactcactcgtgtgaaaggcgaggggaatggagccctatgatatgctcctccatttataaagtaaggctaccaatgatagtaacaatagcaatagttacagcaatgatgattgcttctcatcctttggctaagatcaagtgtaataatagtaatgataaaaagaacacctatatcaaaatattcttgtggaactaaaattagataaaacatataaaagtgtctagctaggagtaaatgttcaataaatattgattctcacagtggtttttaatattaaatgtcatgtgacttgcccccaaatatctggctggtgactggcaaagctgggactgaaccatttccttaaggcatacaagccattcatttttcttctaggccccttcttgtcttttcctccaacaatcagagctaaaccatccttcttcatacaatatggagataatacagtgaaatagttatgaacataccttaggggtaggataaaacctgggtttcaaactaaattctgatattctctttctgggacactgggtaagttactgaatgtttctgaatctcagtctcttcatctgtaaaatgaggataaagataatgggtaccaacctcaaagagatgtagtaaggataaaagacattatgtcaagtacttggaacaggtcatggcatgaataaggtcaataaatagtatctatcttaattatcaacttttcccccacgtgctaagtggcagaagttctccacattgtctcctcattgcctagacagaagttattacacgtactcttgaaagaagacttggacattaccactcatggcagaaaaatatatcaattcaaatgttgactggagaaatattgtcagaatcattcagtttggatgttagaaggtgacggtaaagctgaagtcccagacagcaagctgtatggatttgagcagaaggatggagaggcatttaagagggtgggcaggaaagagatgaaattagcagactatccaatgtgttttgaatgtttgaaaaatattactagtggttggtagatgtgtggaaatattttaaaaattcagtgataattcatgtaaatctgagtaaatgaggctagtaaaagaaatgtcatcattggacatcatttggctcaacagcgaacaatattacacagacaaagttatgcaaacactgactacctatgtaaccataaattgcaacttcactctcctgggaagatgggtaggtggaaggggaggagttgatggtggtgctgaagaaaagcaccactatcagctaaattctcatctaaattgacaagaagctaagggataatatctaagcttgataaataaaaaatataagatttatatttagaaacttgcagaaaaacagctaaagaagctgcaagtggctatacttggagaataggacatggggagttagaggtttgttggatagaggccactgtcttttcttgtaagcatttatgaactgtttgacttttaaaacaatgatcactctgatagcagaaatagaaaaaagtgataatacatactatcttttcttttcgtaaataagttatatatgagttatcagtaaaatttacatgaaatttttccttttaaaatgcttatcaagactttcacagtggttgcagaactacaaccctcacatattatgtataaggatgtttataaaataccgtattggatgatagaatttttctcacatttatatacagatattgttaatgctggaaataaagcatgtattgattaaattatcaatgcacatgtattaataatattaccagacacatgtccacaaacaaaaattaaggttataatttttaaaataaatagataccataataatgcatgataatgcttattgttttactatacttttcttacattgagtgcaggaattgagtttttctcatctttgataactcttggaacccaacaaggaatatatgagttacaaatattttcattagtgacttttgttaattatatttcttcttatgaatatgtgcaagacagtaaacctttatattttgttttagataatttactttgttaaaaatatgattttgatagtctcatttagtggttttgttgtatactttttggaaaatatgaaattctattacacgctaattttatagcagatttattagcagatcctacaatcttaaaaacaatatagtagtgattcttatttggggaagatcaatgacaatcacagaatcacctgggaaatttcagaaattaagttactacccaccttggatattcgaaataactctcccaataccatgggagagcagggtgatggttcttatcagaatctgaaagaagtaatccacttgaactgggacttctgctgtcggtaaaagtgaagtaattggggccaaatttacactgaaacaaccaagaattaataaaatgtgtgaaacgacaagtttaaagatgttggacatcagacactgaaagatagtgaatccctgagagtagaaaaataaacaaggtgagccccacagtttcccttacttattgccttgagagggtttccaggccactgtgcagggaaggaaaacccaagtgaagcccaggggacaccctaagtgaggagatgaagctgagtgaatggggaggtcaaggcggttaggattcacatacaaaaaaagagtcctcgaaaggagagagctgcttttaaagagaatttccaaggtctgcagagagtacctttcaattcagtggaataataattaccatgtaaatgtgaagaaattaaccagcctacagaaggaaccagctgaaaatgttaggggtaacagtggctaacactcacacagtgccagcaatagtgctggtttcctccagtcagacttgaaaacctcatgattcatgggctgaaaggttcttgtctcagtggtgaagaataactaacccatgactgagcatgctccagaccttcccaacaaatcataaaaccaaagccagaatgaatcaaactatttctaagtaacaactcttccagaacaaagcttaagtatatttattgaaatccaaaaataatgagcacccatcaaggaagatctacaatgtctggcatttaattgaaaactatcaggcatgtaaagaagcaggaaaacacaaccactaatgaggagaaaaatcaaacaatcaaaagttatccagagatgacatgaatgttagattgagtagatatggaagagatggacttcaaggtagtcattacaactctatcccatatgttcaaaaagtttagatatggaagatacaaaaaagacctaaattaaactctggaaaagatgaataaacttgaagacataacaatagagattatccaaaatgaaacacaagagaaaagaggatatgaaagaggacatcagtgagttgtgggataacttcaagcaacctaatatatatataattaaggtcactgaaggaaagggagggaggattggaaagaaagatatttgaagaaatgatgcttaaaattgttccaattttgataaagttataaatccaagaagtccaatgagccctaatcacaaaaaatatgaagaaatcttcaacaaggcacatcataaacaaatttatcaaaaccagtgataaatataaagagggaagggcattaaaactggttgccacatgggtaaataaagaagaatttttggtataatttaaatctcaaaaattgcttaaaccaaaacaatcacaatgtaatatggagttaaaaacatgagtgagaatcaaatacatggcagtaaaagcacaaatgccagaagggggaaaatggaagtatattaatataaggtttttatactatatataaagtggtataatatcacttgaaggtaaactgtgataagttaaagatgtatagagttaactctaaagcagtaactaaaataacaaaactaacaacagagaggataaaatggagtaacaaaaatatttagttaatccaaaataagtgaaaacagaggaaaagagaaagaacagatagaacatttagaaaactaatagcgagataatgatagatttaaacctaaccatatcatgaattaaaataaatgtaaatagcctaaatattttaatgaaaaggcagatattgtcagattatgtgaaaattaagatctattaataactatatgtggcttgggagaaacactttatcaattataagaaaaaaaagaaaaaatatacaatgttaacattaacaaaacaaagctgggttggctatatttaatataaaagtggatctgtgagcaaaaaaatagtactggatataaagaaggtaatttcataataattaatgggtaaattcattaaatggtcatgtaattataagcatttatgtatctaatttcagagcttcaaaatacatgaagcaaaaattgctagaacttttatagcagtgagagagttaagagattccaacaccactttctcagtaattgatagaacaagtaagcaaaaaaaatcgtaaactatatggaatatttgaacaacacaaccaaaaaattgatctaatctgcaggtatagaaaactctatgcaacaagagcagaatatacagtgttttcaaatctacatagtgtgttatccaatgtggatcatattctaggccatgaaacagtctcagtaaattagaaaagtattcaagtcacaaaaactagtttctctgaccacagcaaaaataaattggaaatcagtaaaatagtccatttaataactaaatgaaattacttatacaacaattcaagtgaaagtctcctttgattttagggacaaaaacctatcaactctcacctcaggaggaaaaattattatgttagattatgcaaaaattaccaatataggaataccattttaggtacaagtttacacaggcaaaataatgtgggtactatgagaaagacttattcaacaaatatacatgtactttggataaatggaaggaattaggagactttgagatctggaaggtataatgcatagcgtaattttattttctctttgcattgcaaatacagcctaaaagtcactgaaaacacttttccttcagacaacatttaaattgaatttacatgcatttgagctatccctccttgacccccatgatgattgtccttttgggggtagatattttgaaattggttctaccatgtatgtgtagctaactcacttcattcattatttctgctcaatacatatactgctactataaaactcttcattgaccttcaattgcatctcatccactcccacctatgtatttttgctcatgttgaaactccacattgaatatattaataccttttccttccattttgctttccaaaccttatccatgcaagctcccatcttacctgctatggacttctcctctattattctgatgtgtcacttatgtttcttctctgaactcctacagaatttcatagataattacgactaaagcaatatcacacagactctcttgttaattaattttgtattcagcaggttttaaactatagtatacattataattacttgggggtgattgtaacaatgcagatttggggccaaatcctcaaaaatcccagaccactaaaactgggggctcaggaatttatattttataaaaaatcccaggagattctgatgtgatgatttgcaaatcacactttggaaaaaacaaatttctttaatggattttaataatttgtctagttcacacgtagatgcacagtatctaatccttcttttatatttttatgtcaacaggtagcatgctaagcatataatggatccttaataaatgcttgtccacctattgacgtagtacagttaaacattttgtgtatgtactcttcagttagctttttaaataaatgattgcataccaggtgttttaatttttaattttttttctaagcttatgattttgcttttcatttgaataatggaattttagagctggaagggatctgtagaattaatttagctcggttctctcttattttttctggaggcaattgagggcaaaagaggttaagtgacttaaccgagttcatacagttaattagaaagagagctacatccgcaatccaactctccaggctcccaagcctagtgttcttgctggggcacatgttgcctcttaccaagaaatttgcccggtagttctagttagtcacacaagtgagaagattcaaacatgcatttgtcaataatttgagtgactaaaaactttatgtcactctttagaaatcacagcaactgttgctttagcttgtttgctgtggataacttagattcaatacttctttgttttgggggctttcttgtacattgtagaaattttagcaggatccctgacctctaatccctcactcattgccaggagcaccctcctaccacgattgtgtcaatcagaaaggtctttagacattgaagaatattctctggcaagcaaaatcacctgcagttgaaaacctctacttacagacaaagacatagatcacagattcttgaaagactcataaagaatgtttacatggaaggatgcttggcatttgaaatgatccctacccgaagacatcataggcatatgccataaacaaaagaatagtgaagttaggagtgcagtgcaatgttataatgtagaccgtactgaggcagatgatggtgtcattttgattttacggcttttgtatttgtatgaatttttattatgcttcttaaaaattttacttatcagttctaaagtgcctgtttctttaagtagagcattatgttatggtataaagagtggttttcatcatttacaaaccaacatatatctattctagacatgaagcatttgttttgcagaattttcaaaagtcaagaaaaattatgtagctataccctttagaaaatgtaaatacatatagtgctttgttatatgcaatgtcttatcttcttttatttactcttttctttgattgcagaagcttagggaagctatttgaccacttagtctagcgtgaccttaacagaatagtttcttaatggatatctactcatctttgctgcagtactgaaggaaacaacttctttctactttcacagaagaggatataaactgaggtttaacagatgagcaacatgttatcaagcagctaccagggaaatgtctcttcagtgctatcaagggtccaaaataaaggaagaggaatattattcagggaaagttttatcccaaagagtagcttgtgaaattgaggcagcatggagggagtagaagattgagtttcagttcaggctttgtcactaggacaatttctactcttgggatcatttttattcatcaattaatgacagtgttgggccagttgatcttgtacatgcctgtgctgcatatctacagtagaaattgtaattatttatgttgctcaaaataaaatatttttaagcaaaaagatgaaaaatagtattagaaaaatgcctcaactgataacataaacaacataaacctaatcaggaaatactgtcctcttgtagagttaaatatgagattttacttcgagggcatatgtacatatatacctcaatacacaatggttctaattaaaataaaacaaaatactaatctgcaaataactttctttttctatgtttgaaacaaaatactgtatttgctcttagcaactctctgctcagttaggtcaattagtggtttaatatttaaaggaaatactcagctttataatattgatgattttcataattaaagaaattataaatatcaactgcttagactccagtgagcttattaacatgcagtagagaatacaaatgttcataactgataccatttttcttaatccatggcaactaagcactgtcagcccttaatacaattacatcaagctctcatacaagttagcttatggccaaatggtctgacacaggcagtcaatatctgggcttaattatgttgataaacaacaaaagtcacttttttgtgtgtaggctaaatgctcacagtgggtagagagaccagctgttgtacttttgatttcaccgtaaagattgtagcaaaaggtcagaactcttttgatgccagctaattaaaatatcaataattatgcaacttataaatttgctcttagtgtgtaaagctgaaacctctttttcatatattttgtggctaggtactttagggtaattattttgatgtgttaagtgtcaaggagattgacatgttaaagaatactcaggcaatcattcctggagttgggttttcttccttcacaaaattgagtacatgaaagtatggtcctcccattcatgacaaagggaaactgagttcgggagagaaagtcacaaatatggaggaaagtatgttccatcagatcattactgaaacgagatggggatattctttactagtggtttttgggcctattattatatgcctgtgagtattccagcgtaattaattgtgttagcttccttaaaaatttgtccctttagatcacactgcaatctatggactctgtcttagagtcactgagtgttcttattaaaatgcatattccctggcctcatggtcagatgttctgtttcagtaggtctggagtagagcttgtgaatatacttcataaatatttgttctgatactcattaaaagttctcaaaccactaacttaggttgcaggaacctaaacactgttaggacaaatattttgcctatttgcttgcttatctttctgctcattcatctcccagtgacccctcttccctgctccatcccctaccataagcttgtctaggtttcagtgaactgtcaattagtatctgctaattggtgcttaacgtattgatgctcatggtggtatttttgtttcaacaacaatagtaataacagcaacaaccacaagaacagtaatatctggtttacatatttgaaaccttgtatctctttgaccctcaaatacttctggtgccacaagttgtagggaattttcatactgtgagatgatactggccttggactttcatgtaatcacttgaaatgggtcagcaaattgggaagtaggagtactcttgaacatcctcctaaactgagatggttagcaataactgaagtctatatggaagtaactgtaaaccatataaatatttcccattaaggtccaactaaatgtaacgattcacaacccaatgcccccttaggtgaatgccaaaaattcctgcacacaatcgctgccacagcacacaaggttattggaagtgtgagggagggggaaattggaggagagaaagatagtggccttaacgtcattgaagtatcttcttttgcaaattttagaaaaacatatagattacgagaatatgtgttgtccttctcttaaagggttccagataagtaaggggccctgaagcttaagcttcactcacttctcagtaagacagttttgcctgtacaccttgctcagtaatagaaacagcacaagatgtatatatgataaataaatgaaagactagaaaacgtgtaattcttttttaaaaattattttagattcaggtggtacaggtggtacaggtacaggtttgtttcatgggtatattgcataccgaaggggattagtcttctagtgtacccattgcccaaatagtgaatattgtatctgttgcccctaggtagtttttaaacccttttccccctgccccactctcctgccttttggagtctccattgtctactatttccatcttatgtccaagtatactcattgtttagtccccacttctaagagggaatatgtggtatttgattttatgtttctgagtgagttcacttagcataatgacctccacctccatccatgttgctacaagggacataattcttttttcatggctgcatagtacttaatggtatatatatgaatttatccagtaaactgttgatgaaaacttaggttggttccatgactttgctatcgcgaatagtgcttcaatgaacatacaagtgctggtgtttttttgatatgatttattttcctttgggtagatacctactagtgggattgctgggtcaaataatagttctatttttagttctttaagaaatctccatactgttttacatagaaattcaactaatttacattcccaccaacagtgtataaacattcccaaaaggtataattcttatcctcccaccttttcagatgaagtgttgaagttgacctgtttgaaatcacttaacttattacaatgggacaagtattaaaaaggatacttcctgttcatggagtttaccatgctcctcaatgagcactactcctagtgtagctcactgtcacttggtttccatgttggacatcgccctggtttcagagaccaatctgcatggcgacatttttttctttaagaaaatttctatctgcatggacccattctttgttaaaaggaatccagaagaatgtgacagccactattaggttatttcttccagatatcaaaactctttgacttagttaacttgtgagttcttaataagcctataaagtagctgtataaatgctgggtaatagagagagatagagggatattcagacttttgggtagtttctctgcgagactgcctaatgtgccactgacgctgtctctgacatgagaaggacttaaatgccagtttactaaagttagtattatacaggggttgatagcctgatttatggagttggcattcctgagttcttaacacagctttgctgcttactatgggacctgtgctcattcacttagtcctatttcgctatcacatattcactatctgttaagcataactgttttgaggattgaatgaattaatatgattagtaagtagtcaataaatactggcacttactgttgctgtgcttggttttgtctttgacactaactagcttcttgacatcagcatcagttttctcatcagtaaaaggagtagttaaatggtagttaagattcataaaattctatgttgaggaatattggattatacatattacactcagaaaaaattattttgaagtaaaagctgttgtagaactcctttgtttaataattgaaagataaagtcccactaattatccagcatcttaaaagataaattaaaaaatccagtaagttggtttctttctttctcttcggaaacaagtttactgaagagccagtcttgttgcctaatgaaccaagaacccagaccctggatttcattactgttatgattccagatcccactagagtctcttatcaaatgtggcctcattaagtgcaacaggtaatgcaattctccattaaattatgctgagttaactcgtgactgacatgagccaaaatgaaatgtaattattttaaatcgttcctattggactgtatttgcacatcacagacagatattaacacatgcaccactacttgtgaatcctcatttatccaggctttattctgagtaagtatactgaatgccaagtctttttaatgaagcttctgtcaataataaaagcgaaatataaaacaactcctgtgttatcctgttttgagtaagttgtttctaagattaattcagtagattgttttcttccccctctatggaagagagaattacttataaacagacccagcccccaatattaatctctgctttttggaattttgtaaagatatttataactttgaaaaaagagagagtacactgccttataataattgctaagattttacaccagaaatgcttataaatgccatatatgtgtaactaattagctaattaacttacttaatctgtttttacagaggaggaaataaatgtacacagagattacacatttacccatttatacattttagctagtggaagagctggattcacaccctggaagcccagtttcagtgcgtgtttgtaaccactaaactaccattgtttctcaaattccctctaaattatactggtttccttaggcagagagacacactaagcactgaacagtgaggattgaacccacagaatgcaagtttgtatctggtgatatatatgtcttattttgtttctcagttagaaagaatacaatatatcaaatgcaacccaatttttaaataggagaaaccaccaataggtagttataaaacttgcctgcggtgatctggagactttagtgaaaagcaggaatagtacaagcttgtgactctcactctgtccttggctaaagccactagagaatgtgtctgcctagtgacagccatcagtggctgtaggggatagagatgacttggacacaattagtgattccagagggaagtgacagaacatgaaacgcctgggggcaaaaggggggtgttgctgggatccagcttatggtaataacttcaccaacaacctcaactcaaaacaaaatggataatatattttaaagggcattccaaaaggatcttactattcaacccttgggttccactgttatagagtgagcctgcactttcattcctgaagtctttttttcagaggcaaagacacatgggcaatcctataaagtcttcccatgacttattggaagcatagtgcttctgtttttcattgacttttaaaaatagtattactttatatcagaaataataactcttgaatagacatattatatgcaaaataacccataataccaactcagagaggaaatgggaattattttagtcccaccattcagaaactatcagttaacatttttctatatttacagctatagttatatctataacaacttttgaaccacatgcatctgcaattttggatcttgtatttcacttaaggtgaatagttctccaggttgttacatatttttaaattttaaatttgaaataccatttaatgggtggataataaccaactgcacattgtaccataatttattctacatgctcctgttgagcaattagattgtatacagatgttttcaattttgaacaacacatatttttatacttgagtcctggaattttaaaaattatttttaggatagtctttcttaggataggcatttgtcttcaaagaatgtacagttttaaataaaacttctaatatgtattagaaaattgtcttactgaaatatcttagttttttaaaaattctatcagctgtgcaaaaggatgtctgtctcatgagatcctcaaaaaattaaagattatcattaaaaatatttggttaatttagtaggtcaactattataccctattcaatttctatttttaaactatttgtcatctgtgtttcctcttttacaaatgaattgtctactcatatcctttgtctaagatctaatacattaaagaagtgtttgctactgtatgttgtgatcaaaatgatgaattctgagcaaacttggttaaagcaaaacatgctaaattccaacttcacaaggagtttaaaagttttcctttactaaataaaattcagccagacttttaaaaatgagatatgtggaaagatttaggtgaaacaaataccatatttataatatcttataaaatggtgatgaattatatataacgcagaattatcctttacgattttggaacaaggtaaaatactgtgtttaaataaaataagaattatcctttacagttatcttttacaattttgaggaaattatcctttacaattttggaagaagggaaatgcattcttttttaaacagaaaaacattcttttaaaataagatttaggaatatgtttcattcctaagtcttatttactactgtaactgctcattgtttctgaattcctacagtgcattataacgactttgaagagcaaacaaatgagcaagaaaacagtgttgtacaaatattgtcaaatattttttctccatgtccaaccattttaggttaaacagtctaatagctttcttcaccttgttcaccaagtcagcttccaatttgttcaagtagatctatagctttaaagatgtgcatattttttgaacgttttttcccttaaatcctctgatgtctcttttttcttaaacaaaagacacagtttgcttagctgcaaaatttgtctgtacttttcagaaattaatgtgaatcttcccaagtctaagaacaataattctattttggcttaactccaattgtctgcagaaaaaaaaccaaaaaaaaaaaaaaaaaaaaaaaaaaaaccaccaaaaccacacaaaccgttaaggagagtaatgtaatttgtagaaatctgcaggaggccttggtccttggtccaggagtactactgctgacaattacacaaataatgttcctatgcaattatcccagcaataaccgatagcaagcaaaaattatagaggcctgatgggatttatactcagaggtttctatgtagcactttgtttgaatgaaaatggctgtcttaatttttttttcttttctttaaagaaaataatcagtcagcttcttaggagaacataattttcttccatctaggtttaaatggcattagcacagcaatcagatgtcaaggtgaaagaaacatgtctgccccgggtacataaatggcaaaaataccaggtaatatgggtaccatttccctggcttttgcattttaaattgcattaaccttgtgctgtgtagagttatgatttcttgaactgttttcactctaaaatgggcaatcagttctacaatttaaaaatgtgctatgtgctgtcaagtttttctcttggatgcgaaggcacagaaaaatactcagtttgttttggttttcatgtttgcatgattactgcactgtatttatttccacaattccttcaatgtcaccattcgactacccttaattaaaatctgcttgtatttgctctttgcctaggagattacatctcaggacattatgtaatacatttcaagcaaatcagattggaagaaattattttttccttttttaaaagatgcaggtattaatggtcacgtatgaagtgtattgaaaagtagtaaagatctatcgtttaggaagtcagacagccatttttacaaaaactaaatacaaccacaaaatctaagaaggaagaaagagagcacatatgtaccaaattcccttccagtgatcccttttataaaacttgactagaggcaaagagagaatgaaaagcagtttttagtgaagctgtctttggaaattgtgcagattctctttggctgaaaaagaaaaaaagcagagctggacaaacaaatttatttctctatccttaatggattaaatggaaaatgaattccagtgggcaaaccagttttgtcttcattggggtttaaaaatttatattccaaaggaaatttggtagcttttaatgaaagttccaatttttttttctgaggaaggtggtgggcatttttttttttttttgcttattatgtgtattagaaaacatgaaacaatctaataattttctatatttaaaatgatggagcagaaattggctggtacataatcattagtaaataaatgcttgttggattaaatattacttgacatagtcttgacttgaagcctaggccagttttatgactgactgactaatgaggaagatacccaggttttagccttaattcagaatgggtcttaaaggaatggagggactgtccagcaaactttctcagggtaatagtttagaatatatgtggcagtaaatctctagtttcatctatccacccaatactgtcttttccttacatcttccagctaacttatctccacagatttaatgcatcaccaagtcccatcaggctaagatgttcaaacacccttggtttgaaaaaatcatcttgagccatgatcagtgtagtcatttgttctgttggataaaaataaaacaaactacaggtttccccaagttgagatctattactaattccaaatcatcacataattctctaatgagtgttgagatttcctgtggcattggaaaaatttttcaattatatttatttccaagaacatttcttaggaaaataatcctttgatttaactgtggaatttagtattgaatctctagaaagctgaaatggttatgtcagtggctgaagtgtggttttaatctactgtgctgtaagaggtacacaaactgattacaggtggagttatgcttgttaagagctaagtaagatcttggtctcaacaagatgtgggactcagggagcttataacatgatggaagaaaaaagcaaaaaaaataagactatgccaatgttagatactatcattgcttaggtgttaaccttcaggcatttaggatgacaccgaagttgtctaaaatacaataatagccaggggcaatccttcagtctaatgagacagatgtgatccaaacctggggatgatgcacttgtcagaggaggagcaataccgaccatatggtgggagattgactcacatccatcagaatgagccggtcggtgctcttaggatttgaaactgagaatgttgtgcttatggggatgtacatgtttttgggtgtatgtgagtgggtaaatgagctgcagtcctctgtaccctgaattgtggtccataaagacatttataataggctcttagtacattaatatgtgttatctatgttccacatacttccacatcctttcttaggttcacatttcaggaaaagcaaaagagtatttgggtagaaaagaggctctagagatacctgtcttaaaacctgtgttaaaaaacagaacatggctgatctatttcctgaattctttggccttttaagtataaagtccttctgttctttaggaaggctctttgcttgaaataatacagcccgttcaccagaacagttacgtttgtaacagtatgtgaaacaagactttaaggatttaaaaaatgaaagaaacaatcaagaccttaacttttctaattccagtttaaattttttcttgatcctattagaattttaggagggatatcaaattgatggaaattgccatgacgtcttgaatcacaggggtgttaaatcccttttggatcaagacacacatagatgtcatcttctgccagagcttgatagtagggaagggcagtccttggaaggcagtgtggtttggcttcgtttctgaaaaagtgtaggtcctcaataaaaggcattgaatgaaaggactgaatgcaacccagatatgctggtgtcaagagcctgtggttctaatggtcaggagtgaatacagttcactggttggggaaaactaacacgcaactgatagactgaagtccagtgggagttattttctgctcagcactccattggaggctgcatttgtgaatcaactaagagcagcttttattgatatggtcactttgcttttagttcccattttgaagtgtgtctctttgatggatgtgtaaggaatctgcttagacacctctgacagaagacaccaggcagaagatacgagtagattttgaacaatcctgattccacaaaagagatgacacagactgctgagtaaaacacagcaagccagtttgtaaagagaccaagcattacatgacagaagcacctaagtcacttttcaggttgcttgtctttgagggctggagaggaggcttctttctgaaaggagaaaagaaaaactttcccaaggccaaagcacaccaggttgtaaaagcttggagtagagctttgctgacctcttgtccaatctccccaacctcatttctttgttcgtcttggcaaggaccctctgctagaatttaggcagtttccttcacagatcttggctataacttgttcattaccagttttgaacctttgcgtttgttatttctcacttactgaatgtattctctgcctgattcctgtgtgtctactttatattttttatcttaaaaaatctggcttacatctaactcttggggaagcatttcatatctaagcttctcctgtctatgtcctatgtccccactgggctttctatctgtacttggaacaaatggatctagtttagacagtataatttgcactggggttaaatatttgttaactatagatagtcattctctctaactataatataggctcttgaggggaggaacatatttttactcatgcagttgtattcgtccttcttccctccatccaggataggccagtgattggcaaacagcaggcacttagcccatgttatggctattgatccaaaaataagtatctttataatgggccccaactcagagaaggtgagcatcaggaaaatggaaaagagtgattacatagagtgtgtgttctgggtgtctactgctgcctaacaaactatccccaaatttggtgacttgacacaacagtcatctgccatttagcagggtttggaagtaattgctcaactctgctgtgtgtgatgttagctggattttctctctactgagtctggagcatctacctccaagattgctcactcacctggctgtcaagttggttccggttgtctactgggagttcagctgcaagtgttggctgggggctttgatttctcttcatgtgggcccctccaccaggttacttgtgctttcttacagagtgatcaatgagttccgagaatgctccagcaggcagaaagtaaaaactaactggccagttaagaactatgtatgtctagaactgacacaacattacatcatcagaaacaaaccctacctctttttgggggagtaacatgatagtattgcagaaaaccacacttgttttaaacataggtatttggaaaatacagactgctatatattgtgttactgataaaactactacacaaagtcacattacataaagcatggaaaccccttggtagtgaactcttttcaaaccaaagatgatagttaacatttatttaatgcttactctgtgtcaggcatgggctaaagggcttatacatgatttctcatttgattctcacaacttatgggtcagacatttattcctgtccccattccagatgaagaaacagatacgatgaggtaatgtaccttgctcaaggtcataaccattaagaggcaaaggcaggatatgaattgaagtcgtctaaattcataacacatacgcttaactctcctgtttcctagtcgatgactacatagaatgagacattgtaatgtagcacagagatatgagaaataccagtggtcacttgtccagaggtttagaacctgtgtttgggtccatacatgtgcttatgggacagttgaaacctctgtgattgtgttacagcattgttcatgtgggtacatcccgggcttttgttagtcttaaaagggcatgcattgtaaatgcttaagtgttaaaacaacaacaacaacaacaacaacaacaatgtgattagacccctcttcctaaggcaggctcaatctcaaatatctcataacaatgtcaatcaacaccttcctttaaaacattcagaaggaggcttccatggtatactggggtcatgcttgctttgggtcctgtgacagacttggtcaaaaccctagctactcctttgcaatccttttaatcttgggtaaattattgacccctccactcagggtctggtttcttggtttgtagactagagctaatgtcaaccgcctttaagggttttgatgacagaataatttactgtgtgtaatgtacccagcagtaatggggttttacccattgttatttcctttaatggtattttgagtattgtacagaactggtgcagtaaaaacatttccttctcaagtagctgctaccttctaaaggcaggacaaacctccagtgaaattcatctctcacatcactcatatacagcgacataaactgctcagctcacttttcaggattcagtagaatgctggacccatattttcctccttgtgctaaaacattctgcagatttagtaccatgtaaaggcatacagaaaatcaatccaggcaattgcttctttactttctgatcagttcctcccagtttatccccagctttgaatgtacttcatctcttctatgtagaccattatcctctctgcccgcacagtcctatcataaaaaaaaggttcaaagcacttcacacacataaaaaggcttgttattaaaatttctcttctgtcctccctaatttgatattttctgaataaaatcagagagagatttctatgaaatttatgtatgagaaacattttgattttaaattcttacaattaggttttatatgggtttctttattatctatcagctttcaagagtcaaaattgtatctgtttatttggttatttttttcggtgacacattttatctattttattttattttttggcaaacattaacaagtctttttgggaggtgggaactcctgtgcataatggaagcgagttgtaattcttccagagtgtttttctcaggtgccactggacatcctgttagacttgaagagttagagcagctggagcttgggagagaatattagtaaatggttaacagtaaaatcggcttttaattttatctttttaatgtctaggagacattggagccaataaagcttagttactacataaaatgatatctattaacaatgcttccagtgtggtctctttctttgttcttagagccttttcttacaagtaggtttagttctttaaacctttgaatgtggctccatactgagctagattcttatatctcataggctcaagtcacctatgagcccaaccttttccttttatatgattgttactgatatttaataagtttcatttctccttgttatttttaaattaagtttcatcagcctacagcagatttcgaggtattttctagttagaatcgattgtttaaactgcccacctttcttgcttgcttttcattttgtttcatagatgactgccgtcttttgtgttgattatcttgctatagtttgtttgtttgttttgatctgtttttggaagtatagtgaactgcaggaaaaaattaaaaacaatagaatattgattacatcctaatattgggatctttttattttattttattttgagacagagtcttgctctgttgcccaggctggagtgtggtggcatgatcatagcttactataaccttcaactcctgggctaaagtgacttccacctcagcctgctgagtagctgggactataggtaccatgcatggctgatttttaaaaattttttagagacaaggtcccattatgttgcccaggctggtcttgaacttctggtctcaagtgattctcctacctcagccttccaaagtgttaagattataggcatgagccgccacgccctggtggaatctaattttagaacattaatatgaacatacaaaaaagtcttaatttgattgaaaaagaaaagtcctttctttcttctgtcacctcccgagtgtcttagaagatctgtatttacaatttcccttaaattggtaagacatgcttttgccttaggtgttttcattaaaattcataaacaccagacaaactcattatttggatgcccaaatttaataaaaatataaattcttttggttcctattttctccctactttcttaagacacagtaattaatttatgctgagaacactcatttttgtcttagctgagttccctaaaactttcagcgctaagttaacaggtacatgagcttttttcctcagttagatgccactagtccattcagtgttgatagaaggctggggttgggtctggtgccttagcagggccaagtgtagaccttataggtttaggtccgtaaacttcaccttatatttttccttccagataatgctacatagacatggatttcagtcatagaaactcaaatgtgtcacttaatacagaatgagtcttcatgatgtcaccaatttggagtgggcatagcatactgggccagtagtcaacttgcctgccaaatctgatccatttgtagtggttgtttttctgaaattacaactaggctgacatgaaagattgccagaatcgattattgatatctaccatgaagtcgggagagaagaatggtaacggtagagccatgcatttgccgtctttaggcattatttatgaagaaaacaaagaaggactccttttcattttactttgatgcctcagttacaaaacagaattctacttgaaagattaatataactcattgctgcacatcttgaataatccacttaatttcaatattcgtaggatagtcaggtcatataaaaaataatagcatatgtaaaagtctagtattatcaaaaaattataagctgtgaagtttgacttctcaaacccaaccttctcatactataatgcagatgtgctttgctttactccttggcattagatatttcaaagactgttgacatttgaaaaccagagtagctgaacatggattttctaaagaacacactctaattctagaaaaaaggcagtgtgatctttattattttgtttgatgtgacagactgcaagggagtatactctgtggtcatagggatactctcatttcagaagcagccacttacttgaatccacattattactgttacgccctccaatggtaggttgttggcaagtatttattaccctttctgcagtgtgtaagttaaatttcttttccaaggcaatggggccctaagggaaaatcaaggaagggggagagtgagaggagcctgggatgagacgtctggttctataacttccttccaagccattagttgatctcttggatcagcttttctcaaccttttgtgtgtaactttcctggcagagttgttgaattatgtgcagccactttcagcaagctgcttaggtcagggggcttttctttggcatttagctcccacatacttaaacaaaacctcaatttgctaaggtttttaacactagaagcttgttctccttatctggttgtattatttcttccacacattgttattcataacacatctggctgcaggttacagcattttggctgagcttcaccatgctaacctttgttacctctcctagggtttaggaaacaagcccctctggattgaaatattaatgatcataagtacaacagcaacccctctgcttttcaagtaatgcaattctaagccgaagggcagcagcaccaattataactacgggaattctatatactctcccagtaggatagacagatgcacatacagggactcagctgggctctgatacttgtaactcaatgcttccttgtgctttggtgtttcgaagctctgaaagagaaaaatgattctagcaaggagatttggttggtgagggagaaccgctcacaactgctgagctagctgtatagcaaattgcccttaggtagggtctccttacttcttgtaacactcagttttggagatgagggaagcctatgtgacacacacacacacacacacacacacacacacctctctctctctttttctctttctttttccctccctccttccctcctctgggctgttttcagtaattagaatagtgtaccaaagaatgtagtagtacattttattttcaactcaactgccacctgagagacgccctgagacattcagcccaagggtgaaaacaaatgagccaagattataaaatgggtcgagtcacatggtatagggagcctgttggcagaaacagattcacagactgaatcttttgaggctgacttttctgctagactagtccctaactccaggctgacagtcaaaagccttagatgattagagggcataatgaggttttgtaaaggtccatgagttctcaacaggaagaaaagagaaaaaaagtgtagagcaccaggcagggaaaaatttaggtatttacataaaaagagagtggtgccaaaagaataaaactgcagaaagtcggcaaacaatggggaaaatgttgctgagaaacaaaagaacaaagcagtatgtgattttttaaaaaaagtattgtatatatttaacaacatgatgtttcgatatacatatacatagtgaaacggttactacggtcaaacaatattaagcatccaaatgagagttacagataatggcactcatcatttattgaatatctatactgttccaggcaccattttaagtgcttggcatgctattgacttatgatccttgtaatgaccctgtgaggaagggaatattttattaccattttacagataggaaactggaggcacaaaaaccttaaattttaatttgctcaagatcaaccttacatttttaaccattatacgtcagcttcctcccaagagattgaagaggctttttaagaagaggttggaacagttggaaaggccagatggaaaatattgatcctcaaaaaatctgtaggattgagctaggcaggggagctgatgtctattccaggcagatgaataatattaacaaaagtacttcagcaaaagagataccttacaaaagagagctttgtaaatgcatgatttttaatggttgattcatttccttgaagcaactgattaacttactttccttttcctctataactctgaattcagccctggtgataatgaaatgagttttttttttttgttcttttcttttctttaaaccgtaactttcttaaatgtgatttttacagatattctttaatgactaacacattcctgtgcttgagtgatgttaaatggaaactttaaaataaatctaaaaataaatacagttgatggatatcctaatagataatatcctaatggatattgtcttaacatatcctaatggataatgtttaatataaatgggaatgctcatggtataaaaaatatgtctggtataagctagtgttgtttaaaaatgtgtattggtatgtgcatatatttcaaaaagattgaaaaaacatatctctagttatctctgagtggtgagaatatcaatgacatatactttttctgaatttcctaatttaaaaaatgacatgtattatctctataagcagaaaagatgccatcaaaagtaaaaataaatatggctctaacatcatgttttagaaatggctccagtagataattaagttatgaattctaacctataagcatatacatacttagttctactttttatttgaattaaatcttttgactttatatgcaagatagaacattgacttccaaatctgtaacagaattagtcaaacctcaggaggtcaaaatgaaaccaattctctatcacacattgcaaagaaaactgccagttcctgttctaaactttgggtccttgaattctttatctgatttctagtgtacagcactacttaattaggagaagaaaaacattgttgtgtattttaaaaaagaagaaactgtgtcttaaggcaaaaatcagcctaattttctgtaggttatattcagtcattgtgtctgaattcttagagctctttgagaatgcccactaactaagaatttggatatatgtgctcctagttagagcctagaatgagcaacaaaattggtgtattccattacagaaatataaacttatgaaagcataatatgttgatgttaccatttttattgatgacataggaaaggaggatgcagaagggattgaaacaagactcggaagcactttctgactatgagcaataaggtgtgaaaaaatgtggagagctagtatgagagctggtaaagggaaaggattttaggagaagtcaaatttccttggggtgattctggttgggggaaaaggttacccatttggaaattcctccttctctatagattgagacaaatatccccagcaaatgctttatctttttacctggagtccaaggcagccactgtgctctgctaataatgcacgcagaaattctttgggaatgccacttattgtggttaactggcttgcccaaaccataaaccctggagggagcttagttaaaaattgatgggccattgagattaaaagagcaaaacaaacagccacaaaacaaataaataagtgatgcttcttcagttagccaatgccagaactcttcactgccagttggaatttgaatagggtagaatatatgcaaagaacaggcaaaatgcctctctcagttccattgcataaaactaagaaacttcccacctccaatccttcctcttgtccccagagcacaaaaattatagatttagcccatgctttttgactatctgctcactccttgggcagaaacatcaatcaccttgccatccgcttactctgatggggctgcatagtttttctttttcattgtctgtttgccatcctagcctcctatagcaaaacagattcaagccaattgcaaaattaattttaaaaataaatgtcttaaaccagcgtagcagtaaattaatttcatgcctaatctaaatagttctgttaataaaagtagaatgcgtatggtacttgagaatgactgtacaggggatgattttgctggctttctcctctggatgtgacattgctcatggctcttcccaactgctgccagaagctgtgttgattgtaggttgtgggtgcttaacagccatctggaaggaaagttggcaacacctagttgaaagcatatctcaaactgagggatcctggctgccatctcggttagtaaacactgtagcttccccactggattgaacacttactccaaattcctaatgggaagagaaaatcaagaaggagggaaaagaataagcatcacttgaatgctttacaaactggccattcattaaggcaggatgcttttcttttattccagaactcaatccaggtgaagtgtggtccatttctttcttaatctcattagatagagctagtcaattactgctcaagtttaaaaagaatatgcactctgtgctttttagaaaccagagtttgtaacagtctttgctggaaataagcaaagaagcaggagacataggatgattttgctgtatgtttattcaacactacaatgccagttctggaattattctattgaatctttttctcttatttgctggactgtgtcctctcaggaagtaaacaagtagacttcaagagtcccttaaattttggattagaggtagcagtagtaataaaatagggagcttttgttgagaactctttcctgcccaatcacctgtggcatataagacggcaccacaaatcagatgtggccctgtgtattctttctcatattttctttctcgtagttttcagggtcattctcagaaacctggagagtgatgatggatagattccagcccactgtcactctgggtgggtcctttcaaaacatcaaaatgtgattttgctgtcatttgagtgtcaatttcttttctctcaagagtatttaccaagaacatcactggaaagagtttgtcttatacccatattttaagcacgcaatgcaggatcttagtatttttaaagccaaataaagcaaggaagacataagtcaatagagaaattgaaacatagaatctagatttgttgcttaaatctgattcaagagcttatgcaatccttagaatgggactatttctatagaatcacagtgagtttgacataaatataaaggagagagggtttaggtataacaaaccttgttgtgttctaaactagaacatttttatccaaactagatgttagtttacttttatactagagaaaaaacatgaaactatgtagcaacaaaatattgaaatattttgacttacgccacatctttttaaactttataattttatttttttgggtgtttcactggtgtgtttaggtgccctcacaacatattttgtggaataaacttatactacctcttggcccatcgttacttttaatgagagttttgtgaagcacaactttacagtgggtttggctttctatttctatgattcctggtgaattttagggccacaaattcaataacaaagttgttaaagtattcatttagtttagtattctcccacaaacctcactgtagcctaactctcttccttgagttaagaatggaggatcctttgtgtgtcttaaagtgctgacagtttcccttggaaattctgttggtttggggcaccctggttactccaaagtaggtgggatgatgccagatgaggactttactgtcaagagaatccagttgttattgcttccttcttatccactttgcttaccaagtaagcacagcattgtgttttctgagtctctcacagaggctcgagcaaaggagcttcagtctctctagttctttggcaccatcgattctgatgactcagatacttgtccagatggaatcattggaatcttctctacataatgacactgtggtgctctcttttggaggaccatgaaattgttccaaaattaaacctgttgtttagctttggttgcatggacagagactatgatgattaattttaaatgtccacttgactgaattaatgaatacctaggaaagtggtaaagcattattttggggctttcctatgaggatgtttccagaggagattggcatgtgagtttgagtggactaagtagtgaggatctaccttaaagttgggtaggtagcatctaatgtgttggagccttggatgaataaaaacagaagaaaggcaaattggtctctgtctctcctggagctgggacactcttctcctgccctcagacactaggaccccaggtcctccatccttgcaattcttggacttacaccagtggccctcatgagttcgaaggcctttggctttgaattaagaattatactattggctcctctgatttagaggtgtttggacttggactgagccatgctaccagtatcacagagtctccagcttacaggtggcctgggtcttgggacttagcctccctcatcatctgagccaattcccctaataacctcatattcattcatattttttttctctctctctcatctatctatctactgttagttctgtccctctggagaacactaatacagaaatcatcatttactcaaattgtttcaagaacaagaagaaaaaaagaatacttaaagattcatgtggcctaaaattttagtgaaacattcaggcttctctcttgaccgtctgctttatctctcacacatacacatctgtgatggaagctttgcttttctacgaatcttcattatacacttcctactaactggtttggctctggtcccttatactgttagtttgcttcaaatcttatgtttccaactctaaatatgattttatctcccccaaataacagtttaagttcttttgggttttctagaaaccatttcttgagaagccctgtttcattttattttaaataacaggtcctttcaaagatcacttgctaagtatgaattatttgcctttggttcatgtttgcgcctctggtcaaatcatttctgcaggggtcttatagtaaatactgcacctaagaactatgagcattacatttctttgtggaaaaggctgtgggcagggcccacaatgactaaccacctgtgtatctgatatgcaatccttagaatgggacaatttctatagaatcacaatgagtcagacatacaccttgtttcattctaaactagaacatttttatccagtaactaaagtagatgttagtttgcttttaaactaaagaaaaaacatgaaactataaagcaacaaaatattgaaatatttagacttatgccacatcttttcaaactttataattttatctttttgagtattcaatgccaccagactgaagcctgcatatttctctgaggtgctctctgaggttagtttcctgctagtgtggctatgtggagtgtgatgttcttataatcgacctaaatatagtttagttaaaggagaacatatggtctttcagtgttgctcaaggcatgatttcactggactaatttcaatcaggtactttgttttcagtgcggcacttaacagaatcataggcagtctgagctaggagtggccttacatcgtctactccaaatcaagtccaacccctttatatttatagaaaataatttggccgaatacaggtaatctgtgtgggtgaaaataagcttgctgaattgcagggcgagtcttttttcaacgtcccatgctattttcgggatagatataacatatagctttaaaattgatattcatcctaagtccttcaaatacaggtaaataaaatagagcagattatgtgacactaactgtaaatgtcctgagaatggtagaaacctctgttgactataactggttctaaaccaagatggtggaattttattttctcaaatgttttcagcatttaaaatttcccttgtatgtctctcttaaggtcccaatttcctcgaataaataggcaaacaagaactaataatgtattttctttagctacattctccctcctgatgctatgatttttaaaaatctcatgctttctgcaaatattttaaatgataaatttttacacaaggccccaaaatagcagcttatgtgcagatgcataaagagaaggctgtattttgtatgtaaactatgttaatgcaatgaggagaccattttttgtttcttttcacagcattatgacctcctaactgtggttctgttattttgtatgtgtgcaaatctccaaacttgatgctttgatcaagcaatatgtcatcaaatatcccttacataatgcataaaagaaagttttcattcttagcaaaaaaaaaaaaaaaaattctcatttcaacagaataaatatttattgaatcagtgccaaaatgttcagtgaagaactgagtaccctgctggtacttgaggtctatgtcaactacagtttgatggagggctttttctttggtccttaaatgggtagtattttctaaagctagagacttttatctgcctccaagtcagtactgagtgcagtgtttgatatctttgcatttgtaacctgacccatttactgagcaatgcaacagggatttgatcatggataagaattccaagttaacaaatgcaaggggattatggaattagaaaaaaattataattttaaaagcctttaaaatattgacccttgacaatataagtctatgaatttaaaactgttttgatgaaattcgaacacagagtaattaatgcatcaggttgccaattctgatgcatcacatcaatctactaatttgggattaccagacattatgtgcattctaatcaataactctggacatggagagcatcacctatgaaagttttgcaaaaataattgaacctaaatctaattaagcttctacacctagctaccagttctacataaatgtcatgagaaaattagaaaagggggaggagccattgtactttaaaagaaacaatatacataacaacccattgaaagggatatacgttgttaggatttaaattcaaatatgactataaaagaatatttttgagataatcaaggaaaaatagacaagtattagatttcatttagaggtattaattttgttaagtgtgataatcttataactattttaagatatctgttagcaatacatactgataaacttatgagtaaaatgatataatatttgggacttactttaaagctgttcagtaataaaagaaaatgtgggagggcaggagcagtcatgaatggcaagttgtaattaatttttgaagctggatgatgggtctatgggagattattacactcatctctatttttgtgtgtgtttcagagttttcaaagtaagaaaattacaaaacaagctaacagaggtttgtcttcttcctagagtgggcaagatctttagaaccacaactcaggtttgacttggtaagaaaaaatgatattctgtaggttcccacactactcaacactgaaggctgacaacttatttattaggagagggatacctacggtattactttggtctattactggttgtgtgtctatgggcattcacctctgtcagccattagagttatcatttgtgatgtgaaaataatagtacccatagtatatgattgtaatgaggtttaaatatgacaatgtatgtaaaatagttggtacaatgcccagcattcattcactcctcaataaagtggagctgttactgtctttacctcacttaacaaagatcaattgagtgccagttatgtgccagaacctgtgcaatatccacaggattttatgacaaaaaagatacacttctccccatgaatggttcttaatttatttaaaaaattgactcagaagagattgatgttttgttgatataaaactgttaaatatcagcagtttcatgcagttcaacttggtaactaaagtgagatatgataatggaggcagcatagttaagatgatagattctagcactagaccttttggacttgaaacctggctctggcatgaataagctgcgtgatcctgggcaaagtcatctttttgtgcgttagtgtcattgtgaagtgagggatagaatagtacttaccttataggattgttatgaagacggcacataacatacacagcacagtaattagtaaataatgagccttgtatactatagtaatcagcatatgtagaaagtgatgtgcgaaggcacccaattgtgggaagtgcagataatcatattgggtgttgggggtttttactgaggggatcatagaagttttcacagagaaagtatgacatttgagattcaacaggaagaaggagttatgcaggcaaagattactctaagtacaacttagacaaaggacctggaatgtacaaaggtctggaagtgggagggaagagtttcaggagcagagagaagtggagtagggttagagtttaaaatgtgggtctttggaatggaaaggaacagggcatgatacagtcatggtagattgggtggtttatattttgataatttggtaggcaaaagagtcataaggagatcttaaccaagagaacaatagcagtattgtgatgaattgcaattgagggaagacttcttgggagtttataaaaataacctactcagaaggtggtttctgttatcaacagaatcagtatatatatgtctgtctatctgtctgtctatctaatctaatctaatctaatctaatctaatctaatctaatctaatctaatctaatctaactctggttagaaatgggaattcctggtcccacttagaattatgtggtcccacctcacccagaatctttaacaagatctccaggtgagctatagcatgttgaaatttgaaaaacactggcttgacaatgtcataggagagtctgggctaagacaggaatagtgggatgtaaaggagggtgtgaggaccactcccagatatatttaagaagtggaactgaaaagatttgactgatatggtatggggatagtgggtagtaaagaggatgcccatcgagaatatgtctgtgattacttattagggtttctttgtggatggcaatgggaaacacaggaaaaggggaaatttggggggaacagaggtgggaaaaagaactcattttattgcatattaagcagcctgtaggacatggaagatccataagaaatggattgaggaaaaaggagtcactttataatgaggaaaatcttaagaaagcggttatcttaatgtcaaggaagagtcccaaaaggacaaatgctagacatatccctctctactgttcttctacaacagaacaaggacaaattagaattggttctctagtaagcattaactactctgaaaaattttgagcttgtaaagtcaaagatctctggttcctctgtcaagtataaatgcataaaaataaaaccgtaagacacaacaaagcttggtaatttgtacgtaattctcctccatagacttggcaggaattcaagctctggaattggagaggttaaggagtcctagtgattccttggcatcattgttggtggacttgttaaaaaaaaaaaaaaacacttggtttggaaggatgtgaataatttagatatctgaattcactatctgctgagttgaaatgaaatgctaccaaggggtaggcttgaaaggttatttagccagattgtggaatctctaaatatgcaatcactccccaactcagagttgccacatttagcaaaaaacaggacacccagttaaatctgaatcttagatgaacacaaataattttttagtatgtcttaaataatgcatggaatatacatatattttaaaaagaatcattatctgaaattcaaaattaagtagatgtcatatattttatctggatacttcctccaatgccctaattatattaaataattgcaatatatatattgcagatataatgaaaatagcaaataatgtttaagggctaagctgagaattttgtaaaacattatgtagaaatttaaagcagtgattaatacaaacatgtatatattcaatttggagaaaaagaaacagaacaagcttgctggaaaaattatgccatgatttttcttcctgtgcttatgataaaattactgacttattttttaaaccctgcatacgttttagcacctcattctataatcataatacagcatttagtggcaagacagtctattattaaggtgtaaggtatcaaacaaacagtagacatagagctgtgaaggtaaagcctgatgcttatttttttaaagcagactctgatattaagcagatgtgcttgtagtgaacaaggcaatgttgaaaaatcaaactctattgcaggtagcatctaatacataatggaaacctccttttcggttggatctgttttttaaaattttaagacttgggtatatattagttttttttcaattaaattcaacaaatatatcaaacagaatatgcaattaaaaatagttggaagtaagaaatattatgaggccacagagaaataaggaattacttccatcaagggtcatttgagaaggtcttacagagggcagcatgagagcatcttcttaaaatacaggatttgaaaaaacctcagtatgttattttttttctgattaaaagtaatacatgcaggaattttgtagaggggagtttaaaaaagcagcagaaaacaattaccctgaatctcaagacctagaaatactgatattgttttgatatatttccatccagtctttctctgagtttttttttttttacccagttaagatcatactgtgtacatgcaattttctgtcctgctatttcacttaacaaatgtcttaaacatttctccttgtcattaaaaactctctgttcacatcatttaaaccaatcatacattatattggtgagtagtgattttcaatataattgtctaactttgggtttttatgtactgataaggtttttaagcaactgttttacatttaaataaatttatatctctatttctgagtcttagaagtaaattttgggaattaagggtataaaacgacatgaatggtcttgacatacatactaccgaactactttataaatagattatcccaatttagacttgaagagtcaacagatagagacaggaaacaaaagagcactatagggcataggtggggaagtgtagtatgtatttggcaacaaggaacagttggaatattttggagcataatgcatgagtgatggataggtacaaacagcctgaaaaggcactttagaaccaggttatggaagctcttaaatgccaaactaatgcaatgagctttctttttgcagggagttgtgagccatggaaggcttctgagtaggagaatgccatgactttagaactttcttccagttaattataggttattaaatgtctctgaacttttggatcatgaccaaataatatttaaggtcatcagctatcaaaatttgaatgtctggaaataaactatgccattggctcctgatgtttaaagacatcattgacatttaccttattgaacataaattgatttttacacacttctgtcagtgactacataaagctcctggaaggtaaaaagtgctaggtcaattctatgtcatggaaacctttaaaggtgtactctggtggtatacagaactgtgagtgtcataaagatttattgaggatttaagatgttcttaggaccttctagcttaatgatgtgccctgtaagtgttcaggctctgagcaggaccagaagagcaaaaatggtataaaaaggctattcaggtacatattgtctatttaaaatctgtacacggtttgcaccttttccctaagtgttctgtttgtctatgacatgaaatattcatctgaaaagctaaataaaatactcaaatttattttatattttctaggcaaaactgtttttttaaattttcaaaattaaaaacatttttttaagagatggggtctttctatgttgcccaggcttgtctccagctcctgggctccagcgatcctcctgcctcagcctcccaagtagctgggactctgactcgaactgactttattttattttctctcatcacatagatgtttttatggagccattacagattcagtttaagattgctcagtctagtcaataggttgtctctttctgaaggaaaaagatggaatctgttaacttctttcacatgagtgcatacccacaaaaaggaagatggaaccccagatggagaaggaaggccaaacaacaccacaggttgttttcctggtgtctgcatcacatgtacttagtgggtgggacaatgaaagcttccaaatttagaatctatttaaacattgaaggttctgtgtttcaaattcaacttgatcttgttcagccttggattccgtctcctgctgtcacaacatcccttctcaattcgaaagggaagaaaagagattcataggacctcaaatagagtttctctggcatggctgtgcatcaagtgtaaatgaatcagaaaactgagcattaacttttacttgaaatagataagactttaaaaaatagggataaaaatgcactgatggtttgaaatagcaattcaagtagttttatggcacttaccaccagacatgcttggttaagagagtgaggtactccttcgacattatagcattcgtcggagacgttctgttaaatctaaaatgtaaatagcttctcccttttatattatgtttgactctgacattaatgctgtatcctttaagtgactaaaagagtatttctgactaagccttctaattttgtcataaaactttgctcagaatgaatttttgcttaaaaggccaactctaatccatttttcttttggccaatttaaagcaaataaatcaggtcagttctctttatgacacaaaagggaaaaatgataagttttcttacttcatactcttttatttttgaatttctacaactaaaatgtctctttttctcctttaagtacaagctgacaggtcattaatccttaatgtgaatttatacctctgggtattttgggaagaaaactcattaaaattcttttgttttatatgtgactgtcctaatagaaatttggagttcatgtttagaatttgtttcaatgaatagaaagcatagaaattcttttaaaagagttgaagtatatgaaattacttctacctacagtcaatgctgttgctctgatcttaaaagtctgctgctaacttttctgcagaaagaacataagttctgtaagctccatattttcaatgtgaatagatttattccatttgaattatctggataggcctatgcacttaatataattttctataatgtttcctgtttttctgtgaagcactgttttatttttctttaattctaccaaaaggtgaggcattgggcaatgatcttttttttttttaaataagctcttacttggtcaaagttagctagctatggcttatgtataggcccattttatggatactggtggatatattctgcagcctgttgctggatcatagtttcccattatttcctctctctccagtttcttccttctttatagagtgcttgaaagccttctaaatgaaaaagaactgctatcaacaaacttatatttcaagattattagagagattttatcatctgtaaaaacttcccatctcaataggggatgggtatacctgcttctctgattgtccagaatagcttctatctctttttattctagccactgataacaacacaagaactgatgaagagagatatgccttttatttgctttctttttcttaagcaagtatatcaaactcttccatggtcttaactgtattctaggcatatgtttgaaaactccattcatttcatgtttccatacttagcaaacatcaactatgccttgaacactgtgttgggcactgggagcacaataatgaccaaagtagtcatcatccatgccctttggggtaggagtgaggagaatgtggcaatcaatgctatctgacttgttccacagggaataaaagtgacagctgcgataagtggtattaaggacagacatggtgctatcatgtgtataataggaagaactaatttctactgaagcgcaaggaaacctttcttgaagtacgtttgaatgaaaggatgtactgagggacattctagacaatgtagcttatggaagaaagtggtgaatgactgtaatgtaggactgaaggaaggctgcagccttctttcacacgtaggcttaggaggggtcttgtgaggtgaggtgggaaagttatattgggaccagatcgtacatgactttgtggaacagacagtagaaaaaaaggatctaggagatagtgatttattagataagagaggtgagggagagagatgtgataggataagtaccatgtttttgacttgttccttgtactgatgatggttgttcttcattgaaatgttgcttttctcttgagttcattagattataaactcctatagggtcagagttatgtttccagatgaactagtaatcttgaatattaaagtaatcaattctggtctgcaaaattctctttttactctgaatggcctttactcttttatggtgaaaatttacaaatatttactcaagcatctgagttcctttagaaacaaggccaaagaaaatgcaaataatgttattattataactttgaaataatgttattattagaacatttgaaatgataataatattaatactgtattagtcaggaattctaaaagctcaaatcctccctgtattgtttaatgtatttgcataacattcacgggagtatctaaattgtgaatttccattacaaggataatgcaaaaaagattgactttggcagtttctaatcctcttatcgtttcttttaatataagtgataaagtttatttatctatacattttattcagagctatgctagtggatcaagtaagactgcattcagaaacctgggaattgttgcaggggtatgtgtcttctcccactatcactaaccttctcctcaaaaccaggagagtaacaatcttctttgctgtggtgattggggaatatgtatgtgtagtttcattacttgcttcagtattccttgtttttgtttgtttgtttgtttactgtttacatcaaaaactaccatttgttccttgggccaccctttcatctattgatctatgattccagccatagttcccttcaaacatttattatcaattacacactgtgcatgaggcactgtactagtgactctggacagagaaaatgacatcatctgtggaagccagcttgaaggcttccagtgctccttaccgcctgatactgtgcccttgtgtagtctccttccacagtgagtcaaggcttgcctgtgtaactgaacaagtattacggaggtgatgatgtgtgattttcaaggcttggtttcaaagggcattgggtcttccatcttgtttccttgaatcacttgctccttgaatcacttgagagaggcttatttgaagagggactgaggctacttatcgtaccaaattgtgagccacatgagtgagcagacaccttagaagtggatcatccagccctatgcaagccttcagatgactgcagtcccagcggacctcagacagaaacctcacgaaatactctgagccagaaatatctaaccacactacttttacattttttccccatcaaaacgttgaaagataatcaatgtttcttattgttttaagccactaacttttggggcgatttgttacactgcagtagactccaacactggttcctacctgaaggtattattctcccttctataacggaggagggtagcatggagctacttgatttacaaagggctttcatcctgataaacccattgtaagttgaaaatactgtaagatgaaaaggtcaaattcaaaatttgaagtacagtttccattgaatgtgtctcccttttgcatgattgtaactttgaaaaatcctaaatcaaatcatcgttaagtcagggactgtctatattcacatctcagccatgtcccaaacaataataaagttcaactatagcctcagcaaatagacagttacaattcgagcttttcagaattcatgccatagataatagtagtgacttagaattttctagcaatttgcaatttacttttgcagttcaccaagtactttcatacaataactatagtcctctgaaagcagagcagattttatagataaggagttaacaaatctgtattgagtaactactgcaggctggtcatgaactaggtactgaggtcatagcagaaataaagacggacaaagtctctgttttcactgaagaggggaggaacacttaaatggttaccagagcatgcttgctgccaaggatcaggcataagttgctatggaaacataaaacagggggaagccaaagtaatataaggaccaagaaaggcttctctgaaagcattttagttcagttgagccttacaagattgcaggagttatcaaatggaagaagtgtggtaggtaaagatgaggcagaatattctaggcatattaaagcctgagtcaggatacaacatgtgttgtttgaaaacctgaaagaactcaggtatggatggagcaggacaaggaagaggacacttggtgctagatgatgctagagaagcaggcagaggccaggtactcatcaccttagaccactcagtaccacatgtttgtgaaagttaaagggagaaacgtgaagtgcaaggctgcgtgtggctgatctagaacttgaactcagattttctttccaatcctttcatcttttagtactcactatttctttattagagtatccttgacagatagagagcgagcaaccaaatacctgctttaaaagagaggaataaaacagattcagtgatggcaaagacaagacttacctaaaattataactcatttgtggtagagtaaggaacttcgctattaatctaagattcatggaattcaagttttttttgttttttttttttgttttgtttttctgagacagagttttcacactggttgcccaggctagagtgcaatggtgtgatcttggctcactgaaacctttgcctcccaggttcaagcaattctcctgcttcagtctcctgagcagctggaattacaggcatgcaccaccatgcccagctaattttgtgtttttagcagagacggggtttctccatgttggtcagactggtctcaaactcctgacctcagatgatccgcccacctcagactcccaaagtgctgggattataggcgtgagccaccacgcctggccggaattcaagttttatgacacaaaattcagaatgtaatttgttttatccacttggtttcatttaaatcacatgattgttccacttgattgccagaagcatctttggcagtgttgcagagcatagatcacaggggctatcagagaccttgaaggatggtccagctatagccatccctattaaatccattggggggcatctagggatcatctagaagcgggtcaggcatttgtctgcattgaatgcctctggcttcagacctacagagaaaaagcaaagtctttacataaaaaacggttgatgtatttgttatcagaaacagtgagtggagagagatgggaagagtctgtgccattccacaactacttttggccaagaactaaaaagcataaaatgggcagtggctgttagttaaggagaacaaagtaggctgaggccctgaggcctgcttcactggggaacgggcatgtaaggatatggacgggacttatgaccttccatgtaagagaacagaaggaaggtagcttatgcagcatttatatgccgaatcaagaatgggtatgggcaaaggataatgctgattgaatatggagtttagaggagatagtcacaggctgctattgttaaaagtttatacttccactgcctatgacaccttgaaagattgaaaataaaggcaagaagagagacaggatgttactaacatccacttactcttggcagaaaaagattaggaaaccaagaattcttgaattactaaccagagactgcttcctcaggcaagaagaagctattactctgcttggagattagggggctgagaatgggagagaggctgatccttggaaaattgcaaagctgctgaagaggcagcagctgaacatattttccttttatttttgaatgtttcaatgtctgaagaaaaagatatcagtcatagtactgactggcagtgatccagaaaaacctctggagagcttagaattctgattggcacttgagtgaagttccctgacacccaagctgaatctgcggcattcatgcaggctgagttgtgttggtcacttttttttttcttcttatgcagagggaaaaaaagtagtttctggggcctgttaggcttaaattccttccagagcaattagggcacctgctttcttcaaatctctgtccttctatcagtgaaatattttaacatctggaacttggcagatggaattgttcttatattcttaacattttcctttttatttggatttttaaaaacataaccatcaattcttctagtcctctagtgtttctgaatgagtgctcatccctgagaaatgctaaatccctgagcaagaaagggagttacaatcaaggaccaaatgggagtacattacattcaccttccacctctaccattctagaaatctttggtctacaatcctagaattttcaggtttattgaaattttccccagaggggttaggatggaagagaaagccattctctttctcattcctgttcttcctttttttaaaaatatatacttattaaagacatctatgtatcaggcattggggaaataatatgtattagtccattcttgcattgctatgaagaactacctgagactgggtaatttataaagaaaagatgttgaattggctcatagttccacaggctgtacaggaagccatggctagggtggcttcggaaacttacaatcatgacggaaagcaaaggggaagcaggcacatcttacatggctggagcaggaggaagagagagaatgggggaagtgccacacagtttttaacaaccagatcatgtgagagctcactcactgtcatggaacagcaaggggaaaatctgcccccaggatccaatcacctctcaccaggcccctcctccaacatcagggattacagttcgacgtgagatttgagtggggatacaaatccaaaccatatcctaatgattagcacaacatgctggagtcttcacagagcttagagtgtagaaagaaacacacatatgaaacagagcttttatagtccagtgtgataggagccaaaataggaaattgtaggtaactaggggacaaagtagcgatattcagcttatttgggagggagagtacaggaggtcaaaaaggactccccagagaaattgccatttaaacaaagtaatagtgtcatgggctccttggggtgttgctttgctagccagaaacctctgtggccagttgcatcttctgcccctgctgcctctgcttgtgctaccagcccagatcctatacctgccaagggcgagacaggtgcagagtggtgaggggtgtgtgggtgagcaagtgctgggtctggcgtctgcacatagccaggcatactggctgctgtggcagggtgggcagctccgggcaccagcacaggtgctggctctgtgacaggctgttgctggatcagatgtactgcacgcagcttccactgtgggcactggcatctggatgaggggaacccagtggcactgggaagcttgtagatgccgggaatcacagagccccaaagacagtgtcatagccctggctctgagagcctccaggtctggttgccttctcattgaccacagtatggtgagtggggtctgtgtttcagccctgtttgcgttatagctctttcagtcctgccatttggcaggtcctgagttcttgtcctgtgaccaggaagaatgaggtatgtgcacacccaactggagggcgagcaaggtggagaggagcttcactgagtgatagaatagctcgcaggagacttggagcatgtagctcctttcttcaagcaggttgtcccgacgagtgtccagctctcagcagagaggagacctgcagtgggtagctctgcagtgggtagctcctttctgcaggaaggttatcctggtgacccgaagtgggttgcttcttcctgtagctggtagttcagacaactgtgtgagtctggctgtgtctagggggtttttatgggctcagaagggaggaagtgcatgctgattggtccatgggccccacaggtgggccagaaaaagcactatgagtaaattctcactctgggtgctaactccacctggaactgacagtccagcccccatgcttcaggctgtccctggcttgaaggtggagcttcactagggacccacccctttccacccaggagcctgtcagcctcctgctgccatcaattatgttgtcaatggcacccaggctgttcacgctgaggggcagctgcaggcccacgccaagccaccctcagcacccccttggccttcctcccatgcctgttggcacccaaagtctgaagggggccaagggggcaggtggctggcatgtcagcaccaccctgagtgtgcatacacttggccgggttgtgacagtgcccaggcttggtgacagatcccagctgtgcttagggatctgctcaagtataggctggatgctttcttgcccacaaggatataatgaggactcccatcctgacttctaaattgtctgccaatctgtatatctattatgacttcccaaaataggtacagagatctggcatttcccaaccatctactataggtagacacgcattgtaaagtgccttctggggtctggaatcagagtgtctgagtttgaatcctggcacagccatttattagctatgtgaccttaggcaagttacatggcctctctatgcctcagtttccttatctataggtaaaatgtggataataatagtacctgtatcataagattatgtgaattttaagtgaagtaaggtcagtgcctaacagattgtaagcattcaatgcatgtttgctatcattattattattattaccccattattacccccatcttacagtgggagagactgagttgcagggggtttaagaaatgtgttacacagcacttagtgatagaatcgaggatgccactaccctggtgaaggatgacatactctgcttttctggtagagagagcagatattgaacaggggccgagagcaacaagtgcagcaacagtggttcacagacatttgccaggtggtcaggacttgagaactgacaaaggtgagagggcaggtagtcccctcccattccctctttatcttttggaactcctctgagaggtggaggagaggtagggtagcaagttattctttcatgctacagcccggtcatggagctctttgttggatatggaagatgtaaagtggtggtcaagcttccagtagctaatggcatacagtgagaacacagttatctgcatggtctctcacagaaaatttaacatggctgagcctgtcagttctcccaaactattaataagtgtaagctaatttttcttcagatattactatgcattggatgctgttctgtgtactttacagatattaactcaattaatattcacaacacattggtgaggtaagtactattattatcctaattttatatacgatcaaactgaggcatggagaggtgaaacaacttgctgaatcttatagagctgtaaagtggaatcaggacttggccctagatagtcagactgtagagcctgtaatcttaacctccatacttagaactttcttaactgtgaagattaaaagagactattgaaacaccaataacattgttccccaatccctgtaggagcacagaatagcttagtttgccttcttcccctacagacttgtcttcctcaacaagaaaataaagctttagtttatttaacaaatatgcatgcatatttttattatatataagctatttaggtttcatagggggataaaagatgaataagatttcctttaagaggtcaagatctaataagccaagctttctatagagacaaatacacactcagagatccaatacaaaataaagtattaaatggtatcacagagggataaagtgatatggaaatatgatcagtaccatgggtttggaggacttgttcaaaaaacatttgtgatttattagatccttaaccactgattccaagtggaatctgggggatcggaatggagatggttgttaaggtttgaagttgtttgtgttcaccatttaaacatctagtaatttcacaatccttttgtgtccaaggtatcccatttcaaattattacctatctcagtggccttttcacattattcacaatcttacattactttgtactatgtatcttaaaacatttctgtctcatttagactgcttagactgaccacataggaattgctttggtaaccaggactatcgatatctctttctgtgttaaaaattgacttaaggcctctctacagtttaaaaaaagttgtcattttacattttgattacttttctatattggagatgtcagtagtgttcaaagtctggaaactggcctacctaatatttttactgctctcttttcattgggaaatatcagtaatttgggggactttctctaaaattattctatgtctgcaacatctggtaacatgaaatacttcgtttgcttataattctttcttctgtgtttttaaaatataaagagatgcctcttctgtttatttgtgcccttgtaaaaaggatccaacctgctgacaggtgcccagctctgcctgtggggtccaaatgaggtatgcttgctctgcctgggagtggggagttcaactgaagctttgtgtttttgctataaacaatcctttattatggatcttgaactctggctttactataacgtaattcttagagagtagctcaattctttcagtgtaacttgatataatcattcatgggtaaatcataaccaggattactgatgaaagagccagggttggtagaaagagtcgtagggacagggaaacttgccccagtcttgctgctcttacattgaagtgtctcgtatctaagagtcttaaatatgttttatgaatctatttgcatccttgcactcaatctggtaatatgatatgttttggctggactgtttatatttcaagaaactttgtttgtgtattaaaataaaaaagatgaatgtgcatcacatatgttgaaacatttgcaattagttggtgctactctcttaagtgattgggcagggcaggcagacagccagccttggcaatcttttcagattctttttcatgccaatttgcaatttgtgacagtgccacatttttatcgggagggctttattgagctttggaaagaagtacttcttgacctgaataggtgggttcttggctagaaccctagaactgtttcttcctctaatatttttccatgggaatgttggggataaaacattatagaaagctcagtgtggaacagacatcgacccttttacaagttatcatggagaggtttgcaatacagtttgctgtagagatggagtgatagtaacacagaaagtcttgaacgatctcatcatgaacacaccgtatctatcttagttggttagataagaatggaatcaattgactaaatcaaatgaaaattttaatccaaaaacactgaggaacctaaaatgctggaaattcaaatcccaaaacacgctgtttgggatactgtactagaacctcatagaacaggaatgcaaggggagaagattgtggagggaggttgtataaatgggtttgagaatttattcctgatctcaaagagtagggagtttagtatggaattcgataataattcatagaaacttaattaataaaagcccatgtcatatgaaccagtgccaaattgattgctggtatgcaagtagagaccacaggatctaagaggaaatgaggaccctgaatactgtgatggtcagagaagtttccaaagaagacatgagttttgttcagtcttgaagagtagagccaaatagccaaggtagaaaggggattaaggaacagcatgaccaaaaattctgggggaaggaatggcatgttaagagaataatgaatatatatatatatatatatacacacacacacacatcgagtagaaacttcacatactgtaagttggagatttattttaggataaaagtagtgattttcaaaacttttaaccttttgcattccagttggaatagctctaagatttttctttgtgttggttttctgtgttgttttacatatttgataatgtggagtaaggtatttcaattgatttgagttgggaattttaatgcatcagactatgaaggagaaagtaaaacaccatgcaatactctatcccttagagaaaagactattgttgacattaggtaaatattccaggcaattctctttgaatgcataaagatggatacatagataattattagataatcataaataataaaaatgggatcatgctatacccgcttataaattatattctctattattttcatgtaaaaatagtgtcaaaatacagttaagactttacatgtcagagaattcaaaatgacatttcatttcctagtcatatctcaggcaccatgtttctcataaccttaatacctttgtgacatttatttgaaaatagtggctgtgcaatcctttattttaaatttcctgggttcgtgtatatatctctaattcttattcacagtgctgcatttattcaagggcagatttttaaactttttttttttttatagaggggaatggagtgcagttttgctatgttgcccaggctggagtgcagtggctatttactacagtgatcagggtgcactataggcaccaacttttgagctcaagggattcttcccaatcggcatccaaaatagctgggactataggtgcatgccactgtttctggcttcaggagataatctttttaaaattatactttaagttctgggatacatgtgcagaacgtacaggtttgttacataggcatacacgtgtcatggtggtttgttgcacccatcaatccgtcatctacattgggtatttctcctaatgatatccctcccctagcccccaaccgcccaacaggccccagtgtgtgatgttcccatccctgtgtccatgtgttcttattgttcaactcccacttatgagtgagaacgtgcggtgtttggatttctgttcctgtgttaatttgctgagaatgatagtttccggcttcatccatgtccctgcaaaggacatgaactcatccttttttatggctgtgtggtattccatggtgtatatgtgtcacattttctttatccagtctatcattgatgggcatttgggttggttccaagtctctgctattgtaaatattgctgcaattatgatcagacacttctcaaaagaagacatcgatgtggccaacaaatgtatgaaaaaaagctcatcatcactggtcattagagaaatacaaatcaaaatgacaatgagataccatctcacgctagttagaatggcaatcattaagaagtcaggaaacaacaaatgctggagcagatgtggagaaataggaatgcttttacactgttggtgggagtgtaaattagttcaaccattgtggaagacagtgtggcgattcctcaaggatctggaaccagaaataccatttgacacagcagtcccattactgggtatatacccaaagggttacaaatcattctactgtaaagacacaggagtgaattttttaacatgttaaatacattgtattaaatgacactatggatgcaagtggcagacataacttgtactaactcaaagaagagggaatttattaaaactgcactgggatatctgatataaatcaggaaagacagggaaagttgtgtcccaggacagtgaaaaaaaaatggaatggaatctctgcttatttttgcacattggccttctcttgcacaacagaccacataactacatggtggggaatatggttgttcaaggctcccaggctttaatttccacagccctccagagaggtactgactctttttcattagttccatcttggaagactttggggaaagactggtgtggcttgggttaggtgcccaatggattttgaatagagtcacatggcacacacctggtaattggagtacattcctgtttatcttgtgttctaagatgagggagctgagcagccaccctcctctaattggtgccagatatatacataaaactacacttgggttgacatggacagggtgcttaaaatgcgattataaggccataaaatttagaacactttggaacttcattgtttacaattaaggaaataaggttgataagtgtacaatttatttacatgcatgctgtaatctttaaaaaatttcctttgtgtattagcactatatggaaatagaaaaaaatctagactatccaagtttgtaatttaagaataaagcagtatgttattatcagtggaggaaaaaggattcaaaacagctttctggtgcaataaagtttgcctgctttcacacctggataactgacttttagaaatatcaaatttaacttctaaaatatttttcctctgctctgggctgtggaaaggaggctataggtgaatattaaaaaatggtgactaatcttaaagtataagatgaaaatggacacctaaaatagaatctgagaatcagagaattagaggtggagctgaactatctttggcaggcccggtcacttgcatcatattaagtcacaaggtataagatttttgagcaagacttctgaaaattgtagtttttgatgggtgcaatattagtccttgaaatattactatccagaaggagaaagtaagtatgcacaccagcaaacaggagaagatagctgagaactatgtggatggaatcctgctgaagacatgagatggtggaagagtggtttctgagggagtatgtaccagagagggtattatacctagcaaaaagtgagggtgaggagatcagcttctgatgctggactccaggggcaggagacaagagcattggtcatgcagacagagcaggtgagtgagtcagaaaaagaacgaaaaagataacctgaagagaagttggtgaataagtataaatcttgaaccaaatatgaagttggggctgaacggaagctattaaagactatgctctgggaaaggacaaacagaccagagagcaggtctacagttgtagctgcaccatccaatagatagccaccatccagtagatagatagccaccatccaataaccaccatctaacagccaccatccaatagatagccactagccacaggtgactctttaactttattaaaataaaatgaaattcaattccccaatctcattagccacatttcaagtgcccaataaccacatggggttaggggttcaaagtcagtgcaggcatagaacatttccctcatggcagaaagctctattggatagcactgagaggctatgacagtgagcctgaagtgaacatgaacctgaagccttgacccatgtcctggcttcattcttcttttcatagttattggaggttgactatgttgggaatctacttggattctgacactaacatttgggggcaagcatctagcatcactagagagacagatactggagggtgggtttagatacgaaactctgcatccagagttctctacttccttccaaaatataaataagtaagtaagtctaggtctaggctaccaggtaaagacttgttttaattatggttagccaaaccctagagtgatccttctgcttccaatcaaggctgtatctaagccatataaaacagtcgactggccaagctctttttagatgttgcttcatttctccaaggacatgctaactttgtccaggatttagtgggaaaattagaacctttacagatgtcaggtctttttacataatagcgacaacacctgccttaccgcaagaatgtggtggtttaagatcctgaaactaaagccatctcatttttgcataactcaatctgttcatgaacaataaatgttaaaaattgaaattcacattctgctatttgtaaatattaattctttggcttggtgtatttattttaacttagatattttttgccctcatcaatgattcttcctagaaacagggacctttttacagtaattgactccaattttgttgaactggtaagcaattaggattagcatatttatttagtttttttgctaaattttgctcttttaaaaatggtattgaggaataatgtcaaggcaacacatagaagctcattttctcactcgttgaactgttcctatttttaactcaatggctttttaaaaaaattacatcggctttctgaggctattaggctactcttcaattaggtgttgcttctgtgtacacaatagcatgccagaagctggaaagtgctcatgcagtttcagaagtgtttaatttgctaccagggaatagcttagtttagaacagcgtaagaaaagcagagaggagaaaacaagatactatttctcacacctacagttaccaaagaaggataataaaaccaatgagacctaatgtttattgagtgtttacagtgggataaacattgtgtcgttctttcatgtgttttcttcgaccctcacaagaatgatttcaggtaggtaagattgttattcctattttgctgatgaggaaactgaggcttatagagaaagagcaatttactcaatgacacagagctagtaagtggtggatctaagatttaatactcaaattgtttgattctagagaccttgtttttaaccaccactttcatatcttagttgactaagatggctgtttactgaacaccttctttgctttcccacctgtatcttttctcaagctgggctggaaataccctactcctagttgtctttgaagttttatcatgctttaagattcttatctcctccaagattttccacatctcttcaaccaatatgaacattcttcttctcccttaatcttgcaaaactttgtgtttccattccattatttgcaaagcctgctttgtattggaattttatgtctgtactgtgagcttctgaggagtcagaactttaacatatagaagttttatttcccctggcacctagaagtgtgttttaatgtggtaggtacacaaaatatttttgttgctgacaattttgaaatttcactcacaacttaatgaacactgtatttgctgactttgggttgaaagggagggtgaaagggctgaggtttctttttttttttttttgatagtctctttagttgcacttccttatgtttgaggacaagttgtctgttgtcctttaatggtgaccttcagggttacaggcattcattcaacagatactcattatcatctttcagtcttctaggagccaggcatatgatggtgacaaagactgattgtgtcactcttctcttggagttaagggataatctggagaggcgaaagattgtcaaaagttgtcatctaaatatataactgtaagggtactatggaggaaaccaaagaggtgttaggatgaagtgattgaggaagtgatatttaagggaagacctgacaggtggaaaggagaaagctgggatgagcagaggaaggtgtatactcattatgggacatgatgtgtgagagtcctggggtaggcagaagcttgaagaattcagtcaccatctgttcaaatgtcacgcaatacataatatagcaacaattgctttctggtggtcagttctccataatccatgcatgacaggtttatgtgcatttcatggttatagtttaaaccgtgcccatatttccattttgtaggggctttagcagccacttaggggtaagtcatgccttttgtaggcttgtttacttttgaagttgtaaattgggtttaaattatagcttcttacaaagcaatcatcatatttactgttcattgaggacttatatgttaagtagtatgttaaccattttattcatattatttcttttaattcactaaagcagaaatcttggcaaatgtttccacaatgggccagatagtaaatattttaggctttacagagctcatcgtctctgttgcaactatttaactttgctgttttagtacaaaagcagctgtagataatatgttaataaataggtgtggcagtgttcccgtaatgctttatttttggacactgaagtttgaatcttatataattttcacatattgtgaaatagtctttttttttttttttaaatgttccaaccatttaacaatgtaaaaaccattcttagctcacaggtcatacaaaaacaggcactgggcagcatttggcccaggggctgtaatttacctactcccacctgctctcctcattgtccccgttttaccaacacagaagctggagtcactgggaagttgtttatagccaacccaggtctggtagattccaaggtccatttctttaactcaaatgcctcacagcattaacaatttgttgggttcccagaatgatttcttaatagtttctggtgtataaattttagtccctaagcagattgcatgtttctcagagtaagaagcatttttttttttttttctatttgtcttgtttccctccacaggaatgatggacttacaggaggcattcggtaacgggttatctgcccttcaaatggtttctctggaagtggctatgaactgtagatttttgggaatacatagcaatcatatttatattgcccacctaatttagctttttaaagcagggccctgaaaactgattagaaagatgattaaaatcctggatgccattttcacatcatatttgtagaattagtgtcatatttccagttttcaaatgcaaatcttgtaaaacaaaaaagttgatttctcttcccttgtggaataaattgccccctagtctcctgaaccatggggaattctttaatttcttgtttttaaattgtgcctgtggggtcaattaaaggtgaatgtaagagctttcaaaatctaaataaaatgagtaaataaatagaaaaagcttgaagaaattcattaataatacaccagtagccagtttgtcttgatgtcttgctgtctctggacctcttcatctcccttcctagttaccttaaaattaaaattcagatgtgacaaaactgtcgttaacatgtagaaagtggctaatatttttaacaatgagaactggccttgtcattttggattctgcttataacagacattttccatagattggaagatccaaaatgtaccttggtttggtaaaaatatatttaaagcatacacgatacgttacatacaaaaatacatatatttttacaaacatttcagcttatgataacatttttagacatcaacttaaaaacatgtaagtgggtagtttttcaaaattcttgtgggaggtatgatagcaacaaattttgaagaccactgctttagggcatttttgttttaaaggtttctctgaaagccagaattcttcaagatccctaatgattatctaccttgaaaggcccacgttttactagaccaccacactccaccccccacgtttacttgaatggtaaatgttaagagaatgctgatgaaatgacacgcatacaagctacagtagttttgaaaagagtctttttcactctgtagtatttgcaggaagaggaagtgttttgatatttaccttgggtagaaacatgaaagggccgttttgaagtttcacatatttcagacatgcagaagtatgtcattgttgacgatggtaaacagctggtaaagataactgcctggaacagctggaggagggagttgacattaccctgtttagaagtctggaaacagagaaagcatatttttttaactacagtgtacatcagcagcatagatgcatagtctatgtgcctataaagcagccattcaagcttaaaaatatgtttctctttgcttgtttgtgggacaaggctgtgaacaaaataaattaagtgaggaggttctgacctccgcagctggcttccacaaaatgatatgaggacttggggggaagagaaatgagttttgtctggcctcggtggaaccttctcaagggagccttggtggcaagttatatttctttggaagtcgacttgactttactctggttcagggaaggaagattctacttaatagaaacctggtgtccctaaagaatcaatgccgcttccaattggcattttcaaatttaaacaaattattgtcttgtgtaggctcagccttttcattagattttcatggggaataaacttcctgaatttgctgcgggctgagtgtgtatttccattaattagcaatgcaggaagcagacaccaaaaggtgagcaaacctaggtaagactcaaaagctcttgaacctgacaaagctaccgaggttcacaaaagtgaagttacagcttctacactaagtggaatctcaaggtcaccctggagaattatttggccctaattttcaatggcaacatcatcataatgttctttggaagcacacttttatctgtcttttaaaaatgacatttggttttctctagtataaagaaggagtgttacttctgccagtataaataaataaataaataaataaacaaatacttgatttcaagaattctggcttatgtcacttcgagcaaccccagtataagaaaatataaaataaagacaacaaatatgcatttaaagaagtcatgtaatgaattttagtgcatttaaaatatcattggatgtagaaataatgatttattttttacttaagaaaaaatgaacttaaagccatgtttaccgtaagttgaaaagttgaaaaatgacaaccatctggaaattatttggtaaaatatattgtaaacatatatatatagtaatttcataatttagtttacatagcgaaaatccttaaacattgtaagtatgaattagtcattggatacataatattgatttaatctgctaggcatttgtttgaaaagtatttgataaaatccagtttttaatgctgcaacttctgacaatttgtgaaagtgtatctgacttctacggaactcaagagtatactgactatattttagttgagcttagttatttgtgtgtgtgagtgtgtgtctgtgtgcgtgtgcatgtgcgcttctggggagggatggttttcttttgaatttttcaagtttctttccgtaatgaaaggaaaattgaacaaacatcatcctttaccatcgcttttagtgattatgtacccatttgaggctcggttttacagcctgttctctactcttaaaaggttattataaggacagataaataataggttaagtgatttttaagttactcagatgaattaatttgtaaatttaacattgtactgacattcggatccctttaaaaaatttagcatgcaagtttgatatgtctatgatgtacatgtcacagaaaacaaatggtatatatattcacttaggcattatatatttttttcctggggattttgcattattcaatttttatacttataaaattagttaaggttgaggactattgaagtcctgtttcttctaaggtgagcagagtggttgaaattggaaagttcatttctgctaagtatgtaagctcatgagctaattctgaattgcctgggaaaattctgttcaggaacagaatgacagcattggtacagaaataaaaccttaaaaaggataagagtgcttcagaattagagtttggaaagtgacagaatagcgtacctggaaggagttaatgaagacatttagttattagggctcttggaagaatgtttcctgctaaatggcccacaaaatctaacatcaaccactgccaaagtgtttttttattggaatgaactttactattatatcttaagtcagcctatgcaggccagttaactgtcatgtctaagagtctaccatgtgtccaatggagattaaagatgggtgtcatttacctttcaatatcataagtaacactcattaaacatttactatgctaaagctttatagaaatcagattttctaataatcctgatagctctctaaggtatatattatcatgatccttattttacagttaagacattaaggcacagagaggttaggtgacttgcccaggtcatgcagttgataaaggctgatgttagtacttgaaatcagggaactctgaagcctgtgttctgaatcactgcttttactttgggagtagtgcttgaagagctcaccttctaataaaggcgaatgggtacatacaattttaatatagtaggataaatataatcaaacaactatatgcaacgtgcaggaatcctatagaaaaggaactattaatattatttgtgggaataatcttggtatgggaagaaaggcagcttacagagtcagtgacaccttggtaaagcactgaggataaagagagcccttccaggtgggcaaagtggggatggtcattcacagctgagggaagagtctagcaaatataagagatttgctactacaacatgaattcatagagctgcagatactagttatgataaatttttaaatggggtgggagtgggtgaagtgttcaagagatgagaatagagactgacaacaacaaagacagttgggtcttttcagccagagtacgatgttttggccattaaagggtaaagtttatttagctagattgcttagttggacatgcatggtggacagacgtggtggctgggagaccacttcgggtccagtgctagaatctaaccaaagataatgggggtgggcaagtgggtggatggtagagcacctgtgttagggaatacaagagtaaaagcaggcttggggaagatagtgagtttgaataaaggttgtacaattacttgatgagtcattcagtgatattttgtactttctttatgtctagaattttctttaatgtacatttgtatggggacagatactcagaggaaccagttttaaaaatcaaacagcctctatttgctcattcagtcatcagagttgtctaaagaattagaagactgagtaaatgcctccagctctgcttatgtagtcaggtccaggatgtaaaaggaggatccgggtggggggcgggggggcagtgtggggagcagtagctatcacctttctacttggcaacatgccttactactctgaagaccagtcattctttagctactgttaatgctgattacacagaaaattgcacaacacttcactttgatttggccaattgaaatgcccttttagcaaacaagtggcactaccaaatcagtcaattcctggatcaatgcaaatctgagagttcttttactgcggagagtggtcctatcatttgagtgtagtcaattagcagaggtgatatgaaaacctccagctctgctatagaaagcaaataggctttgcatgattattaagcagttttctcatgtgttctttccttgatggagttaaaggcattagggtttgaatcctgcccatgctcatatatagagcatatgtcatcctctccatctttattgctattcatattgaggtcaattatgagctgctgtttaatgtcaccatgaaattgttcaattattttctcccagcgtctaagcagctatcctcaaagggatttgggaggagtggtattaatactgaggaattcttaagaagccagtaggcctgcatggctctccttttataattcaccccgtctcaattatgagatccaaaatgcttgataagttgttaatgaatagcttagtatccaatcttctctttggctaatattggggcacatagacctggttcccttccttggtggtggagttgtaactaaagaagggaagctgctatctttgtcacgtttcccctctctcccgcaactagactcttctggagcgccaagggcccttgcttggttattcctaactaaggaacaattaggatgagttttctttttccattttaatgttggaatgggaagcaagggggtaggggaaaagaaaccttttttattgagtgaaccataagtatatttgtacagcgtcagtatttttctgtttgcagtttacagataaaatgtacttgtatctctgttattattgtcatgatctgcagggggatgcaaagagaaatatttctgtaaagaaacaaatatcagtgcttttcttgaaatagatcatgtttcagttactccttttttctctgtatagcctggtaagagttttctgaagccagcctaattgcttctgatcattgtatgcctgctgtaggctctgggatttggttatgtctgtagcaatgcaaaatcagcaaagtgtctctttgagacatttcaatttgttcatttattcatccaaacttttatgcataaggcattgtgctaaatttattgggagaaggggtataattggatgaatcagccagggaccctctttaaaggagtttgtgatataatggaggcagtagacatgcaaacagttaactcaaatacaatgtagaatgaactgtgttataagaggaacaaatagaaggctgtgggagaagagatgaagaagcagttctcaaagagatgacttcctggaagagaaaatatttgagctgagccttaggagtgagaaggatagttataggtggcatgggattggttggacattcaggatgagagaatgccatcagcactcacgaaggtcattacgctctacgatttcatcttcttaacaattccctgccatgacttttgttgtggctttcagaatccttctatttcctaatgctgtgttactcctctgggctcatcatttttgaaaatctcattctcatcctgtcttccccacttagtaagtacaatagtattcaattttcttggcttagtgtatgaggtctgccatgatctggtaggcacctatgtctgccatttcatgtctttctgcattttaatttaggattacctattcatcaggcatggattttcacccgtttgtcttactgccttcaattccttcatttcttacctgcctgtcaaacactaagttcaatcacttcaatttgtactattgttagcactcaagacctggtttattgtactagtactgcaggctagtatgagtggagccagtaaacagcaccattacagagtgctgtttaaccacacttgttcataacttgtgcccatgttacccttagataggaagatttttttttttttttggtgaagggagggattgttggtattagtttagtagcaaatataattttcatctttagtcattatttatgtatctttcagtcatattacgataactatgcagatgctaaaataggttaattttggaggaagagcttaagaaatgaaagatgtgggattgtgggagtgagaattatctgaagacagtattagtagttgaaggagggaaggtggcgttggtggagggtattttccaacattttcaaatttctttctaagaaaatatttatttatatgatgttggtcttcaaatgagaagtttgattcagtaaataaatattcaaaaaatgattattgcagggcattgggtatatactcgttctggggtataagaaagtaggcaaaggcctactttcttactgtgttgactttttaaccgaatccttggaaacccatgccagtgattgagaggaaccatgtaaaaagctaatttggaaacctgaaatcccaatcaggagattttgcaaggttcaatttatttcctacttatgcttttgcccattcagtgcctgacccactggcttctggtggtattggcttccttctctgatctatctgtttagtgtcagttcccaggtatcagattgcataactgaaccatctacttgacgtacctctgtgcaccacatatgtgaaaggcctgtcactgtggtcagatctggtttgcagatcctgctgtgtggacctgcatcaatgtctaggctctgtctaggacagtttgggagagatcagacgtagatgttcagagcagaaatgtggattaagtggtatgacaactagttctaagtcttgaactttaagccacttgccttcattgaaccttctctcttctctattacttatgattgacttttggtttcacaagagtatttaaattttattgcataatataaatgaaccactttgttttcattaggggactccatacaaatgcaaacactttgtttaaaaacagaagtatatacagttgtccctctgtatccctgggttctgcatccctggattcaaccaatcttggatcaaaaagattaaaaaaagttatgtctgtactgaatgtgtagacctttttttttttgttttactattgtctacataatatagcataaaaaccatttacataaaatttattgcattaggtattataagtaacatagagatgatttaaagtatatggaaggatatgcataatttatatgcagatattatgacattttatatcaggaacttgagcatccccaaattttggtatccacaggaggtcctggaaccaatgcccctcagataccgagggatgagtttatatacttttccacatggtgatcacaatttcttccttcctgagccttatgcaattagttactatcatttctcttttctgttttttttttaaatcccattaaaggaagtaaccaaacttcttttattagtatctgaattttaatctactatggtgtttggtcataggagaaccagactaagaggaagtgaaagaaatatcatttttgttgccaaatcacttttcaatgcattaagggaaaaaaatgcaaaaagacaatgctaccaaactggtgtatccagtgactctgaggttacccaagttctcagcgctctctacctgttcttcaggatgaaaagttctcagtcccttcaccattttccttttcttcctcatgtgaagaccaaggtatattattccaggaatgattagtgatgttgacccttgtcctcaccaaagttatgcttgaatcgtctttcattgaaaatagggacaagtcccataagaggtacatctactcatcatggaatagatcatgtcaggacccaattccctaaaatacaggaagtcactgtgaccttgtgcttatttagggcctagctgctctgtgatgagaaactccttcacttcccagatttgtgatccaactggctgttcttcctgtaactcagagccacaatgctattctaggaccagactgcaggatattcggtaaaatgccatcatttgttggctgctggaaatatttggctttaaatcagttacaataaaagtccagaccgaagaccaatggccacattttagcttaatcaatactgaaagttaaatacttttatgactttcaattttcttttgcctccaatctcttatatatatgttatagtaataataattagtatgttcagtattggtggatatagtatatcagaaaagtacacaacttgcttttaagagtacaaacaccagtcatgttcattgtaaaacatttagaaaatgccaataggcaagagtagttaaattctgttactcaaaaattttacttttgttaatattttggtgttatatgcttttttagttatttctctttatatttaaaatagttttgtaagtgatccacgaatgtgttccaaatttttcttccttcattagagatctgaacacattattcctaaactcaaaaatctttacttgctttctgttgtgtctatagaataaactcagtctccctggcctgtttttaagactcctcatggtcttttgactgtttccccttaaattttctgatttatactttggtctctgacatatgaataggtgcagttttgggtactgggttcctttgtctcaaatgccctttccccttcattatccatctggctaaggctgttcaaatcctctttcctttgaatgttctcagaattaatgtcttgctttactctgctattcagctcatttatattaagcataattctcagtctttccttaactccatgtttacatactgttttctctactagatttcaagtctggaaggagaggattgtcattctcacaatttgttgtgaagactcatttactgtcagtgttctccactctgctattatctgtataaaggcagggtccaccttcatagctccaatatcatgttcctgttggctggggagagaatagtacaaactcaacaatagtggacttacccttgtgtctttttttttgatggagtctcactgttgcccaggctggagtgcagtggcacaaatttggctttccgcaacctctgccttcctgccttagcctcccgagtagctgggattacaggcgcccaccaccatgcacagctaatttttgtatttttagtagagacggggttttaccatgtcggtcaggttggtctcgaacttctagcctcaggtgatctgcctgcctggggctcccaaagtgctgggattacagacgtgagccaccgtgctctgtctacccttgtgtcttttgcagctcttagcataatgcctagaatatggtaatgcctaagagatatttgttgaattgaattgttattgactgtaagtaaggagcatacatgggctatgtccaaatttgttggaacatttttgaaggaagtaagcttattactctgaaacctattcagtagtataaagcattttgaatagaaatacagttaagtattattccaggtagcaaggtgtattacagagtgttcttagtgacctcaatagccactatcacctttttaaacgttattgttcttactatttttgtttttgtttttttgctcagctggacacattgtcattaagattgaatcaataattttgtcatcagccaccttccaggtagaggattccacccatttgcttaagacccctcaagtctgccttcatcattttgggtatcatgggtctttactatcatttgtttagcttttccacattttgtgatatcttttcagcttttacctattagaattatttttccaagtctacttttggatagaatataattttactgtttttggttgttctctaagtgacattgaaaggtacacactttttatttttattttttactctctccaggatcttagtaggaaggaatgcattttatctttcaccacactgtgtaatctccttggcatcctctcctttatttgttggatttttcttttaattaaaaagtcattccaggtatgttttattgcttatttattctttccttatttactttctcaaaaactaattgaacataggaaagtaaatctttaattctgctaaaaatatcaagactattattgaaatctattcttacacattctttaaaatgagcaccccaaatcattgttctttcttgggacaaatgcaatgaagatagtgtgttagctatgcgatatcatcagtggtgtgcaaatgaggaaaaaaataaaaaaaaaagtggatggttctatcctttcttctaaagactaagctggtagctgcccttaatgttggtggcattttctaagtcagaatcatgtactacttggtacatttagaatgatataagaagtgattgggattaagttgttataaaacatcatgtattttttaaacttgttgattcaatgttctctgcaacccttttcaatatagcctgatcttttatatttctaattatcttgtacaaaaacatatcttgagcacctacctacaatgtacccaacactgaatgtactctttgagtggtacaaatggaatataaggtgttacaatgagaaaatacactaaaatggtttcgcctgcattttctttttagttgcgctattcctgctttcttactgtatgatttcctttctttgttacatagtagattgcctttctctcaccacatttttggttaaaattgacttatgcaagaggggctttgaagtgaacaatataaaaaatataattttcagtcaaactttgagcttcatggttatatgtttttcattgcaatttagaatctataatattttatcatactatatatgccttatttgtgatttggaatttgtacctgaattattttctaaaacaagatattataggcaggttccaatatggtactagactactagtggcaatagcataaacaaataccagttttgagatttgtgaatacacatttcttacaaatttgtggctggtcaaaatgctgactttctgattaattagaagtctgtagcctcaaataagcccaaatctatttattcatgtcatagaggggatacactgagtacttccaaataatttatattatatggaaatagtaacatgcttgccattttttctccaccattttagattgattcttaaatatcacaacattgtacatcattgctaattgtcagaactgcgtaccatattgccatatttacttctatagcttttcctttgtattttaacatttgaaataacttcaagtgaattcattcagattcattcttaattactagattcctaataggactgtttaaggaatgccttatatttgatgtgtggaaaatgaaaggtgatataaaaatgcagtgttatagggtagcttctgtgtaattttggctcactggaatgccagttggggaatggcaaaggctaatactcaacagatggcaaagtcctaaaacctataataatggttgcagttattttcattactgtcatttgaaggcacatgcaataatgtgaaaaggcttgaactgggtaatcacagtaaatatactcaaagggaccagatgcatttcaaacaatcaaaacggtgatggatattcaggctgagtgccacttctgcacatattctaggtacatttattgctagggattagaagcaacattacttgtcacagagaggagctccatttccccttttagtaataacaagcaacaaaaattgacatctgttataacacagacagaatatttcacatcctttatgattgtgtgtcattatcatgcatataaatttagtttgcagatgttcaacgtcagagatcaaaataccaattttgcctacaaaagagttgcaatggataccgaaaatctaagcacttttgaaaatagataagttaaatcttttagagtggggacaataaaaatcaaataagattaggaagaaaaagcatcaaaaggcatcagaaggggctgtgtggaagtttcagaagatcttaatatttctatttgcagctttgtaaaagcaccattcttgattttaatctccagagactgtagtttggagttgttatacatctttgttattttcttccatacaataaataaaatgaggccaacattttttccttgaaagaatctgtcattccagaaaattaattagttcacatatgaatattcataattcttcctgtgtctaatatgtaaaaatagttcttggtgattttgtgcaagggattgggtagcaatgacctacaatgatgctattaaacatagtacaacagacaagttgaccttttcaggtattcagtactcaatttaacatcactgtttgttctatatataatttcctttattacatttaggaaacagatgaacagattgatagaagatgagaggaaaattgtatattttgtagtacaatataaaacacctaagaataaaaaaaaatatgttttatggaaaactcttctccttttccccaccctacgtaacccctaaccacatacaacttcaaccaaaggaaagaaacctacgttacttgtttgaacaatcttgtgcctgcttcaaaggtactgttaacaatgtgatgtattttgcatttgcctctggggatttaccactcaatattaaagtacttcccactgtgacattttaaaaactgtctctttcctctgctgagctaaaaacataatggggatcaagaaaaccatctgaaacaagcatagtataaaatttctgccaggcattggaagttaaggcatggtttttgaccctccttttgtactgggcaaagatacaggactgctgccctctcactctgccttttcaaaagcttgttaaatgaattgcctctgccatattgtaaacttgacatatttgcccagggtctttggttcaaatctaagtgtatatcctcctagtccagtgaatatgtgcagaatgatatttgtaaatcaagacatgatagtgatgctactttctgaagaatctaaaaaaacagaattggtaggaagctgggattagatgatgagaacatatagtttcttgaaaatatttttatttttttctagatatatatttctaccttgaaaagcaaaccactaattttattgattgcttgatttctgatgttttgtgaatataacctattcttagtaaatttggtaatctgaggacatattttattgaataattttagttggggctttaattctagtttttcctgggacaaatatacggttggactcatatatatcctgggaccaatacagtttaaattatagtaaaattaacaaaattaactcgaagtttgaacttgaacagtgtgaaatcacattggaacattttaaatttagtagcaataattggcctatccataattaatacagtacttatatatattattgcttaaataggtgtttaaattttacatgctctgggtgattttgcttaaatgagttaaaagcacagtttaattaagaccaatgagttgctagaagaatgcatttggcttcatacttttcttggatcgtgtcactcgatacagtactcactaactagtggcaaataaaaaagtcaataaattcctgtttccatcaactagactaatgaacttcattagttgatcatgttatcagtataattactacagaccacattttgcccttggctattaatgcaacagacttctgtacttagaagaactgcctaagaagagaactcaggttaactctggcaaataactttgactcttttctttctaaaatcattattatatcctctggaaatagagtatcccatatactcagctatgatggttttcacattgaactgtgggaatatgttgctagacccctttgctttgttataattgtgttggctatgcctttatgggatactgttgtgggttgaaatatgttccccaaaaagatctgttgaggtcctaacatctggttcctgtgaatatgacccaatttggaaatagagtcataacagatgtaaattaagatgaagtcgtactgaagtaaggtggactcttaatccaatatgactggtgccctcgtgaggtgagaagagacacacacatacctagggaaaatgccatgtggcgatagaagtcaagatcagagtgatgcagctgcaagccaaggaatgccaaggattggtggtgaccaccagaaactgggaggaggtaaggaaggattctatccggagtctcagagagaacactgctttgctgattccctaattttggcttctaccctctggaactgtgggagaatacatttccattgttttcagccacccagtttgtggtactttgttatagcagcctgaggaaactaatacaaatttcttacttgaattattaaccataatagattaactacttagctagttaggaggaagtgatcagctgttctcagggataaatggaagtcttgaaagtccaagaattattcattaggacaaattcttaaaaattcagtgattttttttttttttttgagacagggtcttgctttgtcatccaggctgcagtgcagtggagtggtcacaactcactgcaacttcagcctcctgggctcaagcaagcctcccacctcagtagcctcccactcctgattagctgggactacagtgatgtgtcgccatgcccagcctagtggtatttttaacagataaataagaatggaggtagtggcagaggtggagtgagaagagagacaagtaaaatatagaaatttgagggaagtgaaatggccctttctgtatttttttaaaaatatggaggtttgcatcttcttgatttgcagctttgaaaacattgacttttttgtgcgtcatatgacactaataacagaaactaccccaccaaaataccaccacaaacttcacttaaaataaactccaaagaagaatccatttttcgtgtgatatgaatgacaaatgattataaggaattttaataatttatataaaaatccaaagagtcatattgtaagtactgacaggtatactagggagtttttgatcacacttaaaaattacttgtgtaattaggtacaacattaaaatgagaacagggatatatacagtaagtcctcacctaatgtcattgataggttcttggaaacttgactttaagggaaatgactactctataatgaaacaaattttatcccagcttaaatgatataaatgagagtcattttgcttgacatcactgtttacaagaacctatcagtgattttaggtgtggacttattgtgtgcataattcatatattatttaacaatatattaggtccaaagatatatctctggctttcttattctacagatggttaatgtctgctagctaagctaggtaagttaggaaaagcttagaagctcaatacatgtaagcaaataaaaaacccaaaaacatcattttagacgattctttaaccttctattctaaaattatggcaggcactatacgtaagggctttatagtttacattttgtagacgaagaatataacaatcaagaaacagtctaaaaaactggcaatggaagaaagaatgaagagaaacccaagacttagctaattcatgatgttgcctcaaatatcaagaagctggtattatgcaaatggatcttgtgagaggaaatgaactcagaactgagattatgactgtgacgtactttgagacactttcagaaagattgaaagacgaaaagatatttcttggtacaaagcacattatgattgatgactgtttgagggcagttatctttaaactagtattacagacaaaaatcccatcacttgtgtgatgtcctccattgtgttgtagattttattagcctcatggttttatgtgagcaaagaatgatctcaacatgacacaattttaatatattttctcccaagctctcagagctatttttgtctattaattttaacataacagagactgcagttcccttatattttgctgttctaagggagaattatgtcttttattttaagccaggtagagggaaagcatttttgttgttaaaataagtgaggatgattatttttcccattcagattttcaaatcccttggcgaagaaggtattgcattattaaaatttacttgtttgatttagaggtactgcttttggacatggtaagagttttgaactttaattttgatttatttgcttgctagagtgatagctatgaagaattcataacattttattttaaatggaaattgctaacagaaataactgcactttataatcgttttgagataattttggttgcaatttcacatttgactaacagcattagagatatgattccaattaagggaagtagtaaatattttcctttgaaatttctaagaaaggagagcctttctgtgaattaatgcataggttgatatatgcagaaaaccaagcactctccatagcacaagaatgttgaattagctaggaatttgcactgaattagctaggaattttatacacctgtcaacattctcccctttccttataattttctgtctatttccagatcttcattcctcatgattctatcacaggacgtgttagaggagcacacatcactatggcttatgacatttcagaaaacataacttaaaaattcctttgcagaactttattacagaaaaattgatcacatgtagtaaggaataataggatacacaaaaagtaccacatagaacagtacaattttagaaaggggagagaaagaaggagaatatgtatccttccagatgtagatccccagatgataacagggctatttctgggtggtatgattacaactggtttctattttcttccttttgttgattcattccctctaatttttatatgattaacatgtattaattgtgtaattttttttcaacttagaacaactgaattagggtggatgttttaaatcccatctccatagtacaatcaacacactagatatcaaaggctcttttttggaacaggagggcagactgctattaaatattattccagggatatgcaaatgtttaagaggctcaggtgggcatggaacaagtgtgctgggagggtatcaccaatggaatagccattaagggcctaggcagcacttaacttgagtcacaatagcactgggtctggataatagccattgtggctgaaacgccgcttagagttgtactctgtgccaaattcactttacccacagaaattgcaaatgagttatcattctcattttttccttttatttctagttgccacatcattgtacatatttatgtgatacagagtgatattttgatacatgtatacaaattatgatacatgccatgatcaaatcaaagtacttagattgttgaagggcaggcagaagactacatgatataatttgatgggcttttaaaatgttcccttacccccaagtttctctcaatcggctggccctagggttttcaattacctctgtcttcctttgggttaaatcactgtattttgagaaaatgtctttgaaaatacttgcgttacatggtcaagaccaccattctacagattacttgctaaagaccaaatctctgaagaaatgagcataaagtaagaatattgacagaggaagggagacagagaatcgtttggattgttgatcactatcagtagcaataggtgatgaagtcaaagtggagggttttttcaccaggactcagtgtgaaaatcctaagtatttgatgtgaatttgtgaaggaaggcactgaaatagggaaagaaaaattttaaagcttgctctgtacagttaaaccttgtggcatatttaacaaatatgttttcaataactccaatgatctcttggtatgttggaatgcataattttgccaaatttgcataaagttcatggtaaagtgatgataggagactttggttaggtagtaggtgcatctatccagccactcagcatctctttctcagcagggctcttttgtgtgttcttggtactactaagtctagagtaacatggagaattgtcctacaatattcttagcagtgaaactttaggcaattaatttgtaatgtcagaaagttcccagcgtgcatgtaacactagaaggaaatgtgatttcagaatgagccagatgcatttataaatatttcaagattgtaaatttcttgaagtttccagagtaataaagaatatcaagaactgactctttgggaattcaagttgttataaagctaattgaatatgtgaaggcatgttcagtgtttgagttctttttctcttttttttcccttccccttctttcctttctctttctgtcatttctccctcttttctttactttacctctctccatccctctttctttttctttcttttttttacattctccccttcctttcttcctaccttccttccttccttccatttttttttctttttctgccttttgagtatttatagtgatataatcaagcagctcagggaatttggctgcaataaaggctgttttggtgactccctgcttctcttttcttctctcaaacatagttttgagaagaggagatatagtgctagtagcagcactcaagagacacttgattaaacttgaaattttataagcattccaatgctattacattaaatgtatataaatactgacttggccagttttgccaagagtgaattaataagcattcatatgtgctaagttataagagagtctaatcagttctgcattctaacattgccttttgcttctactcctgttacagtccaaagagaatatttaaaagattccatgtttatattcttatttcttgatattagaccactacttattttgttagcattctgtcttcacagtctgtctcattcattcattatacccttttcctggcctggtatcattaaccttgctttgtaaataaagagagacacagaggtcagccttcttggcgagtgttttgtctacttattgctattgctgatattagataaaaatattgaaaaaatgcagcttcatttccttgtttaccttacctgaagttaggtctcaattatgcaccaggggattctatgctgcagtgaaactgctttgttgggtaggatgtgaccagggaatgcagactaactttcaattttctgtgaaaaaataataataaagatggtcagtgtgttgccaaactatagggatatgtgtgtttttacttatcactctgtacatgtgtatccacatttacataaccatgtttgagttttcatgccactactaccttgagtcttccttaatatataggattcagagggtttttttttcaatcattatctccattactttcacatagccaatttcaataattatagtcatgttttaagttttgcgcacattttcttttagccagaaaagctccattttaaatgctagcaaatccagtaactcaaaagctttcaaatatagtctattgtccagggctttcgtggtgcatttcaacaaagagaatctctatgctcactcaatttgcaaacatctggaggaaaataatgtgataattagaaggcaccatgggttcatcaaaaacaaatcatgccaaactaacttaatttctttctttgattccttaacaagctgagtgggaacacagagggtatttttattatagtaagacacttgatgtagctttctaacaatcttaaaaggcttagggaaaatgcagattagggaaaatgactggttaatgtaggatatctttgtaaaaagggaccagcaaccattatctatctatggttcagaatacagttagtagaggctgttggataaattttattttatttattgtatcattcaatatcttaagcctttgactttgattatctatattttatatctcatagtgttttttaaggtaactggctatagggattttatttttaactaataacattggtaatttttttctagaaaggaacatatatcttggccatcttttttcattaaaaatctatgaaaatcatacacacacatatacatataaatcacatatagactgaacacacgtgtatatataattcataaaattatatcataaatcataatcttagtttcaacgactaatattgttttaataactgttcttatggttttgtgtctgtccataatgtttttataaaagtgagagtatactaagtttactatttctgatttgttttactttaatagtatagtgttaaacacagtcctaagttgataaatgtacttttacagatttatttataattattgcatagtatttccgtggatgtgccataatttattgactcgtctccctttgttagatagattatatctttgttgttgtttttacaactataaaatataatggaatagctatacttgtagttaaaactgttttcttatacggcatatacctagacattgtattattgggtaaaaaatgcaaacattgtaagaattttatgtgtgctctctaaatgccttccaaaaggttgaaccagtttacattcctactggctgtttaagagaggatgctatatatatgtattcatatctatagacatatatgtctgtatgtgtatatatatgtagatatatgtatatgtctatagattttatgcatatgtctatagatatggatacatatatatacatacacgtttagaaatagacatacatgtgcacatataggtgtatatgtcacatacacatacacatttagagatagagacatatccatatacatatatgtaggtatgtatatgtctatagtttccatttggaaaaaggaaagttcctctttgggaaaaatgaaactcactggaaagatttaaatgataaaagttgccataaatattttagaaactctatgtttgattatgcagctgtgatgaaagaatatcaaaatataggcttaaattgacttttctcctacttctctgtaaagatttatcaaaaggagagattcattttgtggcagttattgttcttattgaacatcctgaaataagaattattctatgcctcaaagtaacactaaattatattctttgttaatatattaaacaagcaaaggtcttttaaatggtgtttgagattaaagattctgttttgtattttaattctgcagcaaatacagcttcctagcttctactgttagttggctctgatttctaattctcatctcttctttctttttacttgttgtgcctcattacaatttcaaatgaaactgtatgacgctgattggaattgtttctattgggggaaaatgtacgaattagatgtgcccaggaattcatctgcatttgagccctgctatttgtttgacacaatgggttttcaggaatgggattgcgggagctaaatctttaataaaattgttattgactgtccctgcaggaggcagtgcgcatggtggctaaacatgaggattcaaaccctcagctctgtagcttattggctatgtaattaacctctctgagtacatttactcatctgaaaaatgtaatgatacaaacctcttaaggttgttgagaggattcgatgggataatttaaatgagtacaggggacttagtaagctttcaatagatgttaggtgttactgctatctcttggtgatccacacttccctcagatgggagggcataatctttcctatagctattgcaaaaataatctgactctgcttgtcccatattattgcctcattttggaacaattatatcagaatctgtaaaataactattatgtcaatattttcctgcctgtctcccttccctctttccttctttccctttccttgcatttattgagaaccaaaggtattctatgctttgctaaagattggagaaggaaaactgataagaatcatattttgaagaaggtaacacaccagtggagaagacagatgttaatcaggtaatcacataaataaatgtaaaattgcaaggatgacaagtgctacataaatgacagctgcatgggttataagagcatataggagattggaaagacttctcagaaaatgaaacagggaaataaagtataagaggtaaacaggtgaagcagtagacttctacatagtctccctatttttgccgttatcttcttaaagcttattctccgcatagcagccagagtgaccacattaaaatgaaagatagattatattagatctctgctcaaatccctctcatcatgacttcattacatctcactcagaataaatctcgtagttcttattttgttttatagacccctatgtgattggtctcctgctacctttctgacctcatgatctttcactctcttcttacacagtcacgttcaaccacactggcctccttgctgttcttgctgttccttgaacatataggtaaacttcattttgaagtcttttgatcttgttctctgcccaaacactttccccaggtaccccctcaccatatcagtgagctcttccctgatgaccctatagaaaatagcaactctgtctctatcaggactcctcattgcccttatgctgtatttatcaccatcccacattttataaatttacttgtttattttttgttctccctcgtcatctcgactcaacttgttaaaaacatcatgggatcaggaggttatgtttactgctgaaatcccaactccaagtatagtgccttgaaggtactaggaactcatttaatatttgaggaatgaattaaggaagaagagacatggtggtaagagcatttaggacagagagcgaagcatatgtaagggccccaaggcaggtagaagcatggcagccaggggggactgagggaaagacattgttgcttttgaacacagtgaactaaaaaaaagtgtggaatactagaggcaaaaaaggtaggtaaagactggatcatacagttataaagattttcccctaaaaacaaatacaagctactgaagtattttaagttgagatggggttgaaggaccagatcaagtttatgttaaaaaaaaaaaaaaccactctggctgaagtatggatatcagatttgaggggaggacagtgtgaatgtgagtagatcaattaggagttcgttatagtagttgtgccaagagatggtgccagcttgggccactggcttcagtggataagaaaggagcggattgtttgagagcagtggttctcaactggagcagtatttgacaatgtttggaaatactttttgtcattacaattgttgggggaaaggggatgtctactggcatctattgagtagaggccagggatgctggaaaccatcctacaatgcgcagaacactctccaattatccagtcccaatgtcaatggtgttgagattgagaaactttgttttagaggtaaactcaagaactctcttcatgaggtacaaactcagaacttgctgttggagtagacatgggagttgagaaagtgggtatttcctataaaagaaaggaaatcagtatatcaaagagatatttgcactcctatgtttgttgcatcactgtttacaatagctaagatttggatgcaacctaagtgtccatcaacagatgaatgaataaagaaaatgtgatatatatatacaatggagtactattcagccataaaaaagaaggagatccagtcatatgcaacaacacaggtggaactggagatcgttacattaagtgaaataagccaggcacagaaagacaaaccttgcatgttctcatttatttgtgggatctaaaaatcaaaacaattgaactagtggacatagagagtagaatggatcagaggctgggaaagatagtggggagattgggggaacatagcagaggtacaaaaaatagaaagaacaaataaaacctactatttgatagaacaacagggtgactatagtcaataataacgtaattgtacgttttaaaacaacttaaagagtataatgggattgtttgtaatttaaaggataaatgcttgaggggatgggtaccccattctcaatgatatgcttatttcacattgcatgcttgtgttaaaatatctcatgtactcccataaatatatacacctatgtacccacgacaattaaagtttttaaaaagcaagtgggtacatctcatgtaacccaaaatatatacatctattatgtacccacaaaagttaaaaattttttaaaagtaaattaaaaaaacttccagatttggggcatgggtaactaaactgatgagtgtcactcgccgcagggttcttctgcccataaggaattatgatttctgtccaacctacatcttttctttgatgttaacaacactaaccaaaagggtagaatggatactcatgtttgtactttatgatctgggcattttgggatctattttatggtattagcatggaggttaggaaatacaacatttaatttgatattttcactcaattatctgatgccactgattcatctgactgtattcatacagctgacatctgtggcactaattctcagagctggcttcatcaaaatagccattgaatgcatcttttagggagcatcaacactgtgctaagaaaatcttggatgtttagccaatgagcgtaaaggtaattaaatattttattaactttgtatataagagctcaaagcactttcacatacatttttccttcatactctttatgtgcttgtattggcagaaagaggacaaagtagctgtattgcattatagcacaaactttcaggcaatgagacattcctgaggcttaaatttcacttgcaaactaggagaagaggtggaaaaaaggaatcagaatttacccttttgctaatgcattgtttccttagaaatgtaatcactgcatcattctttcattttgagagccttctgagattatacaagatatttaatccaatatctttatatgttgaatctgcataagaagaactggagaatgtgtgttcttttttattttatttgtttgaatgtatgctaaacacactctacagaattcaaggaatgctaattatgtgtgctgcaattgaagttatctggacccagtttttttctcttttgctgctgcatttttcatggcaagaatctggtagaagatgaaaattataaaattgaaatcttttcagtttgtgtgttactatttttaagcaggaaaagtttagtatgtacaaaagagatggtttcagtgaattcctgtgacattaatgtgctattttctctctctaagaaggaagttgagaacttgagcttgattttaggattatgtctgccctggtacccttggcgaacgtttctgcttttgccatgtgttcctggcatagttttgaggtggcgtgcattttgaaggggcactgatttgtgtttgaaagaaattaggtcctctgtaatagtcagcaatccctgtcttatctccttggttcagattggcctctaatcttctattacctccagttaacttctgcagtctgcttctattctcttgttaacatttgttgctgcatctgggatgaagcttataattatgtgtccattgccaactctttactagagttttggttaatccaggtcttattttgtttatgtttgcttaagcaaatgatgttcaatgctctttcagatatcctttaaagtaatgggatcaataatttaagcctttataagtatgcatatcctggctaacctcattttacccatgtgtctgtactgtcagttatatttacattgagcaacctcactgactcttgtggatttatttaactatgaagcaaaataatagttataaattcagtatgagaaagtattacagatatcatgtcttatcttattctccagcgtattttttaagtgggaaactgagtcccagagaaaaggaataattctctgcatttgtaataacactctgtagtttacaaaatatactaataccattatttcatatgatgttttcagtaattctgtgaggtgtgctaggaaggcattattatctctattttacaacaaggaagaaaagatgtagagaaattgagacttgcttcctcaactacctacaacaagtatgtggtaaatctggatctaaaatccaagacttaaggctgttaaccaagtgtcctttcccaaatatgatcttggctcatgagcagagtttttccatccacgtactgctgtgctgtaatgtgttgagatactgactctctcagcacttagagctgccagagtagccgttgacctctagtcacaaggatccttctcacctcagtgcaacacagaactactattatcttctgtgtacctcgacattgaaaaaacacagaagcacagttctaacatataatggaaaaagacctgattaagtcactcagtgagtttattgaaagattactaggtgcctaacagtcctgggaatgttttcacagtctgcattcatccacctctgatactcatatatatttacctccaaggaacctccccttcctaccgacagtttgtgtggttccaggaagccagctgacaacaattctgacccaggttaaagatgtgggcctcagtaagcctctgtgctgcctcttcttgtcatggtgattagttcaaggggaattatggaattcacccagagccaaccagatctcatgagactgtgacttttgggcaaaagaatattgctactgttctgtaacagactctggaagcatgcaggctgaggctgctgccaccagcctgactcctcatgtagcttaagattgaagccaatgctggaattaaggagatctgagagagaaactgagccccgctgataccatttgatgtcaagctgacaaaaaagctgaagctaattctacgctttagaattatacgaaccaatacatttctcctttccttaaaatgattagatgaagttaccgtcactaaaaatcatctgtattctttcataaatggttaaaaattctaatttgtcactttaaaggcctcatggggacaaggacgatttagaaatggatgttccaatttgatctgatctcttccaggttgtatgtttttcttctccctttgaaaaggtaattcataacctatgaataaaaacgctctctctataaactttcacacaatctaaaggtgtttttgtcatagtcagttgcctatattaattcatcaaataattattgttatgacactgaggtaggctggggaagaagacatcatctttgctgtcaaaaaatttataatttagttggtagaaaaaacatgttataatggaaagaaaattaaatttaattaatgtatataactaaatctgatgtgagtgtcactggagtaggtcaaaagaggacaaggtgccatagattcaaaagtgatagtcaccatgaaagagagaactggagtcaaatctttaggatttgggcaggtgaccaggaagaagtctgtccaggagctgcagcatagcacagacaaagactcagacaggaaagaatggtgtttgaggaaggtagtgactcaacaagatgggttgcagcagaggagttagggtgagcaacaggatagcttggaaatttccatctttgacttttgagaagaactttgggacaaagctctttgcttaagattggtattgagaaacaataacatgctagccactcttttttttttttttgaggtgaagtttcactcttgttgcccaggctggagtgtgatggcacgatcttggctcactgcaacctccacctcctgggttcaagcgattctcttgcctcagcctcccgagtagctgggattacaggcgtctggcaccacgccggctaatttttgtattttagtagagacagggtttcaccatgttgacaaggctagtctcaaactcctgacctcaggtgatccacctgccttggcctcccaaggtgctgggattcaactctttattgagcacttactacatacatgacattaggttaaaacttcacatgcattatctcacttaataataataactttcaggtaggtattattgtacctaccaaccaaccctgtaagtggatgaggcagaatgaaccaaggacagtctgcctctgaagaccgtgcagttgctctggccatgaaattccatctgtctaagatgaacagagcagtcactttgcacatgtcatgtaagtttataatggtcctctgcacatttcggtgagtattggtatttttggcaagtttaatattcggagttactactagcaaattcttagaattactagatttcaggcatttagaaagcctctattttaccatgaaattcattgttatttattctacacttaaagcaagggagtgaaatctcataaattagattgaagtaataattattaagaacatcacaacttctagggattgaattaaagtatttgcattattatttcatttttccccaacagattgtgaatgaggatgttgttattccctttgtatagacaataagactgcgatcaaaagtatttaagtagcttatacaagggcatataattagtgtgagcagagctgtgacttgaattcaggtccttcaattataagtctagttctttcccaactacattagtctataagtggccaaaaagtacatatgaaacttggcattttatatgtattggagttacattagaccttaagtggccatagagtaacaaatgagacttggcatttgtgtttactactagtgagtgtgaaaagcctaagtaattatcaaatacgagggataatttgacaaagttaagtctcattcaaactgaaagtttgaattttccatttgtctggttattctatgatttgtcaacaagtcaggataacaaatatttattgaataccaatttattaggtaaaagtatatgctaatgtaaaaagaactttgtgcaaacgctacactaatggaatagaaaatatggttgaggacaaggcgaaaacctatacagtacaagtgcgagtaatctctgagaaacgattaaatgaatattttgaggtgggacataactaatatatcataggaatattaaggactatgagtgcagaggaagaaaatatttgtagctgctggagtggtcttgggaaatgttaacatgaaatttattgttattaatgaaggaagtatttgaactactccttgaggggaggacttggagaaatcagaaagagcaaaagcagagtggtaaggaagtatgtggtgtgctccagggagcagtttgtccagaaccaatatttaaatacagggtaaaatcacagaagtgggtcagggccagcttgaggaagtcttaaagaaaaactaagaggcctgaatttaatgatgcaggagggattgcagtgcagggctctgcaggtgcagaggagtggagacagggaagactctgggagacgaattaaaacaggagaagagtagagacaaaggttcatttgttatagaaaatactggggaaattggatgaaataactaacacaaactacaaagtgattggaacaggtcaggtccccacaagttaaagggggaagaataaatagataaatggcatttcaagtaaacaatcagacaaatttaatttatctgacattctgtaacacaaagtaaactgtcatgaaaactaaatacttgagagaaaaattaaaaagataaaagaaacagagtaattaactacaaacacaacttgtaaactgtgatcgaatcatagttaacaaacaaaaaaccaaaagctgggggactagcagagagatttgaatatagactggattttaggtaatattaatgaactgtcaatttttagttttgataataattttgtggtatagtaagaaaaagttcttatttttaagagatatatactgagaagtctcatatgtgccttttattgtcaatttttttctgcaaaatatatgtatatgcatatgtgtatttttatttgtattctatctgtatctatatttacatgtaaaccttttctatggctttgtatgtatttatatctacattcatactcagacccatactcatagtcaccccatccctatctctgtatatgtagctagatccagatatggatctagaagaagtatatgtgacataatgttaaaaaatttttgaatctagtttatggatgtacagatgagcaacgtgctattcttataattttttggtgtgttcaagatttttataataataattgagctagagggaagggggataaataggtcaggacttggagcctaaaggagaagcagtgtgagtggaaaggaggagcagatgtgcagtgataattggtagcacagggtgagttttttaacccaaagcatcagaggagcctcttaggtatgagttttggcattaaggccttactgattggctgtggccacattttgaataagggcaggaatgtctttagagaaagtaagtttgagggagagaatgtacttgttttcagatgggttttgtttccagtgaatatgagctttccaattgaaccttgttggaggaaggttgtccagactctgagaagatcagagctagagatgccaattccatagtcagacacagcagatggcagtcgaaatcatgaaattggatgaaaattatgagtaaagaagtgtgcaaaaggaaaactgagaaaaaccctaagaaatgcccatatttaggtggtggaaagaaaaagtgaggagagcaaagcagacaaagcaggccaaaccagaagggaaaagatagtgtcatgtggagaagtggagggagcacacagcccatggtgaacacaccatgcatctttttgaatgaatgaatgaatggagttgtacaaaagagtgagggtcattaaagtaaagataaagagaacagtaaagacaattgcagagtgaatgaaaggcatttgggattaggagttgagaggttattttaaactcagactaaaggtttggtggaggctgttgcaatggttcattgtggaagcaaaagccagcacgagaaagtggggaagctgagtagtagagggctcctcagtgcagtttggggataggaagacctggattcaagtcatgactcttaactctataactgccttccctgggcttcagttgtctatttccctaaaaaagtggggtaggctaagtgatgtccaacatttcttaaagcactcacattccactggcccttcagctgttttaaaatatatatttagagaagactgtcccaatccatattgtagtgtcattttcagcttcctatgtgtcacagttgctttgactatagagtccctatgtagaaatagaattatcctattctttttttggcaacctcactgatttacaatgaaattattggaatggtcaatagatacatccatatagcattttgacataagcaaaatgtaacttgactgaatagtaaaataatactgtaattttttatttccaatttcaaagattattttaaagaactgaggagatgatatattatgttgctatgcattggcaatttctggtaggaagttagggggaagatcaactcaaattctgaaactttactccattataaacttttctacatcctattagttccaaatatgcagaaagggattgtgcagatgataccattctgcttaaatgacaaacctggaatgatgaatgcttttcctggtcaattaacccctgccaaagctctcagtgactaaaagaaatgctgtggaacacagtctcaagtagactataaaatatacaattagaggtcttctgaagaggatagtgttccattagaaatctaccagctccttttaactctatgggtccctatttctcagaacttttaccagaggtttgttcagaaactggctcatcaccagttttcttaacaaagctttcagatctttgttatcacacaaagagataaagagtctgaaatcctccttatgattcaggcatcatctgttatcctagatcaatgtcaagctaaagatttttggaaaggattttggcaaagtgtaattgtagattaaccccacagccttccattagataaatggcataatgggaagtttcaaacaatgagtcagaggactgggctctgatcttgagaaagctgattttctctatgaccttcaattagttatataatctttttgtctgtgaatcttttatctaatctgtgatatatggtaactacttttttgtttgttggttgaggactataggaaatacaagatgttattttttctcatatgttgggaagacccattctttctgcatttcttctaagggacctctttctccttaagcacgtggacttcactggcaaacaaaggatgtatttaacctgatgaggaaagtcaattctgaaaaaaaaaagaacattttaataaggaaagtgctggtagtgacctcatattgagtgtaatgaagcatggttggatatacatcataaattatgcatctttgggccttagtctattccaaactgcaactttgttgaacctcatggactataattctgatgtgtcagtgggatatactcattgtcatgcagtttactttttttttttttttggcaacttcaaatacttaccttactccagatctaactttctgctgagggtagcttgccacccaccttggattccattactttctcactgccatgagggactcctttccaagcacttgaattttcattttttttcttttaaattactccttacaatgactgataagagataggattcattagcacactttgctagtactttgtgctaatattacactgaagtcaggtcatatgaaatcaaagtgttctttaattgtccattttgcacattcaacatgttgcatatggcccttcaggatctggtccttgataatgtcttctactatttttaaggcatatttcactctgattttatgccttaataacagtaaagtagtaatttctcccatgcgatgtggtgtttatcacctgcaagccattatccatgcttctcttattcttgggacactttttctgggcactctgcctacttaccttctattcttcctatacacctctgctcagactccctctttaccagggtctttttcctgacatcctcattcctttaagcataaggacaaagagcctctctgggtgttctttgaatatcctgtgaacgcctctgactttatgcccccaccttgtttatatttctgtttatgtctattatattaattagacaatgatattctgcagatcattccaatacccagcccagtgcttggcacacagtaaatggctaatatacatttaagtgaattggcctacttggaagaagaaaaagattcagattagtggccatttttatgtatatttgatgtccagcaactattatttacatacctgggaactcatgcatgacctcgggcaaggtaacaagggaatgctcattcggtaaatgaggcagaataaaaaactacttgttagtctagaaattaaggccatatatagataggcaagtctatatgggaggagaaaagaactcaggggaaataggtaatgaaataagcctcttaaatatgcaatgttcttcagttaatatctcatataaaacaaagaaaagacttccaagccttcaatattctaagttgccatggcagcagcaccatcactcttggctctttgagtagtaggatcgcagggggagaaaggcctgacactagtaggcagaatgccaaggggctgggagaggttactgaagcattttattactgacactgaagaaatgattatagatcatgaagcaggagaacctaccataccgtggcaatgagattcattggtttccagagagttgcattttgacttttaaaaggagattttaaaaaatgatagtcaaattgcacttcaatggattaaaaaaaataaccattttaaaagcagaagggtagaagctgctagagagtgtattcaaatccatgcttcttagcaaccagaccagatttcatccataaaagaaagccagaggtacaataaaaaaagcctctttggttctctagagaatataaaggcatattagaaaaaaagaagcactttgagatctgtggataaaaggcactatatgggcataaagtatattacaaaaagagaaggacaaggaagaagtgatgtctagactgggcaggttatcttgggtacgtatgagaataattgccaaagtcaaaatgagagatcatgacaactagaatcattagagtgttcagaagttagtattattttaaaacataacagatatatattttttcctgaatcaaagcaaaataaatgtaaagggaaaatagagaatatgtggattacttagtaactacatactatttcctcaaaagattttcacagtgaagagaaatgaaaaagtgcaaagaaaaaacgtcactaacatgttacagagtttgatgttatctatcttcgaagtttcagtgaaattctacacagtaattgattctttctgattcagccaagtaggaaacattagaacattttatgcataggtgtttttttttttttttagataatgtatggttagaagagtcatcacaaacaaaaaagcaaaaaccaaactaaaccaaaaacccaaacccaacaacaatcaaacatttaagaggaaagtcagggacaagaatgtagtttctggtgataggataagaaaaattacaagttaaactagaactctcattttctctaaattaagccagccctttttgtgtatgtataaaaaaaaaagaactggggggtatgaaagaaatgattcttttcatgtactataatcaatgcagagattatcttcaggaagattcaacaatgttcttgagtggtatacaaaaagcctgatgtatttgaaagaaaataaatataaatgaatgttttctggataaatgaagaagcaaagcttggaagtagaatgtgtaaatttagcagagatttgacgcgtatgtttgaacagacggtggtgcagttgttctcgtccgaggttattttatgaaagctgcattttcccttgaagccagaccccgtatggggttgagatgacgaaagcctcatgtatctcactatcattaggctaatgagattggtcaaggccacaggcattctagatcttggcaaaatttaagataaatctagtaaattcttctaatagctttgtgctgtttttggaaagaaggagaaagataagaaatgaataaaaacaaattttcgaatacaaaagattccatttctgaaatactgttccattatgaaaatgattgatattaagatagattatttacccccattgttataaaattttatggtcacagaaataatttaaaccaggtatttgtaaaaaatccaatatgtaaacacaaatattaggaacatttgttttttaagcattccctttgtacccaaaactttccagtttttatagtgaagagttttgaaaattatggtggatggacattgaaaatgggttagtttagctgtgaaaaagtttatttttgagctgagaccaactgttggaaattatagacaatttgtaactactaagaaaagtgaattggtgggagccataatgaatgctttctgataggaggcttataatgacttacatgcagttgggggagatatttcatttaaaatctttgggcaggttttcatagctagttaaaaataatgcaaactgattttaagtttggtgtgttaatattacaagctgttatgtatataagtcatcgagattactaaaattgctctttatattggtaggaaataactccatagtattgtctgtaaagtagaggccactgggtgaaaaatgctttgattgctgtccaaacgctgaagttataatacagtgcagagcaacgcccaataataaatggaagtaccatctgcagtatattacaaatgagtcactttaaagccttgtgtgggactttttaaaacacagttgtagctgcacaaagtaaagtggggagtttagaaattgcctggtgcttttatcagctcaagcagctactatagataatttaggtcctacaaccttttgcctctgtgagaattagatattcttggcctgaatagcttatatatagctttaagttcatatatctcttgatttggttgtactgtgctaaagaggccaagatgggtggattggtgaacattttactcccccacatttcacccttgggtcttaagaaaaaagcatactattaattttgccagaataacttctgttgtaaggcatactgatggttgttcagacgcatcacgttgacataatactatgataatagatgccatcagagggtgacattctagttctgggtcctgtgcttcattaagagacttcacctggaaagtttttcctactaagacatgttctaagatataataattaaattattattgaatttaattcaatccaatactgaaaaactaattgaagaattaaaactgtacagtgttttataatgtctcactattctcaagatatttaatgatacattttatgtccaggattggatattgtttcaggtgcaatgcttcctcatgggagctcccaagttgcaatacattcccaccagtgctccccatgctgaccaaaggaaaacaacagcaaagattttgaggaagtaatgcaaacagaactaaagacagttggcataacatttataaaaatgttctacaagcatatacgtaataaaatccatcattcaacattctaagttgtcattttacgaggaaaagaaacatgcccaatgtaattaaaactactgaacttttatgtcttgagtttttcagttctcttgttgcctttgatactactgagccaaagtcaaactattgaagattatgcataatttgacttcactttattgtttgaaattacaaatgctgggttttttctccttttttaacttttaacctttaagttcaggggtataagttcaggtttgttaaataaataaacttgtgtcatgggagtttgttgtacaggatatttcatcaccaggcattaagcctagtacccatcagttatttttcctgatcctctccctcctttcaccctccaccctctgaaaggcctcagtatgtgttgttcccctctatgtgttcatgtgttctcatcatctagttcccacttataagtgagaacatgtggtatttggttttctgttcctgtgttagtttgctaaggataatggcctctagtgccatgtatgtccctgcaaaggacatgacctcattcttcttttatggctgcatagtattctatggtttatatgtaccacattttctttatccagtctatcattgatgggcatttaggttaattccatagttttgttatcatgaatagtgctgtaataaacatacatgtgcatgcgtctttataatagaatgaaaattaactcaagatggattaaagacttaaatgtaaaatcccaagctgtaaaaacctggaagacatcctaggcaataccattcaggacatagggatcgggaaagatttcatgatgaagatgccaaaagcaatggcaacaaaatcaaaaattgacaaatggaatctaattaaactaaagagctgcacagcaaaataaactatcagcagagtaaacagataaccttcagaatgggggaaattttttgtaaactatgcatccaacaaaggtctaatatccagcatctataaggtttttttttctagtatggtgctaataataggattagcacttttcaacttttatttttgacagctttgttgatttgttttattcttagtatgtccacgaaatgaccacttaaaggattttaacagttttcggtcaccacaatgttgatagcacttgcaggtgctgtggtcaacatccagaaagccatggattattggatattccaggtgtcaatccatttaattctattctattctttaatttctaacattctcttattagaagcaagttataccttagaagtgttgttaggacacagcactaaaaactataattccaatttccatgtgtctttattttatttcaaatgtatttgatcaagatgagtattacatttttgtaataataaatgtcctcagttttctggtctgaaggaggacaccattattcatgtgtaggttatagggtattctttactgtgcctgagatagctaaaatattgataaagatttagagattcctgtaagttcagctttgagaccttatgtctgccattcagggagcgtccatcagatggctgtggtaacttgaaaattgccatatacttccttttctctccaggggctgagtgtttactaataattaaaattttcttcctccaattaatttatttaaaataaatatattgaattaagaaaatcttatgatgactaaccaactaattttagcttgaagcaagattgaagatttaaaacatctcatggcttttccagcagtagttttctatcaatattttatacgttgattgcaatttacttctatattggcattcttgattccattgcttacctgtttacattcaagtagatgtataactttatgtctttggctctttttctctggtagcctcatttctgactacttcgagggttgcttggcagtggtgagtgggaaatcagtcactttaagggttatcctttgatttttctcacttatatgcttagcggctagtcttgtctatttcccaaatgcagcaactggcacagtgactggagcatggaatctgttcttatcgccttatgattcttctgaattagaaagcattctcctcaaagatggcagctgtgtggctagctttctccttgtaagttaatatactgttgccttaacttactctcaaatttcccctcccatgagaatttccgtggtgtagagctgtaattgtaaagtagggcttctaaggcccctagaaatattgtagtttgttagaagattttgaatatatctttctagaattttattgaaccacagtctacttagatgagcattctaataatcaagtacctagtgaaaaggaaacatgacaaatatatttttggggcagattatttactgctctgtgcattattacatcacttcagccacaagagtatggatgattctttttcaaattgtaattaattcatgtgttgagaatgtgggaaactacttcatgaaattttacaaatattatcagtgatgcatccatgtgcttctacatgcaaccaaactcacataaaatcaattaataatgaagttaatacaaccataatgtatcattaaaataaaagtaacaggccgggcatggtggctcacgcctgtaatcccgtcactttgggaggatgaggcaggtggattacgaggtcaggagatggaggccatcctggctaacatggtgaaacactgtgtctactaaaaatacaaaaagccggatgtggtggcatgcgcctgtaatcccagctactcaggaggctgaggcaggggaatcacttgaacccaggaggcggagattgcagtgagccaagatcgtgccactgtagcctagagacagagcgagagtccatctcaaaaaagacatccttgttgatgatctcacaatagagtttccttctttagaattatgcggatgtgaaagcgcacacacattgtactacagtgttgcgtgacaaccgaatttctcagtagaatactgaatttcagcctcagtaagctctaatgatcttctaacattcatttataaaacccaaactttagaaacacttaacaaaccactcaacaggatgtttagtaacgtttaacaatttgcaaaaaataattgccaattacccagaagacctgaaaaaagaattcgtaatttttatacagcccatggttcatcaagctgaaccttgcatgagctgacaacaatgcatgtttgacagtctctcttgagttgaaccctctttttgtggatgacaaaactgaggtctgcggaaggaaggttcttgtcagttgtagtaaagttaaatatttttcaattttttgtgtgaagtatttgcttaagaatttgaagtccaggttatatgctgggccagtttccttatttatgaaaacacctttgcttaagagcatctgtaaatagagatttcttcctattatggggtcatttattccattatagggtaattctgattgtttgaaagttgagtctgatgtgaggctgaaatcgaatctgtctcatgacaatttctatttattttttcatttcctggtgatgtcgtttagctgtgtccccactcaaatctcatcttgaactgtagctcccataatccccacgtatcatgggagagacccggtggtacgtaattgaatcatgggggcgggttttcccatgctgttctcatgatagtgaatatctcatgagaactgatggtttcataaagggcggttcccctgcacatgttctcttgcctgcagccatgtaagaggtgcctatgctcctccttcaccttccaccatgattgtgaggtctccccagccatgtggaactgggagtccatttttacttagtaaatttaatttactttgtaaattaagtcttttactttgtaaattacctagtcttgggtatttcttcaaagcagtgtgaaaatagactaatacacctggataatgataaggtttgttttgttttgctatcatactcatctgagtgtttcaggcctatgatatggccagatttgcattaacttacaaagcaagaggtataaaattctttggagtgagttctttcttctgcagttatctgcatggtagagattgtccagaagagttttttttttttttttttttttttttttttccaaagagcagcctcacttcaccatgtgatttgctttgagatggaaatggcccaggaaatgatagggtttatatctatcttcttacttaataggaaagcatgcagatgtaaagaactcctctctgccccaaatctctgataatttccccaagaataagtattgagaactccagaattcagatgtttcaactccttcacaagacacttttaaagtacttgaataataatttctgtataactttctgctgtgtgtagaaatgactcttttgcttctcaccattgacatattactggaagtgcaaacaacatttgatgatgtagctataatactgggagttttgaacaatagctatctctaatcacatttgtcaaaagcagactagagatcttacctgtctgaagttgtcaacccgtaggccatttttctagaggcaacctaaagtgctgaataagatttgcaagtggaaaaaaatgctatgtcaccgaggtagaggtaagcttggagcccaagtactgtgcataattcttcaaaggttatgagaatgacagctattagcaggctgaaggcacaattctttaagaactaacacacagcagtctttgttgccttttgccctaaaatctcacatcacattctatttggttagacagctattgaactcaaaagaacttcagagtttctttcaagtttcttttcctacctttctctttttagtggtataaatgcattcaatctcttgggcaccctttgaattattttattaaattctgcaagatcttagtgattggtttctggtatttcctccattatcaagaccactgctaaatcttaagggcaatgttatgggtatagaaaaaagaaaataaagatgcatcaagatagatatgttagatagagaaccatcactcaattacctgccagaacgttggagagtgactgtgatgacaccgggtctaaaagcatttgaaatatttaaaaagaaatgtaataacagatcaaccccctatagaaatcgtattttattctactgaattgtttcttggaagcatttacgtctttaaccaatggaaagatgaaacagctttttttctttttttgacaattaaaaaagtttggtccaactgaatttagaatatatacacttggatagtttgcccatttgtttcagctaactggtagggtttttaaatgtgtactaattgtacctcctatttatagaaaaaaagtgctgttctttgagagagagaaagaatccaggaaatatgatgcttaaaggtaatgtctttcactacacccactgaaggtcactttatctatccaagggtaaagtttttctttctctcttttatttttattgaagttggactgcagcctgcatagactttctttttcctttaaagatatcgttttccgcctaattgtgcccagcttcatttataccctgaaaaggattgtgtttgtgcttacatactcaggagactctttcactcaatagccaaactccagcaacagccctctgggatatttgagtaaatgtaagtgaaagttccctgtgtttgtctctgtgttctttttaaacaaaagtttaactcagggcaccgtgggcatatttaaagaaatttatctgtagaactgtcttccagctaagatctgaaaaatacattttggcctgcaaaagtgttcatcagtcagcagaatttccagtaatgcctcttgtattttcaagccactttctccccatattaataggtaaaagaactagcagcacatgcctacagcccataatgatgtgcctttaaaactttctgtgagaacttagcaaaggattaaaaaggaaagggcaaaccaaggatagcaaattgattcaattccagtggaatgccaattccagtcatttagtgagtatggcatcccatgcaagctaaggggaatcatgaggatgcagtcagtaggaaagcatgctgtgattgatttgattttgccatgggcatgggaaggcaaatgatgacatacgttacacacgtattccacgtctggcttaatcttcaacatcaggtttgtatagtcctacaaattacctgtttgggtttctgagctacatcattcatattctgttaatttgggattcttacttccaaatgaatatgaagatttgtattggatttctttaactagtgaaatgttcaaatctgagcaataattgaaggttcagtaacaggccagctttgcttgcttggtcttccagttctagatctagggacattgctttgatatttatgaccataacctactttaagcagcctagcttcatctccttgagagccctgtgcatggtacaaaaatccttttgtgtacattttgtcctttttcttcctgggagcagaatcatggtactgcctatagacatgtggtcagcctttacacttaaatcaagaaaatggcaggacctttgtcttttgtacaactgtaaacatttgaatgtcccttacacttcatatttctcatcttgctcactgctgggactgactctttttttttttttgagagagagggcctggctttttaaaccagactggagttcagtggtgcaatcatggctcactgtagcctcgacctcctgggcacaagtgattctcctacaccagcttcttcagtagctgggaccacaggctcgtgccaccatgcctggctaatttaaaaaagtattttttagagatggggtttcagtatgttgcccaggctggtcttgaattcctgggctcaagcaatccactccgtcagcctcccaaagcgctggggattacaggtgtcagctaccgcacctggccaagagactgactcttatttcctgttctggtcagtgaggctgggctgtccctgattaacctgcttttacatgatctaattggccacactaacagctcctttttatttttagatgctgtgtttagatttttgttttgattcagaaataaattttaggctttgagctactttggcctttattaatttgtgcaatgaactcacaatacaatacatgctcttcagcttcattgaatttgttgtttacacagagattgatatttttcttacataagtggtttaagtcaggaaataaataacttattcaactgggtaaatatattaataagaaggactttggtgatacgatttaaagcaaatcaaagaaatttattttaaatgtgctcctggtttttaaaaacatgcactgaataagctgagcccatacctggaataggaatccaagtctagactatcaaattaaataaaacaaactcctccaaaaataaaaagtcagctaaagaaaattggagaattgaatataaaaatggatgtggtgcaggtggccattactttgaacagaaaaaactccagcttgtagcgacagagatgaagaacctggagaggagaatgctgatctactaaagcagatggtccaaacaaacacgagctaggaaaacaaagcagaaagtctgggagaagagccaacatctacaatggactaataaaagcgaacaaacacctcggcaaccacatccgacagctaggaacctgaattggcactgctcagctcattgttttgggcatatcagaaaaagcagagggaccaccagcccgtagatgctcccattcactgcgggccaacaaccactggggagaattagaatcctcctggtgccaggaaacctcttgaagtttgcatattaccacagctagtgctattctcattcaaatataccagtaaaccaaggaattgtgtaagatattatattaaaaagttgtaatccacagtagaaagctttaaagaaagagaatggtgagaacgaaggaatgccttatttaaggattgattgttgtatttttcataagtagttgtgtttttagttagataacaaacacttagaggggcttttaagagggagagagaagagcaaggaattcaaaaattcttttctttgtccatgcagtgctgtgcatattaatttggtgaatgattattgtgtttaatgtttcaatagtatgattttaacaatggatcctatagttaattctgtataataatttgtaatataacccatcttggctgcattattttttacccactgcactttactgctcgtattttacaatcacaacatagtggttacgatctttggggacagctagaccttggcttgaattacctacttcacttactctttgactattgagaggtttaagttccttgacctctccaaccctcagtttcctcaactccaagctgaagataataacatttaatgaaacatatattgaaactatgaaatgaaatgtataaaaagtgcttagtttttggcatagggcaagcagtcgattactggtagctatcaacttgtttttctgtcagtgccaaataaaattgataacagaattactaaaaaatcatataaactaataaggaaatctttaataaccaactaataatagaattagtattttgagacttctgaccttcctaataccacattatcaaacttcagatctgtctagaactattttaatttggaaaaaaaatagtctgatagctgcctctatatgggcaaatggagatacaaggaattctccagagaatgtgtagtcaaacagattttcacatcttgattccagacactacaaacaaaaggcatgaacatttactttagatagatacagccacattgtcctctaaaagagtacttatttacatagctaccatcggtgtaaaagaaaaaaaaaaggctgtttctctatatactttcaaatttttgccgatttgttggctgaaaagttgtaccttgttattttcattgacattttcttaattattagtgaggctgagcatctttttataagttattggctacttacctagtgatatggtttggctgtgtcccccacccaaatcttaacttgaattgtatctcccagaattcccacgtattgtgggagggacccagggggaggtggttgaatcatgggggtccatctttcccatgctgttctcatgattgtgaataagttctcatgagatctgatgggtttatcaggggtttccactttcacttcttcctcatttttcttttgccccggccatgtaagaagtgcctttcgccttcaccatgattctgaggcctgcctagtcatgtgaaactgtaagaccaattaaacgtctttttgttctcagtttcaggtatgttgttattagcagcatgaaaacgaactaataaacctagcttctgttaattggttgatcttatagtttgacaacttttctactcaattatttgtgtttttcttattgatttataggaactctatacatattttaattcataatgtatattgcaaatccatattcccatccactacctgccttttaatttttggttgttttactccataggaattattactatttatgtcagtgtacatctttttctgtaaggcctttgggcttcatatctaacttacgaagatttcaaattcaaagagaaatctgtattttaaatgcttctaaagttttaaaaaatgtttagtgatttatacaaaattgacttttaaaatattatatggggtggaaatcagaattaataattccattaatgttttctctgtaagaatattcagggtcctcatgtaatttttgagtactccatttttttcaccactgatttgaatattatatttattaagtattaaatatatatatagttttaaattcattttgcttgctttctttgatctagtcatacatttctgtatcctgtacttctttacttgtctttaaataagtaacataatcttaaaatgaattggctttattgtgtgttttaatatatagaaagtgctcactcattattttttatgtgatggtctcataattcttattcttttagataaaatttaaaattagcttatgaagttctatcagaaatcctggttgggcatggtagccacacctgtaatgttagcactttgggaggtcaaggcaggaggactgctatgagtccaggagtttgaaactagcctggacaacatagggagacctcatgactacaaaaagtaaaaatattagccagggtggtggcgagcctgtaatcccaatgactcatggggctggggctgttggatctcttgagtctgggagttcaaggctgcagtgagctgtcatcacaccactgcactccagccagagcaacagagcaagactgtctctaatataaataaataaaattaaataaaaatttaaaaagtgttatttatattaggctgaagtttcaattaactaaaagtttgtgaagctgtagcattttaattgcacagacttccatgtaagaacaaagttttcttgtctttaaaaatatttatttagttaagttttatcatattcttgatattgatctttaacactttcaataacatttattcctaagtattttataatttttaagaatggggacatttttattgttaattttaagctatcatccctaccaagtatttgtttattaattttcaaagtaatacctgtgcacagtttaatattaaataataaaaaagagttctccttggattgaaaaccctggtgtgcgggagcaagcttgtgtggatctcttcccaactctgtgttcagggatgacaaattgttatttttaaattggccatggtgggagtatttctactacagaaattggcatgtgctataaatctgaacttttttttttcctggagagcaaattttaaacatttatcagcctaacactgcaacaacactactccactccaattcccacccccagagacaacaattttcaacatttttagcagtctcttcagctatgtgtatctgtttctaaatatgctttgttggtttcctttttcttttttaaaaatttcattagccattgcttatggtatttacttcccaccttgagggatgagaatttccaccactcctctttctataatagtttctataatagttacatctcattttattcaggcacactattttgattatgtccatatttttcatgagttatatactataatttagttttcattcttatacaacctttttgtccttatttgagttaataattgcctaatttttcttagcttagttttctgtgaatatatcactaattatcctcttcactcaatgaatgtgtgaaacttctacaataaaatcaaatgccagggagtttacctataagcttcatttcttcccctttggagacattcctggagccctgcaccttcctattccattctgctctcgatgttactatggaagtgtcatccttgggctttccttcaccatcattttgggaattccttttacttctgttcactggaatttattttcctgggctatttctatatgttgaaccacccaattagcttccttaaaaagggtgttttgaagatcctttttacgggtactttgcaggactgaaagtatccttattcttgcatcatacttggttgatagttaaactgagtataatgttcaaattggaaatcatttttctctagtgattttaaagacattgctctgttgtcttacagattccaatgttgctgtaaaaaggtctgatgccattatcatttcgaatattttgtaggtggcctcttttgttctctctcaaagcttttaagactttctttttaaatcacaggtattcttaattcaaatgatatcccttagatgggcatgttttccttcatttggcagattttttgaggatgagggtgcttaagcagttccctctgagatttattaatttttaaaattggttaccaaaaatatataaaaaatactttatctttttaatgttgcctttttgaccatctgtctggattttgttattctaacattctaatttttttgttgattttcttggatattttacatgaatatcatcaataaataatgactttttatctattcgtccatattttcatattccttatttttcttgtcttatctaattgtccaagacatctaggtcaatggagaatagtaactgcaaacagcagatattctttcactttcactgactttaatgggaaagttcttaatgttttactatggatgtctgggcatatacttttttttttcctttttcttttcttatttttttgaaatggagtcttgctctgttgcccaggctggagtacagtggcccaatctcggttcaccacaacctccatctcctgggttcaagcgattctcctgcttcagcctcccaagtagctggaactacgggtgcacgccaccatgcctggctaattttcgtatttttagttgagacagggtttcactatgttggcctggctggtctcgaactcctgacttcatgatccacctgcctcagtctcccaaagtgctgggattacaagcatgagccaccatgcccggccaggcatacacttttataagtgaaggacacttgatttcattcccagctttatataattagtatgataaatagctggtacattttcgctattttatcttgacattaatttttaataatatatgtatatgtacatatatattcttatacatgtgtaattttgcattctttggaaaattgatttgaggctatgatgaattattttgttaagaaactgctgaattgttgctaatactttattaggaattttacatgaatattctcaaaataggtgttctaaagttaccttttaagtgcttttcttctgctttgatcaggttatgttagcctttagaaatgttctggctaatcttttgttaatatgacaatttgactgatttatttaaatctcacttgtctgaatatattgagatttttttattagcctaatacatgttcaggttttatagttattgcaaaggacatttgagataatatataatacgaacaagatttctctatatacctacttattgtaagcttactaattattgttatttaactgaacaaaactttttacttttaggttctttattactttattacttttgcatagaggtttattagagtacccttctatgattataatttttgacaatatcttccttcatatataaattttaactttaaattccatgttgcttagtgtataaaatttaaaactatgtggatttggccttctaccaatctaaatattcatattgtttcatttcatacttttgttcttattttagtattacatttttgctaatagtaatactgtagcacgtgctcatagagggctttctttggggttcatggacaacaacaggctgaaaatctttgctcttggattagagaaatgtggtgtgttccacagctgggcgttacacacttacatactacatagttatctccctgtcttttgaggaggtttgctttgcttttctttctggcctggatatctaggctaaaagccctctcatggaagagttttctttctttggaaagtaattcttaagactttaacctgggaagcaaatgtcagtgttcctagatgttttggttttggtctgggagaaggagggccaacactgacacagcagttgctgtttgactgatggtattttaattaattgtacccatgaatgtcctgctgtttgaatttgctgactctgagcttggagtttctctggagttcctttgggaagaaaggttctcaccttggcaatggctttctctcaggcctactttcggttgaagttttttcactgtagtttctctcagtttgatcgtctctttattctcttgtctagaaatccttctgtatttctggtttgttgatggcattttttcttcttgatgactgcagttattgttgaattcttattttagactatttttttttagccatattgggatttcagaaagaacattgtgctctgcctgctgtctcaagttgatagtgtcatgttttttaacagactaggactttttttgtgaatataaaatatctaatatctaaatataaaaaatataaccattaccatccagattaagaattagaatatgataatgaccattggatcccattgtgtattacagcccagcacatcttcctcctctccaagtggtaaccactctcttaaattttgtgcacatcattcctttgcttttagtaataattttactatatatgtttatctccccaaacagtatatggtttagttttgcatattttgtactttatataaacagaatgtcttctttggcagtttacctttttgcttagcatattatttgtgggattcatccctgttgataaatgcagttctaatttattggtcacttttgcagatgtacaatgttccactgaataaaaatagtgctcgttctcttgttggtaaacatctgagtggttctaaatcttttttattagaaacaatactactatgattcttttacttttcttcgaatgcacacaaagaattcttacggtttatacaaatagggttagaatgattgagtcatgaactatatacacatctttaattttattagataacttaaccttttcccaaaagttgtacccagtacatttccacaagttctatgtcaaagttttcaaggctcctctccctcagcaatattttcaaagctttaaaatgtctccaaatatattatatggaaggttgtatttcattgggcttttcatttacagtttgttgattcctatgatcctgaacatcctttcatatgtttatggtattcaaactccctctgtgatattctcctttatattatttgcacattttattggcatctttttcttttaaatttacttttaggagtttattaaaataaattttaggtatcaacccttttttgattatatctaatgaacatcacatatattataaatgtattatctctttttacttcttctaatgttttcatcatggtttgggctttttgtatcttttaatggaaatatttctgtatcttggtcttaaagttattgtaaacattttaatgttttgttccttatattcgagtgatccatatggaattgagttttggagtacattacgatgtagtaacacaattgtatgttcttatttcatttggaattcccaacaccattatttctccactgataagcaattccacttgttatatatcaactttacatatatttataggtccaattctttgtttcatttgtctctgtaatctttttgccaattccatgtgtgttaattgtatttttattataggcactaatgtccatgaagtatttttttcctttgtacacgttttagtaacatcttgtcaagtcctctcatgaccctgtagatattttgattttgctattaattaaattaatgaattttgaaaaattgacatcttttacatattatcatcctatccattaatgtgaccaactcttcaacttttaaatggtcttaaaatatgtctttcagcaaagattttaactttttctatgatgaccctgtgtcacttttcttagatgtattactgggtgtaattagttattttattttttattgtaaatgaacttattagagatacatttttaaactctccgtgagtggtaaatacaagtgcaatggatttttgtacgtttatctcatatccgacaatcttttaaactctattattcttataacttgtatattatttcatgctttatctgtccacaatttgtacgtaatgacaatattatttcttttttgcctatcttgattcactttattttgttttcttgtctgatattcctggctataacctccagtaaactttagaagagaatgctaataaggagtatctttttcttgcttttaaaagaaatatgactataggctttgttgtactatttgtagttatattttatcaagttcaagcattctcttctattcctagtttctgagatttttgtttttaaagtcttgaatgccaattttataatatgtttttcctattctatcaaggtgatcatataatttttctcattggatgtgttaatataatgtaatataaatcttgctggaaatcagtggaccccaaacagtccctctataattttatttttatttatgtttattatttatttttaaataaggtttacttaatcagagagcctctgaaggcatcaggtttctgtcatttttttttttaaaggcaataaactggcaactcgggtgcatgatgggtaggaactgggcatggggagctgggaggggtacatggagagaacacaggggaacaggcactggggaggggaggagagagaagaaggtggaggagtatcagatgggaccatagaacagtcagacccagctcctagccacccctgggacaggcagacaatcggacagacacggatacagacacacacaaagacacgtgtgttctgtgagctcaagagcctctgctgtcctgcacaagcagggatcagtcagagccaagtgtggagaaactcaagcagatgcacaggctgcgcctgatccctcaaccctgaccctcaggcccacagtgtctccactggccacccagaggctctctccccagggactggacatccaggcccagcgcaggtcatggcaaagcagaagtcagctagaagagaaaacctccagaccactcatgcccagccctggcaggaaaataaaggggtgggaggcagagaggcaggcagtccttctgtccatccatggtcacacgattgcatttaacaggaagaagacagcccccagtgccaggccagttcagccataaaatatatatattttatatatatttctttgatttcatttatgaatgtttaggttttaatgtttatattcatgagtgtgttggtttgtaattgtttttcttgaaattcttttgtgtggtttttatatctctaaatgatttggtaagtattccctatcttttaatcgctagttatgtttaaatgatgttggaattatgttcaattccaatatattatatcctactctagtagaaattttctgtaggcctagtgttttatcttgtgtgaaggtttttaatcactgattcaattttcttaaccattcggttttttttttttaactaagtttggttaattttttcaagtaatttggccattttatccctaacccattatcttatcctaatttatccttgacccattatttccctatgactgtgtttaaaaatttgaaatatatgagttgatgtagttcttataatgtgtttctatcttaatttttagtcaaaatattacatggcctatatgaaactatccaaactcactgtatgcctttttaaaataaacttttaatttttgtggatacatactaagtgtatatatttatagggtacatgggatgttttgatacaggcatgcaatgtaaaataagcacatcatggagaatggggtatccatcccctcaagcatttatcctttgagttacaaacaatccaaattatattctttaagttatttaaaaatgtccaattaagttatttttgactatagtcaccctgttgtgctatcaaatagtaggttttattcattctttttttttcttgtagccattaaccactcccacctacacccaatccccccactacctttcccagcctctggaaaccatccttctactctctacgttcattagttcaattgttttgatttttagatcccacagataagtgagaatatgtgatgtttgtttttctgtgtctggcttatttcagtgaacacaaggatctccagttccacccgcgttgttgcaaatgactggatctcattgtattttatggttgaagagtactgcattgtgtatacacaccacattttctttattcattcatctgttgatggacacttaggttgcttccaaatcttagctattataaacagtgttgcaacaaacatgggagtgcctttttattataaacttacataaatccctcatgtgtgcttgagaataatgtttattattttattctttggagcagatctctgtatttgtacattaaaccaaatgtgttttcttgaaaacatctgaaacaaattcatttttatttgtataatttatcaattactaaatgagggcccttccttagaaagccaaaactatatggggaatttatcaattcttattgtagttttttaaaaatttttgttttatataagtatatacaagtttctaattggtatatccttgtcttacattgaaacattattattagtgagatgactctttttccaatgtaatcatttttgccttaaaaatctgctttttttttttaagattgctattttactctccattacttttttagttttttttgtatttacacctttttccttttgatggtacttattcatctattccatatattatattacttttctttcaacctttatatacatctctttaaatcagccctaagctgagtttacaaaaagatgaaagtctgtctacataccattttctttttactggagagtgagtttagtccatttacattcattgtgattgccaacatatttcagtataattttgctatcttattttgtgctgtttttcatatggtatttatctctctcttaaaacgtatttctttcctttttttgtattcaatgtttattttgttttactttttccatttatgttaggatgtacgttcaaactacctactttacaaacatgaaaatcaccatgcctctcaacacctgtgtgtatgtgcacctgcatatacacacacaattatactcttacacacacatccaaaaccaagaccagggcaaaatatttccttagtatttctcttcggtgggtgaatttttaaaataatctatgtttttactgattgtgcagccctttggagacgcgttctttccagctttatgtgcctaggttccaagtctattgcaagtgaccaaggccttgtttcttgtctttgttggctgctagaagagaaatggagtttgaagtttagcagatgcttttataatagccacagccttaaattattgcttataattttcttctttattcctactttattattctcttttgagtttttttcttactttgcagaataaacactagtattacttggtgttgggtagtgggtatgttcaggggttatctaatctaccatcttgacagaaacagaagcccccaatgctattttactcttcattgctttcctgtgatatcctctatataggtaaagaaggcttaaattaaggagggactgaaatactatgaagtacagtcagtgaattggacattggacagttttacctggtgaaacctgtctacttggaggtctgtatcactcaagaactctgttgctgctatttctggacagttgtacaagaaggatgcaatgaacaatttttatcttaatttactttgatttagagaaaaaatagtctgtgtgatataggaaaatctgatccagcgtcttttgttcttaaggttttatcagcatgatttgagattaaaatgaattagaaacttccaagtctgcctttatttttttctaatacaattatttgctaaatatgtaaaaaataaaaagttttcaagattgcttaggtttattactatgtgatattcatctacatagaagaaacaaataccttatagttcaattaaactagcctttaccttatgtgatttttataacatttagaaggatgtcttgtgatctaaagacacagcttcttggaatgagccttaattagcagtctaagttttaatattatgtttgtcactgatgcaagtcaggtagtttatacatttcagttttgtcttctaccaaaggctgcctaatcctaactctgaaaaatgttagaatatgctggtattcttgcagctttctcctttttgtttttatttttcaaaatacttgcatgtctgtacattatacaatgacaatcatgtggcctcttgctcagtctctttagttgccacatggcaactgtctctcagctatcatttcagttttggcagcatcctattgtaattcacttgtgtatatcaatgactggaaaaagtgaaatgacagtgctgttgaaataaaggtagaagccactaatacagacgtaagtagtatttagtcttattcagacactcattgtattgactgagttcaatggtaaagtaaatgaacaaaactaaatggcatgaataaaatgttgaaaatataccattgaaggttgatccaaaagatgggatttcatttgagacataatatttatttatttatttattattcttatactttaagttttagggtacatgtgcacaatgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgttctcattgttcaatcccacctatgagtgagaatatgcggtgtttggttttttgttcttgcgatagtttactgagaatgatgatttccaatttcatccatgtccctacaaaggacatgaactcatcattttttacggctgcatagtattccatggtgtatatgtgccatattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctataattttaagttgctaaataaaattctctgtacctttcggatttattcagatttaatttaagcctttcggatgaattcagaacatttaattttggttcatcatttcaagtttaccttttgcctttatcctatgttatgatacatgaagaaaaacattaagagaatcatcaactgcctggtggttataaatgtactggaaatatttttcaatacatttttgaaaatgcttgtaatggataattcatggctaaaataattagttcttttttgtgtagtctattaattttcgagaacaagtataatattctttaagatactttttcctactttgtcttattctgtatattttttctgacacacagaacaatataaggccattgatcctcccacctccaccctattttctgcttctttttggtaaatcttagaagcattttaaattccatctgtccctttttaagctttcaccaatttacgaaggacttattcactttctggagcacctagcttcaatctcaacctttacttgacaaaataagtcttccatgtaaacatatatttgatgaaaaaatttcaacaaacaatgaattattattatagaaaatgagaaaaagctgtaacaaaatcacctttaatctgcctgccaagaaataaccaatgctacattttgatataaactccctgaagtatttaaatttatgtgaataaattttacatatgtgttattttatctattttatgtagagaaatgaatcaaataatagttaatgaaaggttttatcatttctttttattcattcaaaatagagccatttatatcatacttatttccatatcgataaatgtgcctctacaacttatattttgtatataacaaaattctattacatgatataacaaattttaactaatcctcaattactagaaattcaggaggtttctaagaacattattacacacaatttttgagcacctactatgtgccagctcatatttgaggcactggagtttagcaataaacaagacaggtaagtttctgctcatatggagcttatttctggagagtagccttgaattaatctctattttctttaaccgaggtatttttcctcattatcacacaggtatcttaggttgttgtccagaggtgatgctttttatccttcttaagggaaaaaacataacttggatgtatctccccatccgtttcttccaccaactatgagtaacaattcatggttaagagatttaattctcttttttgtgtagcttatgaatttttaagaacaagtacaatattctttaagagacttctttctgctttgatttttttaatatattttgttaacacagaaaaatatagggccattgatcctcccacctccaccctattttctgcttccttttgtttatttccagaagtatttaaaattcattttgtctctttttaagttttcacaaatctatgaagaactttttcactttctggagcgtttttcacattctctgctttttttttcaaggctttgatggtacagaaaaatgactgctcttgcaaaactaaaagtgtagctggaatatttgtatttattgattaagaatcatcttttactatcactctttttaaaaataaacgttcctaaataaacacagtttagtatatatgagttacagtacagtttcatctaagcctcatagactacatatattttagcagttttggtggtggagttttgacagccactttttactcttgcgttgtcctgtgtggcattgctccatatccttaaccataaaagctgaggtgatttctatagcgctcgtaagctctggacagagaagcattgcattagctaccgtaaaaatagttcttaagactctggtacaaatgactttaaacccttttgtatatatgtaatcatccaatcttttggcttttagttctggtttcccataaagatgttatactacctttttcaattatggtaatggcaggattttcaaagaaggatagtctataccaacaagctattctatatacataacttcaatttctgtcctctaaatcctggggaatatttgccctcttgaatgcagaaaggcagcccatctgcttctttgggtaatttacttcattattaaattgttctataaggtgataggagaacttttcagaggagttttcatcttatcagaaacatgatataccattggacttcatgcattttcttgttttcatttcttacaatacatagctgactattttctcctctacatacttttgcatggctaggggtcaactcctatcgttagaaaaatgtagattaaaagtggcactattaatgtaagagttaactttgcttggatttcatgtgtggaagttcagagataattaattgggctttcattgtagttttgcctttttcatttcaatgtataaatctattttcagggagggctggctagcaggacagcagaaatctaagacttccataaccttcaccttttgaaaaactcttcattgcttttggatagtctcaatttcttcttctatttctcttaagaaaattcagaattagtgttgaaactttttttttttgtaaaatcaaactctgttagatcctttcaagtaagtcatttaccacagatttcctggagttagattccaactagtatttatgtttttagttgacatttaggaaaggttttcagctagagttaaaaagagagtgaggggcgaatatgtgtagctcagctgttttgaaaatgatctgtttgtagaaggccacaaagcaaatatgattatcttattcttactctgaattttcaccactaaaaccacattctattgaaggaatatataataaaagtgcattatcatatagtgtcacaatgagggattcaggtgcgaagggaagactcattcctgtgaaaacatagcccatccccagcagttggtagaaggatttgctggagttcctcctctttgtgtggcctataaaacattccatgaggcatgtggcaatagtcacaatgatagtggccttatctcctccagtctttgcatcctcactcaagccacctcttttcatagacacatactttatgtttgggaagaggtgctctaggtgggacacccctgcctgctccaaataattcctactgacatccatggcaggttcattctatctgagctggagatttgggaatttaggtgggcacagaagaaagaaggggtttggggcagtgtcgtttggatgattttgacagattcttcctgggggtaaagagagataggtgtgtctaatcatccaagggaaataaaatgcaaaggtgtgtgtatatggaaaatcaagggagaggaaattaaaattatccagattgcttatttaatagtcaggaaactcaactttccatgaaggtaagattccccactgtgtctttttctttttcctagaaattgaccaatttctgagtagatgaaaaaatacaggtggctgggcgaagtagcttatgtctgtaaacctagcactttgggaggccaaggtaggtggattgcttgaagccaggaactcgagaccagcctgggcaaaattacaaaaccttttctctaccaaaaatacaaaaattagctggccgtggtggcatgtgtccatagtcttagctacttgggaggctgaggtgggagaatcgcttgagcctggaaggtggaggttgcagtgagctgagatcgcgctactgcactccagcctgggtgacaaagggagtctgtctctgtctttgtctttgtctttctctctctctctctctctctctctctctctctctctctctctctctctatacacacacacacacacacacacacacacacatcagatatgtccatcacacgcacacacacacacgcacacatgctttcatggtagttttgcctttttcatctcaatgtgtaaatgcatgtgtgtgtgtgtgtgtgtgtgtgtatgtttatgtgtgtgtgatggtcatatctcatatatgattattgttgattattgaaagattttcttcataggatactgcccttgtatggaaatatctatgcagagaagagaataacaagcagttcaagaagagttcacaggcagccaggcaaaataaggatctgttttttcagactcttgcctttgcctagaattctctcctcagcttttgcatttgggaaatgtgacaaagttttcaaggtccctttcatatatcaactcctctgaaaatctttccttgatctctagcagaattaacccttactccactgtgttcccttggcacaaccgtaagcacagttttgttttacaatattatattttgttgtgcatgtgtctttctccctagctacactaaactatatggggctaggaaggcatttaatattgcatctctagtgcatagcagtttggtggcacaaattagatgtaagataaaatgttattgaatgaatgatcttcatctaagtgatttatatcattggcttcagtttatgtttacatcttggttgctgcacaaggaagatatgtataagaaggaaacgtagcaaaggcaaaatattctagttcacttctgataagacaaataataaagctaattaataatgagtaagcgttacttgcttttgcatcacaaaaacacaagtaggttctctgtaatatttgtagaataaatgaataattaataaaagctttttaaaattaaacccttaatatatgctagacactgagtaaatttatttacttgtctcattttacttctattagactgggagcaaggtgttgttatccccattacagagaagaggatatagactcaaagaaatgatgcaactttactaaaatcggataactcacaaactgtagagttaatgttttttttttttttttttcagagggtggtttttctttttttttttattattatactttaagttttagggtacatgtgcacaatgtgcgggttagttacatatgtatacatgtgtcatgctggtgcgctgcacccactaactcgtcatctagcattaggtatatctcccaatgctatccctccccgctccccccaccccacaacagtccccagagtgtgatgttccccttcctgtgtccatgtgatctcattgttcaattcccacctatgagtgagaatatgcggtgtttggttttttgttcttgcgatattttactgacaatgatgatttccaatttcatccatgtccctagagttaatgtttaaactgaggattgtcttactcactttctcatgaaggtcttcaccactctgcgagtttcccatgaatttacaattcttcagcaatggattttttattttggtcctcattccaattgtgtatggcagagtaagattcgagtttccacagctggtggatctttgattcagtgtttattgtacttctatgtacatgatgtcctaactgttataggatatacagttttagctacataagggcagggattgtgtttaatttatttcttagtcttacagtgtctgcctgacacagcacattgctaataaaagcatacaaacatttaatttgaaattctgaattaaaagagcaaaaaaccagcaccataaatgccataaggtagtgcaagtgccaaagaaatgttacaaggaaaatgggctatgagctcagaattgagaggaatcattgtaggtgggaattgtcagggcggttggatttgataattttgtaagatattttgaaacttcctgccttaggttatttttgataattcctgtattcttttgagcagtgatttgcaggacatttcctttcacaacaagggtctggacacttgacttggaaacaaggcgaaagtagagaagccctggcccactcctaggcagtcactggaggaagggtgaggaatttgggaaaagcaaccagcatcaaatcagagatgagggctcatggcagctgaaagggaaggggacagcagcctggagtataagattcaggtatgatttatgatgagaactccagcagcaggagatgtcagggatattcccaatgttataaacttcaaaaattaaaagtttcttggcaccaacaaaatcaattggaatattaagaaagcaatactggaccaggtgcagtggctcactcctgtaatcccagcactttgggaggccaagggaggtgcatcacctgaggtcaggagttcaagaccagcctggccagcatggcgaaacactgtctctattaaaaatgcaaaaattagctgggtgtgttagcacgcacctgtaatcccagctactcggggggctgaagtagcataattgcttgaactcgggaggcggaagttgcagtgagccgagatcgtgccactgcactccagcctgggcaacagagcaagactccatttcaacaaataaataaataaaaataaaagcaacactgttttttgaaggaaggacaaattcagtgaaatgcaataattcaaagttaatttcactctgcatttctgttttcagaccagtatttagtgacttcgaaaatacagtatttctatgtccatgtatactttctacataaagtttgaataaaattaggcttaacacttatatattaatacactctctcagtgcctaaattgtaagttcctactactatgttttattctttttatcttcagtacttgccctggtgtctaatttatgttaagtgctcaacgagtgtttgattagtgaacacatttccatttagtatgtggcaatgtttagtacttaaattttttcttaagtttcccttggttcacaacttacacattgtaactacagctacaataaattgaatacaatatgcagtaccaggctccaaggaaacttgcttcatgttgatttgtgcttatgaagttgactttgggattttaaaaaacatacagaataactgtgaccacattcagacatttaaaaaaggtttcttatctatccttggctttgatttgtaagttatataatcaagatgaaaacagtcatttataatcattcctggttcccatatcacagtgtatttataaaaacaatatgtagcactatgtgtattattttatagtgttacgtatcgtccttcttttggttgcttacactctagtagaaaaaaaggtcaaccaatttaggttacctataagaaaataaaataatattgattaatgtgcatacaaagtcagcgtgaggtagaatagatgattttgggacagggtagtttagttttgaatggtctaaaagaaataatgaattatatgcgcaagatttatatctgataacttaatatttaaatgctgtgatttacagaagaatagtaaagggaaagctggcataagaatatgtatatatatatatatatttttttttttttttgctaaaacagaaaaagtataaggtgaatgccccagcaaatgggtttgtttcatgtatcagggccaagtgacaattggctctgtgtggttatagttttcagtcccacttagagggatgtagaagaatcccagaagttttcaaagctgattaacaacttaaaaaggaagattaccagagtgctattgacaataactaaatggagataataaacggccttaaacaggtttatcagtccagaaaacattgctatttagaaaaacattggatgccttcagtatttagggatattgtttctcagaccctctattaagggtatcagaagacgttttctttaatcaaggcttttagcttctttgcgatgtgttcaaacatcctcctttagctcagagaagtttgatcatctgaagctgtcttctctcaactcgtctggaaaccgtcattctcagcaaactatcgcaaggacagaaaaccaaacactgcatgttctcactcataggtgggaattgaacaatgagaacacttggacacaggaaggggaacatcacacaccggggcctgtcgtggggtgggggcagtggggagggataccattaggagatatacctaatgtaaatgacgagttaatgggtgcagcataccaacatggcacatgtgtacatatgtaacaaacctgcacgttgtgcacatgtaccctagaacttaaagtataataacaaaaaataataatgaaagaaattttctttaaaaagaatgaatataacctagaaatgcattgtgttattttttctgtcaactcaaattattgtgtactgtgcacttagtcacctgagggtgcacagcacagcagatagtctcagctctgatgcaacttatcatccagtgctagggatgtgtgaatgattgtgcagataaacaatttggggacatttcataatacagagagacgtgctgggatggtattggcgtcaagtgtttggggaatacttaagaggagcagaatcctgcttgagaaaaacccagtgtgactttcttcatcttgcaatattactttaaattaatttaaattgctaaaatatggtaatgataatgacagcagatacatggagcatcttattatgtgtcagcactgtgaaaatattttatataaattatttcgttttaattcttaaaattacactgccagataggcattaatttgttttgttgtttctattttgcaaataaggaaagtgaggcctaacattttaagtaacagtctgagtagcacagaattaatcaggggtggtgagaggattcaaactcttggacttaccttacaactcttaacttactgaacctttagctcttaaaactctgttaacttacataaacacgggtgaaagttttgaaaagagacactaagcaaaagcatagtattttttgctaaaacaactactgttcaaaaattaagaacaaactttcccacatttaagtagctatgaattttaaagattgcaatgccaaacttgttgaagttttaaaaatgaataaggctcaaatgtaaaactcattttttggcatctgaggacaggaaatgtaaatttgaaatgaattggacaaaagtaaagctactcactgaaactgaaatcctttgtcataataacaactgcaggcttctttggcgcaataataattgtaaaattttaatgtatgattgaagcagaactatcagacaaggaaaagattcacaatctttccaataatagatatgttaattttttatgacactgtacaagaacaagtttaaggttactctagaaggttaaacatttgatttttagttttactatttgtcttttatttatcaaaaatttccagtctaaaaatggttaatttcacaaatgaagaaaagtatcaattatggaaaaatcagaggacataatttttatatcattcctttttttttttttaaagtaagtggctaacacattgccttatatggaacgatcttttcctcaggaaatctcttttgattaagaagctgcacagtgacatagaaaaatatagcagagtgattgcttcctctacaaatcatatctgaataataagtagtcaaagcaagaataactgggaatattgaggtgtcttcattttctaacctcagaatatttcaccaatttattttatccttaaaatgcatttgaaactttttgttgccttaaggtttgcagcacataaaatgatattgttggagaacaatttgaactgaggatgggttatgaaaagatctttttatcccaagtaataccaataccaaagtgactatttcctgtgcctactgattcttaaatgacaatttggctcaccacactcagacttctcaaaatagttcaacctaagtggatctgacaactgcctagaaagcttgtccgacccaccttattttgttgttgctgtttttctgttttgttttgggcttttagcagcctgaagtcatgttttttgttttctgtctgaagtggtaagcagaaaagaggggagaggaaggggctttactggcccaaccagaaacagaaactaagaacctatgtctgtattctctcccttggatacctgaaaaaggacattaaaaagtcagtgtaaaacaaagaaaaaacaaaaatgtaagcgaaatttatgactttggttcaattatatcccagatatcccaaatctgtagaaataaccaaggggagatcaaaatttttcaagtataaaggtagtactcagtttttaacttcttaaatgaggagtgcccctcagtcttctgttatataaaaatttactgttgcatatgtttccaaataatgaattaccaagtatgactgatacataaaattatactatgaaagaaaacttacaagtatttgaaatatatcaagtatcccccccaaaaaacaaaccaattaacttgaaattgtaaattacacaaaatgtaataagtaaattaacatataaagtcttttgtaaattaaacaaaatatatcaagtaagttaaaatataaagacttcccggatagattccaaccaaaaagttgctcaggagcttgaaaataccttcttaaatgctttggctcacatttctagtttaaatgattattgcatatatttttgagacatggcatatgattttatatatatatatatatatacacacatatatatatacacacacatgtatctcaagaagagatggatagttgtatagcttgatatttgtttctatgtttgatttaacattgtcatataaatttgtaactggcactacatgatattgatgccttgtgattcccataagtaagaaaagtggacagttgttttttatttatttccgttcataaatgtcagaacaggtacccttaaactatggggataagttttggcttaagttactggaactttttgaccaatatatttaactagaatgagaaaatgtactttgacaatttcaagcatagttatgattctatttcctaaataaaaattgtacaaaatttaatattttacttttatgtaggtattttttttaaatttgtgaatgaaggactttcaattttttatcaagtctgggtgagtagtagttgttattgcattacctttatgcaaattagaaaactgagaagtgacgaaagtcagatagcaagtaaataagtatcagtcagggctggctggctgacttcaggttcaatattctgttcattaaactacaagtaatgttttaaatctattcaatgttgcagtgatatcaaaaagccatagtttgtgatatttgtgcagctactagtgttgtttcttaaatatattttaaaatacgtgtcattattcaatgcttggaagatgcaacaataaaaggttatgcattttttaacaagtgaggacatttctgtataagattatcttatccatgtttttatctttatcaaaaatttactgattataacacagtaagtgctaaaggaaggtatgagtgtaatactgtgaactgatatggatagaatattttggcgtgttgggagatgaatgcttgcctacagaggattgatgacaaagtcagagggtatcaggatgtggtcccacagaaagctctgggcttaaaattgagatattggagtcatttagtatacatggagtcaatgtttgtgagtatctaaattcttacttgcaaaaagaaggagattggtagacatcagggtcccccatcgttgaattctggctaattctgccttatcatccctttcgcactcacagtgtgcacaattttcctttttaaatccctttggaagaggatgcacttgacatttaactatgggccccatcatcctttctggtctcacgatccatctgatttacagtttttgttatctgcctagccccattgtagattaattccaagttctctttttgctaagcaaaacaaaacaaaaaaatccttgcggcattttcatctaaaattaactggttgtatgtgtaattgcaaacaaataatagctaaagccggcttctgttccagataatactgttttaaggctacaaaacctactaaaattgttaaaggtttctcaattgccaaaatataaagatatccccttacaaaattattaacattaatctaatagtctgatttatgaaaattcttaagaagtacattaattacttgactaatcagccaggggatccagcattagctttctcaaatttaactgagctgaaaggagtctaatcctgtgatacagagaaataattgggtttccaatgtctgatagtcttaattcatggagatagcttgagtcccttgaagaaagatctggtcatcagggtctgttaccctctaatcgtaatccttatttcttctcaaaggtcttgctaccctttttactggatttagaacgccatgtatgatgctttaactttccatccgtaacagattttctctgtctgttttgggtatttccactcattttcttctctttgtctcccatcttcctagagaaagagaagtcttgttaccctttttactgaatttagaaagccatgtatgatgctttaactttctatccctaacacattttctctgttttgggtatttccactcattttcttctctttttctcccatcttcctaaagaaagcgaagggtaagcttatcccatctcctccctcaagtgctttctctttcatttttaattctctttgcctagctttttcccctttgtgaggaccaagaaaaatatcctgtgcttcctagaacatgtgcactcttctttccctccttgtattgcccaacttgtttaaaagtaatctgcacaaagcacacttcacatgtgcctcaactgctcactacctaacctcttacagttggtaatcttctcccactgcccttctgaaattgcttctgctttgccttgactggcatttattgctttctgtctgattttaaaagtgatatctatttactgtagaaacttacaaagatataaaaaaagaaagaaaaattacctttaataccattctccagagatgctggattataaggcacttctatttttaatcttttgagaaacctctagactgttttccataatgcctgtactaatttatattcccacgaacagtattccagagttcttttttctcacctcgtcacccacacttctcattttttgtctttttgataatagccatttgaacagatgcaaggtgatagctcattgtggttttaatttgcattgctctgatgattagtaatgttcagcattttttcatatacttcttggccatttgtatgtcttcttttaagaaatgtctattcagtttatttgactgttttttaattagattttttttgctattaagttgtttgagttcttgtatattttgtgttttaatctcttatcaggtgtgcagtttgcaaatattttctcccattccataggttatctcttcactctgtcaattctttcctttgctgtcataaagttttatatgttatgtaatccaattgtctgttttcactattgttacctgtgcatctggggtcatataaaaaaaatcactgccaagaccaatgttttggagatttcccctatgtttccttccagtggttttacaggttcagttcttatatttaagtttttaatccattttaagttgatttttgtaaatggtgtaagataaggatctaatttcctaattctacatctgaatatccaaatgtttcagcaccatttattgaaagggctgtcctttccccattgtgtgttcttggcacatttactaaaaatcaattaaccatagatacatggatttatatcttggctttctattctattccattagtctactttccttttatatgctataccatgctgttttaatataattttgtagcatattttaaagacagatagtgtgatgcctttagctttgttctttttgttcaagattgctttggccatttggggtctatttgtggttccatataaattttaggacagttttttttctatttctgggaaaaataccattgggatagttatagaatttgcattgaattggtagataactctgggctgtatgaacattttaacaatattatttcttcacattcatgaacatgggatagcttgctatttaatgtgtttaatttatttcatcaatactttatagttttcagtgcacagatcttttaccttcttagctgaattattttaaagtattttattttttggtagctattataaaagggatttttttttagttctttttttggaaagtttgttgttagtgtatagaaatgctactgataatcgtatattgattttgtatcctgcaactttactgaattgatttattagttctaagaggtttttttttctttttcttttttttttttttttgaaggagtctttgggtttttctatttgttaagaccatgtcatctacaaacagggacaatttagcatttaatttccaatttggagaccttctagttccctttagttctttcttttgtctatttttttctggctaggacttctagtactacactgaaaaatgtgggaagagtgggcctccttgccttgttcttgatcatagataaaagctttcaagttttcaccactgagtatgttagctttgggcttgtcatatatggcctttattgtgttgaggtacattccttctattaccaatttgttgagaggttttatcatgaagggttattatgtttgtcaaaggattattctgcttctattgatatgatcatatggtttttgtctttcattccgataatgtggtgtatcacaattatagacttgtgtatgttgaaacatccctgagataaacaccacttgatcataataagaaatccttttaatatgctgcataagttctttgctagtattttgttgagagttttcatatttatgttccccagggatattgacctgtaatgatcttttcttgtagtggctttgcctggtgttggtatcagggtaatgctggccttgtacaataagtttggaagtattccaatttctttaatttattggaagacttcaaaaacattggtataaattattctttagatgttagaattcagcagtaaagccatcaagtcctggcttatctttgctagaagactttttattgcttatgtaatttccttactcgttattggtatgtttgggttttctatttattcatgattcagttttagtaggtagtgtatgtctagtaatttatcaatttattctagattatccaatttgttggcatatgattgctcataatagtctcttatgatcttttgtatttctgtggtattagttgtaatgtctcctatattatttctaattttgattctttttttaaaaattaatctagctaaaggcttgtcaattttattatcttttaatttttttgttcatctactataggtttttgctctgtaactaacatgaggcttgcttagaacatcttatagttataactatggttattttaagctgatgacaacttttatcacattaaaaactgaacacttttactccacatattctaacattttgtttttaatgccacagtttaattttttaattacatattccttaacacattattgcagctgtttttttaaatacttttgcattttactctttatacaaggatatgtgataattagccattacattattagcatattctgaatttgactttcaccagagagttttactttcagatgattgtgtgttatacattagtgtcccattttttttcagcttgaagaactccctttcacatttcaggtctggtagtaattaatttcccaaatatttgttttgttttgttttgtctgaaaaaggctttatctctcctttgtttctgagagtatctttgtcaggtgcagtattcttggttgacagtttttttttttttctccgcagcattttgaatatgcatttgccatccattatctattggcctttaatgaattttttttctgtgaaatctgattctagcctgattggaactctcatatatgtgatttgcatcctttctcttgctgctttcaggatcttctatttgcctttgatttttggcagattgtttataatatgtctttgtgtagtcttatttagattgaatctaattggagactcttctatacctagatatttatatctctacctagatttgaaaagttttctgtgatcacttatttgcataagctttccacctctttgtctctctcttcttcttcttgaactcctaaatcttgaatatttgatcttttaaagctgtcccataaatcccatgttttatttattccttttcatcctcttttcttttttctcctctgattgtatattttaaaataaactgttttcgagttcacagattctttcttctgctttgataaattctgctgttgatgttctctattgtattttgttgttgttgttgttgttgtttagttcattatattttccagctccgggatttctgatttagaaaaaaattattttaaatttctaatttggttgtttattatagtttttctgatatcattttattgtttctctgtattttcttgaagtgttccagactttcttaaaataattattttgaattatttgttagacagtttgtttctccatttctttgtggtcagcaactgagagattattgtattcttttgatggtgttatgtctctttgtttttttttttttattttgttgttgttgttgtcttatgttgataactgcacatttggagaagttgagacttattttagtctttgcagactgactttgtctgggaatacccttcagcaatcagcccatccagagattctaggcaggccatttgctacagtttacaggtgagcttgctactggagttctcatgcaagcttatttgattcttgggttcagcaggtaggcaagcctgatgcctgggtccatgggattgggcctgaatcctggatccacttgggtagacctgttgattgagtccatgggggtgggcctggagcctgtatctgcaggggctggcttaaaacttgggtccacaaaggctgatgtactggtgggataggctttgagcctgagtctgcaggggctgaccaggtactggcatgggcctaggacctgggtctactagaacaggcctggagcctgagttcatagggtctggcttggtgctgcagcaggcctgaagcttgtgttcatgggggcaagtatggcttctgggtccattgggggctggcctggagcctgggtctgcaggggttcatgagggctaccctagcactgccctggcactcaggggtctactgtagttaggccgaaccctgggtatgctgaagccagattcgactctggatccaactggagcatgggtccatggggactggcatgaagcctgggtcctctggggttggcctggagcatgggtgtgtgagtgctgacctggagactagttctatgagggccatcctggaatttgggtccacagggatggtcctggagcttgagtatgttccagccaataaattgctgtgatttactgtgatgggtctgaagcctgtatctgctggaggaggcctggacctcgggtctgctggtgtgggtgtgtgctggggccagcccaagactgggcagacatggagcatgcgtccatgggtgccagcctaggtcccaagaccaggagtgcttagctagccctgtgtggacctgaagcctggggctgtgtgggtccacccagctctgtgctggtctgaaacctggggtagtcgtggagaccaaagggcctggcctagaggttgagtctgaagatgctggcctgattactagggatgtgggggctggcctggcactggggttgacccgaatctcagacctggcttgggggacagtatgaagcctggggctgtaggaactcaactggttttggcactagcttggaggttcagtctgagggtattagcctgaattctgggagcatgtgggcttgcccagctgtgttttactggggtgaacctggtgttggagtacaaggcaaagtcttggcaccaactctgaggttcagtctgaggtctgggagcatgtgtgcttgcccagctgtgttttactggagtgagcctggtgttggagtccaaggccaagtccactgctttcttccctccctttccctcaagcagagagtatttctccccatgctgtgctgcaggggaaggattgatgtgggtaatgtacaactgtccttcctactctctttaatgaatcttttcttatttttgtgtcacactcaggtgctataatttttcacctgtttccttagctcttgtaaaaatattttcatgcagggatagttgttcaaattgatgtttctgcaggaagccagggaatgaggactggaaagtcctattctgccatattgctgacatcttgctgatcagaaccccagtcttcagttgttaaggatttagaatattttctattataaacaagtattggaattgctctcttgaagattatcagtaacccctaatgacgtaaaccaatgtcattttctgggccttctggcatttggaatggctgctgcatcttttgagatgaacttccctctgcctttgattctctttcttttgttctgactttttattcctctccctctcctaaatgtagatgtcctttgaggtagtgtcctttgctttctagtctaataaactcttctctggaaaatttacttttctgaaatttacatttttagtgttgaaatctctcacaagttctatcccttttttcttcttaaacatttctacttaaaaccaatgttaaaaccaaattggatttaccaaagattatataaaattgaacttcactaaccccaaatttatgactttttgtaacttacagatttaatggtactaactattgtctgaattatccaagcaaagcttctcatgtaaactcgtgcatcttttctgccaacatgtccaagtccttttgtcccctcccttcctttccatttaatctcaatgaaattcatcctctactgttttaacagaagttataacttctattagcatcacctttaggctgcccaatatcgtcatttaccagaaaaaatgtgttctttaaaacataggtcagtggtccaatatgtatcacaatataaaagcaatttgaaaaagtttttgatacttcagttacctgcatcacagaagagttttctttttctatgtagagggttagggacagggtctctttgttcctgctttttcaaggatttgtggtctggaaggtttttcactatgggttcccctctgatactgctttctaatcattgaaatccatacacagtgtattaggtaatatctaagctgatagcacctctgacatggtcttatctacttgggatgtactcatctgcctgagtcatcgtcatgttctttaacaagaaatcattcaaaaattgccctaccgtggtctgtggacagttaagacaggcactccacagatacataccattcaactctaataaaggctacccatttttcagattactttttaaggcaaaaatacttctgtacaaatagttaaataaattacatatgctatttttgtgtgttcgtggtgcttaaatgaacagttttatttctatgtgaaagagaaaaaaatggtaatgttattacaggaaaatactatcatgttaagaagaacatatgtttgactaagattttatcatattaagcacccagctgtctttggccattgaagctttcttggacagataggttcctgagcattctaaaaacactctttttgattgccaatatgatgtttggtttcagagactttctgtctcatgtatttgccataaagaatgaacatactgatgctctccctcagttttagcaagagaaacattttagagcactggaatgaggtactatggaaggctgtataattaccttccattaaggtctttaaaaacagaatggctatttatatttcttgaattgtcttaaagaagctctttctacatgggaggaatggttctgtgatggtttttgaggtcattttaggtcttgagtagtttttatgttttagataagtttggtacagaaaaacacacttgttcagaaaaattgggtctggcactggttctatcataaggttattgcataaatcctaattctgtcaccatttctaaacagtgttttaggatggaatgaaataataagtgtaaacattctgtcgcctctttagaaaacagcttgatttgaatttctctgatggctagtgatgatgagcattttttcatgtgtcttttggctgtataaatgtcttcttttgagaagtgtctgttcatatcctttgcccactttttgatggggttgtttgtttttttcttgtaaatttgtttgagttcattgtagattctggatattagccctttgtcagatgagtatgttgcaaaaattttctcccattttgtaggttgcctgttcgctctgatggtagtttcttttgctgtgtagaagctctttagtttaataagaaaatgtggcacatatacaccatggaatactatgcagccataaaaaatgatgagttcatgtcctttgtagggacatggatgaaattggaaaccatcattctcagcaaactatcgcaaggacaaaaaaccaaacaccgcatattctcactcatagatgggaattgaacaatgagaacacatggacactggaaggggaacatcacactctggggactgttgtggggtgggtggagggatagcattaggagatatacctaatgctaaatgacgagttaatgggtgcagcacaccagtatggcacatgtatacatatgtaactaacctgcacattgtgcacatgtaccctaaaacttaaagtataataataaaaaaagattaaaaaaaccataaaacacaccataataaaatgaaacccctaggggaaaaaaaaaagcaaacagcttgaaagacaaatccaatacagtcttgtctaattgttttttaatctctatacagctgaactgttgtgatggttgaggcaattaataaaagaagtctgcattttgaagaaataataagtgagaatagaagtcagggaagaccattgtttcacagaggcgacctaagtggtttcaacttatacgaacactgtgtgctaacagctgtgggtccgtcctccttttccaactttgagaaattttctcctttcaaacggttctttcttatcccacagtctgctctgccatctctttcctcattacttttcttggcctgagcatctgttctttcccctgtgtgctgctaagggaagaggcaaggtggtagagtgaaaagaacagggattttgaatgaggcagacctggattggaatcttgctttattacttaccatcaagattgctttagtcaagttacatatctccatctaaaacactgacataatttctgttacaaaacgaggtgatatattgaaaacatcttagcagggttgctgacaaataatgaattcttaataattattaggcattattgctctattttcatatggcctgtcaaaataccaccaccacccaatttaaacataattattttaagcctaataaaaggaatataaattggctttagaaaaaaagtataaataggagcaaaagttatttgagtgagatagccaaacataaataaaagcaggcattattaacataaacagtttcaattaagatgcatgcttttaaactgaatactttatgagaaaagtatcaagttctcagatataagttgaggatggatacctctggtaattttcccaaattagaggccactatgaagaaataatatttcagatatatactcaaaaatggaaatgtatttcaaatctgtatgtttgttggtgaaagcatgtgatattttccaagtcaaagaggctgtgtggcattagagttaagtgcagtgctgggtttgtattccaactttattagttactagctgtattatcttgggcaagctatctaactgccccatgcttcatgctttcatgcatacatttggaataataatagttctgtgcttacatagtttgtgtgtgtgtgcatgtatgtatgtatgataattaactgaattatttcatgaaagggattacaacagtcttcggcaaagactaagtgttcaatattaattaggtgctcttattgctatcattattagtagtagtagctacaggaagatagtgctacttgaaaaaaaacacatcttccccaaattattttatggctaacatggattgagcattgaatatcttcacagactagaagaaaacactgtttgagcctaaaacaaggggatcaatattatcagtatttcatttatttattgatgaagaagttaaagatagctacaatgttgaaagctactccacataacaaagtaaagatctattgtctacttggtttgcaaataagatacagtattggagttgtgcctaagtaaaaattattttttctattgtgaaaatatcaattacacatttattttttgtaaggtacatttttaatcaatgtccctagtacttacaaacatatagacacacacacacacacacacacacacacacacacacacacacctatgcaattcaatccttgctgcaattctgcaaggcagatattaatagttctattgtacaaatggaaaaattgaagatgagaaaaattctgtgggttgcctaaagggatgactaaactgagtaaatgggatacttcttgactcttctttgggtcgctttgtttctctcaaagtatattcacttcccgagagtatgactattacacttctctgtggacctctgctatattttatgttcagaaaacgtaccgtatttaagaagaaagttcattctttgcaattaaactctactaagaaatatgggtgcattcgtatggagagctgctgaatgcctgagtgtggcaaggaaatctctggaggcagaatggaaacaaaactcactctaaaggagtttggggttccaggcatttacaaaagtagaaggccagagataagcatggaagatgctgatcaatagacagactggaaaaatgtgaccatagtcacagaggggttcaattgtagctgcattaatgaagcaggttcttgacaattttggtaaaccatgctgatagccagcagcatgcaccaaagagtaaatcatgctctctggaggcctatcacagaagggatgccaactaatgagattccacacatcattgtgatgaggtatgaatgctcatcaggaacaatcgacctagaaaccgaggccagtatttcaaggggtatcttacggtcaagcccttactggtgtagacagctccagatgaaatatataattgttctaagccaacttagtgacagagcaaccctgactatttcctaccagggctgacaggttttttggactgggtatggatgagtaaaccttaaaatagaacaaggggtaggctaaatccttctggtcttgtgtgttgctgagagaataggaactctggaatcagagagaccaagattcaaaactcagctcttctatttattttatataatattgggtaagtatttaccttcctaggctttagtttctttatctctaaaatgggactaagaatacctacctcaaaatgcctaatataatatacataaatttctgtaatgtaacatctgtttaataatttttattttattttatttaaaaattttttaatttcaatattctaatttttaggcataagccaataaatattagttttatcagcctccttctattaatatttgagaccagaattgatatacaatgtacttcatatcttttcctgattataatttcctcacattcttgcttttttcttaaagttgatgatgcgtttattcattcgacaatcagttattgaacaaatataatgtgccaggaacagtgtcaggtactgagactgcagaaacagaagacatggcctttcttccaagttaatcattgcagcattcatagacaacttccgtacaatatggtgagtacaggatgctaggggagcacctcggacagatagagtgatgatggttaacatctgtggtacattttaaagtatgagtataggttatccaggtaaacgtggatgagaataatgatacattcccccaaaaggataacacatggaaagatatggaggccttgcatggacaaatatgggtctctttcttgtgttttaggccatttataatgtgtaaatggattccaataaattagtcaattcaactgctaatcacggacacccatttccatctagccttctcttttgccacttgttggtcattcttggctccagctacctctaattatctagttttctatactgtttggctgtgtaaactaacaaatctctagggataggctttagatttgcaagcagagtctggatgtttttcttaacaatttaaccatagtcagtgccacagatgtgttagcaaaaaataaaagtgtaaagttttattgggaattaacatttcaatgcagttgctgctgtactttacacacagccttgaaaacaagtattataaattgaataaccagaaaagattataactccctacgtctaagatgtgtgttatcctaagtgtctattgtgtgcaataatgtaactagtttaaaaacagtgttcaaattttgtccaaatagtctatcaaagcaaaggatggaattctggtgctctgtactttagttggcttgtgtgtattaagatgagtagctgtaaactgaagtcatttgcataacactccacctgagggccccaaatcaggcctcatctatgcaatcgtgatttttattttattttagttagataatatattttgaacaaaggaattttctgtttgtatattattacctttaaaatgtcactttgtctagcaaagtgtaagctcacagaaatgtgtggatatatagagaaatgttgaataaacacatttacattactagaaaagaaaaagtgatggctggtgacttaggattccaagatgtgcttatttatcagtatagagcttggctgcctctttatagttttctagtacttgtaggaatattagtaagttgcttaactgggtaaagaagtagcaacttaaatatatataatccattatgacacagggcttaaaggccagagagaaaacatactgtttgggacctatagttttatactctgttgtttcaaatctcattatttatcaagaagtgtaaagagccaaccaaggtgattaagggggaaaagacttctgaaccaaatatgtttactcatcactctaaagtatatgggcttatgcagaaatgctaaccctgctacaaatttacactgttcagcaaatactgggtctctatgttttgtttattccaattgtgtcctttagtctctgagtctctgaaagcatggtacaggttgaatgtagccatctgtgatgtcctgtctgatgtatcagagttatcttgacaacagacagcaaagttatagatgtactttgtttcatactaatctggtattgagacctaaggaaactagaataattataaagggcagtttttgaagaaattccccatgctatgtttaaccaggttgataatgacagaatttgcaaattaaactaaattaaaaaatttctaaggttataacatttatactaagatctgtgattccttagaaagttaatgttttagttgggttccatttaagtagaaggttgtcagaatgtgaataaagaaataatgggaaggtatttagaagtgcatttaagaaatgacagaccaaagagaaaatgctagtttgttaataggaagagtagacattaaatgaattatttgctaagatatttacagggaaaggcaggggacagatgccagccacagacatgagtttccccagagaggaaaagaggaactatgatagcacaaaaccagatgatcaaggtattagaatgtgaagtctgagaaaagctcctggccatatggagcccatcccattactgtgaaatgaaaaaagaaagaaagaaaccttcctctctatgcttagtttccaactatacaaggcactatattaaaaggaaatgcaaatgcatttagtttagaagaaaactaaagattaatttagctatgaacaagatgatttttattgataataaaacaatgcattttacaggttataaattgaagtttatttgaaacttataaaatgacttaataaaatatactctcaatctttttgtcaccgaagtaattagattacattaccaaatagttgcccaaagaattagtgtttacatatatataaacatacatacatttatatatattttataactatatatggttataaaataatctttagtatcaaccaatataaacatctcaatgttgtatgtttccagtgaaaatgaagaataattaggattagttaaagcttgatggagttagaggatacttttgagagaaaatgttggataggaggaatacatttatcctatttcaagtactctctaaagtaggtgatttcctaagtgttttaggtcgctagtacactagtactattgtttagtagcccaagggtctacaaaactcaccaagttatgggttcagaagcaggttatgccagccgttagtccagaagttcaataaaccccacctctaggtgcttggtctaattgccattatataaattcacatctttcccttgagtagatatatttttccttttcctttactcctcttagaactacttatgtctctcttatgtaccctttccccttctagaacatctcttggggtctgtgggagtttctcatttacggtccttttgcatctccagtgtttttctccagttgcatcctagcttcctctggttgttgctcactacagccagcattggagctgtttgctggctgtagtggatgggcagctatgccagtgttcaggggcacccatcctctcgtgatcaccaaaaatctcttattaatctcactcccactgctctcagccaagtcacaggctcctacgggtccgcagagcctcctgttaaggaatgggtcacttcctattagttgctgctcgtgtcatttaggctattaccactgcctgcaggtttgtggtctgcacatgaactactcctagggaaaaaaaaaatagtcctcttgttgttattttgtttatgtagagtggtcccacagcagagttgctttggaccttattataaaatctattttatccttgcagacctctcctctcttagttttggttcacttttctagatttatctttgctttatccaatttttttttttttttttttttttttttttttttttgttgagacggagtctcgctctgtcacccaggctgagtgcagtggcacgatttcggctcactgcaagctccgcctcccgggttcacgccattctcctgcctcaacctcccgagtagctgggactataggcgcccaccaccacgcccggctaattttttgtatttttagtagagacggggtttcaccgtgttagccaggatggtctcaatctcctgacctcgtgatccgcccacctcggcctcccaaagtgctgagattacaggtgtgagccaccgcgcccagcctgctttatccaattcttattggcccctaacattttaagaaatagttctgtaaagaacacgttcaagtgtaattcagtacaatttgcaacattatgggctagacaaatataatttcaaggaattggggtgccgcactggagagctctatgaaaagagaaactgtatcccgtttatctgtgtatctcatataatggccaggatgttttttaattaatgtaacatgtttaattgataacgttagagtaagaattaaggaacactctaatcatagcaggtttgaaattgttaattgttaaaatcttattgtcaattttccctcaatgtttctttgtcacaaattaacttttgttattatttttggtgtgagttgaaagtctttggttaagaacaaatatttgtgatcaaatgtgtctgaattgggtgaaggcttgtttcatggtggccttaatcacccaagtctatttgttgcactctcttcattaagatttaagctaggctgggcgcagtggctcacgcctgtaatcccaacactttgggaggccaaggtgggcagatcacgaggtcaggagttcgagaccagcctgaccaacatggtgaaactctgtctctactaaaaatacaaaaattagccaggtgtggtggcgcgtgcctgtaattctaactactaaggaggctgaggcagtagaattgcttgaacccaggaggctgaggttgcagtgagcagagattgtgccattgcactccagactgggcaacagagcgagactacgtctcaaaagctaaatcatctgtttgaaaccctagtatgttttcagacacggagtggtatttgttcatgacctgattactctcatcaacagcataaagcttttattcagtgccatttgtgggttttcctatgctggtaattgtataaaagaaattcaattcatttcaaacatttattgagtacatgtgatgcatcaggtactatgatagatcctggggatatgaaggtgcattaaatgtggtaagagtttgctggtggtgaatcggggagagggatagtttgtttcagatggaaggaacagcatatgcagaaagcacagagtgtggaaaatacatgggctgtgtgaggtcagatgaataatcagtgcaggtaaagttaaaaagatatgcagtctgttcttccaagccatataacctaagattgtagattgcattgagaaaaacaaatctcgtgtcttatagattatttctccaaatgactcaagagaaaatgttaggtagtatatatagatgcttagttaaaacttgttcaatgacaaaaaagcattttaaaatgaaacaaaactaaaaatatgtttctgatggaagtaggaagatggtgcacatttcaaaaagtgaagtacaatgccaagacacttgtgcttagtgactaaggaaaattgtagaattattatgcaatgatcaaaggaatgaattcatgtaataccaaggatcactgtaacagttattgatataaagttaacacctggagctgccagtgctaatgaggtagctcccatcaaggatacctgtgatcagcatcttttatatgcaataaagtgctaaaacagctcctgcataagccatgaggaaaatttctattaacagaatattagtgctggaaaaggatcacatgacctaaaggtatcagcaaccttctgaatacttcacctgggacagggttaagagactattgaactagatgttttacagatgaacaaactgaggctacagaggtaaagagagttgctcaaacacacaactggctagtaacagagccagcgctaatgtccggtacagtgctcctctcctagactttgctgtccctggccagcccctttatgttacatagttagataagtagatatttatgacatcattaagtggcataagtcatttagcttcagagctataataataaaaatccatcccttttacttttagatttgagacctttctaccatatcacaccatctttcatatataagcgtttatcttccgaccaaagtgatatatgatgcaaaaataccaaatataaactggaattgctttatgcttctttctgtgaaagttaagtaatattttgagacaatttacccagtaatgtggatttctttaactttgtagacaccaaagggaccttgtgtttattataatatatatatgacataaattgtaatatatagttcaatgaagctactcagagtggggaaagtccatgagttggaactgtgccactgccctgacgtttgctgcatccactgaccccttgtctccttgactagacagtaagtcacaggatttctaggaagggtgtgtgcatgtaaagggcaattacaatacttcaggcatttcttcagtgttaacagtcatatctaaattttgattccataatatacaatgtatggtgaaatgaaatcttaattattatactgcattacaaagtttatgtttattagtacagtgtggctgtttttcttgacaaacatcaggcctgtgtcaggctgcatctgagatgattgggagacattggcctatctggcctaccacatctatatttttccagtctttctctactattgggaggttgtagaaacttgtccagcccatatgtgcgtcatttactgcagtgaaactgagctttgccccttttctagaaatctgaaagttgagatccagaaccagaagtcctcagggcaattatcaggagcaaaagcaaggaggcaagggaggagaaaaacaggaggaggaagagaagtgaagggtgagcatgccagtggaagggtctgaatgggtgctggggtgaggggtgattgatcaccttcacctttgtgcttgagtatgcctgtttcattgaaagggcaagggaggggccgagcaggcagtgaggatgaatgtggttacttagggtcctgaggagcacaggtgggaaaataattcagacctctataagtctcttctggccttagaaatagtaattctcaaacctagccgtgcctcagaagttctttgggatcagattcccaggaagatgcattctgacttcataggtcttgggacgagatcaggagagtatgtgttttaaaagcacactaaaggattctgatacacagctgatttgggctatatgcctctggaaattctttacagtactcacacaatgattaaatgattatattttaatatttaataaagactctggaatatttacaagataccacttctactttaccaaattcctttgctccatataaaggtcatacaaataagaggcaagactttactctcctattcttatatcatctggggaaaaatcacttgaaataagcatcagtggaatcaacatacagatataaaattgaaatataatctcatgcctctagtgcttaatggaaatgagtacccaccaactagactttgggcatgaataaatagaagtattgaccatcagtcagaagcaatcattataacattttataaagaatgagtgatgcttcttcagaaatgcagtacaagatatgccatttaaaggaatgcacacattattaaccttttaatagttcaagtcattagaatgtgatgttgaatattttcaggtatcaagagaagatgaatttaccacaaggcagcttattccagcacaaagagcccttgatttcaattcaagaaatctgggttctagctctcattcagctactaactagctgggtatatttttctgttttgcattaccataaaggaatatcgtgtagcttgtgaagaagaggtgtttatttggcttggagttctgcaaactgtgcaggaaacatgacaccagcatctgcttggcttctggtgaggcctcaagaagcttttatccaggtcgaaggtgaagtgggagcaggtgtgtcacatggtgagagattaaacaagagagatgtcaggctcttttaaacaactgtcttttgcataaatgcatagagcaagaactcactattgtggggagggcatcaagccattcatcagggatccaactccattaggcctcacttccaacattggagatgacatttcaatacgagatttggaggagagaaacatccaaactgttacactggctgaattgcacaacactccttagtgtcttagaaaaagagtggggctatatctccaaagtttcccaaaatcaaattttctatgatacttgtcattgtgatttagaattcttacacaggaatgggtcagattactgcagtactacagtggttggttggcagaaaatgattcagcccagtgtgctttcttctggtaaaatgctacaactgacaagatcatttctgggtttgccatttatagtctctaaatatctttaatttaaaaataacctatttttttcctggctttttgatctattaggttggcacaaaagtaattgcatttttttggcattaactactattacttttgcaccaacataattttttttgttctagatcatcttgtcacttaacaaatatatattgacacatattatgttcaagacactagcctgcttaatatgaaaaatatacccccaaggaatttagagattaatagagatgacaagaaatagacaatgcccaggaagctagagacattgctataaaatgataattataagaattcagactaggagaccttatttctactatgagtctgctttatagagatggcatctgtgttgcatactaaagttcaggaaggatttggaaatggaaatttggtggggcacagcacttcaggtagagagagatgaaagaactgtatcatgtttggagaacagtgaatgattaagtttgatgtataggacataagaagaaaatccctgggaaacaagctgaaaagatgggttggatgagtgacagtgaggctcatgggtctgccttttcaggaagaaactttctacggtcaggctatttctgggtttgttaatatcatattcctgcccgtgaggcacctttgccattagctgtgatcaccacatagtatgtgtgtgtttcctcacaccagagcttattttcaggagacttttgacatggtatcctggccttgaaacttggcctttgatatgcgatacttgatgtgaaaggttaggttcactgttcctactttgttgactgttttctttcaggccatattctggttttattaattcttagtctccttccttcagtatgttttaagatggtatgtatgaaggagaaactgatgcttgaaataaaagagaaaatgcacgtctcctgatactaagcactaacgatcctggatgttcagagcttcatgatcgtcttgctaacaatctggcacacttacagaacagtaactgcaagaagagactgtttggagaggttttactttcaataataaaccggatatactcattaattatattctaaaaccaacttttgacatggtgagaagaaaatttcaagtcatttccttcagtgtccaatgtcccctgtgctatttattatattcctctggaaaccattttgtttagctattgaaatctattaattttgtcccattggtcatatttaggcccttctataagatgtacttgctgtgttaattatttaactatcttccaacataaataatgtgtgggtttgatttcaagtgtagatgatccaggatgtgttttaaaaggctcaaattcgccatgttgcactgtataactacattaggtgtgtctgggaatggctctgagcggaattagaagtaagggaactttgttcttcatcctagacctacttttcttgtcccttccctctcctgccagtggtcttggcttctgtctctcaggaacagtttctatctgttcctttcaaaacctgcccttatatgatgctcctttaaattaattcacacaatagtttaatcaactgataactgagagttatcctttattacgtgcatttgatttaataggttataataccctaagccaaatgagtttttttttttttttaattaggtatgtttgaagtagagaggcattcctggcttattaaaatgtatccttttgacttttagatcccacagataagtgagaatatgtgatttttatctttctgtgcctggcttatttcacttaacataatgatctctagttccatccatgttgttgcaaataactggatctcatttttttttttatggctgaatagtactcccttgtgtatatgtaccaccttttctttatccattaatctgttgctggactgttaagttgcttccaaatcttagctattgtaaacagcgctacacaaaacatagtgcagatacctctcctttgatatgctgatttcctttcttttgggtatgtacccagcagtaggattgttggatcatatggtagctcaaattttagctttctgagaaacctccaaactgttctccacagcggttgtactaatttacattcccaccaattgaactcatcgatatagagagtacaaggaaggttaccagagcctgggaagggtagtgagggaatggcggggggaagtggggatggttaataggttaaaaaaaaaatagaaagaatgaataagacctattattggatagcacaacaggatgactacagtcaagaataattgtacattttaaaacaaagagtgtaattggattggttgtaacaccaaggataaatgcttgagaagatggatactccaattctccatgatgtgtttattccacgttgcatgcgtgtatcaaaacatctcatgtatttcacaaatatgtacagctactatatacccacaaaaattaatttaaaaatgaaaaatgtattctttatcctctcctatcccaaccgaaaagagccattttaaaaagttaagtatttgataaaatattctaaagctctttgttaggtatgaccttaagtttagcaaacatgcctgatattttatacctacaagattcctctttctagtttgcatttagaatgtgctttattcctcaagtgtttggatgtttctttccttacgtctaatgaaaattctgtattgctgtcaaaattcaaaaagaaccattatcatttctctgtggtagttcaggaaaatttaaattagatttgtactcttcaaaatcaaagcctgtttaggcataaacaaattacatgcaaataatgcagaaaatatcaggtgtatttattacacttggatatgacctttggaaaaataatatagtgcctggttttgttaaagaagcagtggagaactgtggctgaataaaaagtcatctatacacagtaaaagtatagtttctttaagtaattgttcatatcagaattatactcctgttctgatatgtaatgagaaaaaggtgaagaaagttagctccacaaatgtgctaaagacaaagagacaagtggcattatttcatctgcctttggttctaatcttgttaaattaggggagagaggagaataatctttaaaatgccatgtgtggaatgtcatacatgactggaatctaggttccttcaaaccaacttaatattatgataaactggaactgttgtcattgttgtcatttatgccatcactgtatttatggccaaggatgctgcattttatgctgaattacacattaccataaacaaatgacgataattttgatgcctataagaagttttattttttaatgaaaaaaagcaggcaagaagttgtaccgtttggcaagatagaattttcatgaagacaaagtatgtcattgttcatataatgtagtttggcaagtgctaagtaagggtctcagtctcaaaacaagacacccttttgacttcagcagatatgtaaaggctgttcattaccttcctacttactccttttggtagatttcacagtatgtaatgcatcagtgcagaggctctcaggataccatgcatgtaaactgtgatgactggtggagtattgggatcattagactaagtttgggttgtagaggattgggcactgcctgagtgagcttttggaggtgagtgagaaaaaggagcagggggactccaagaaggaggagtgctaacatgagacacagagaatccaaatttcatcaaatcttttaatatttagtaggactaattttaggcccagtattactaattttttcccatttgatatttagcttgtgaaaagtcaacatgtagacatttggttgggaaaaatgttatattaaaacatcattttacctcatttttctaatcatagaaacatggttctttttcctgtaatatttatgtctctggacatttttgtccctgaacatgcatgggtacaaaatcagaaagaaatgagcttaaatactgcctttgcacataggagcaaagtgatttggggcaagataaccacactgatcataattttctcatttgagaaatagagataataaccttgatgagatttttacggagcaatatgatgatatctgtacatcacctcattgagtgctggtacatggtaatgttcaaggttagctagtatcattgtcattgatactactgtctctctgctgagacattctgaaaattatttctttctagaaataagccttttggtcagacttaacaaaaatgttattttatttttaatatatttgaaaatcaggactatcaggctctgttgctttttttccacgtggtacaaatacatgcagagttgatttgattttaaataagtaaggtatgagaatcttagtcaaaccttttttatgccaagaaatgtaaagattccttatttgaatattgttgtggttctttgtataaatgcaatcattatgaaatgtacattatgacttgcttctccatggcatcttggacaagagcttttgcttactttggcagaggtctgtgtgtataagggtgtcttcaaaatgcacagctgactgatcaaagggatgctctaggatctgatgttcttgatgtaggtaagactcattattcagaaacttgataaacagaaatataaactttttaataacactaatgtaagtcatggaactgattcattatacattataaattcgtttacatatcttgtagttaattcaacattgtaaatgttatcttctattatttaatgtcctgtagtatatatctgggtaaatgtggttcttatttttttctgttactgtaatatattagattgctgcttctgtccttattttgcatatcttccttgctttaggccaaaccaatctttagattgtgtctgccaacagaattgggaagtacagttaaagaagcaaaggattacaggtcattgatctgttgcatgacaggcaaagatgcgatagaaagtaagtgatgttttagcttagtgtgttgtattcaaattagacacatgtatgtgtcttcttttcacttataaggctttggcactcatcagacagtcctatgctgggaaggggaattgtaactcctgctctcatttatctcatcatctcctagtcttgttgagaaatctactttgactttgcagatacattttcattgtatgacacagttaataattaggatttcaatttatcagaaagtaattgataaatgttgcagaacaggattacagctttcaggcacatccttctaaaggtgctcttggatactgtattgttacattttgaaactgacatctgttaatgtttctaggtaccttcgttttccatggtctttgtttttgatctcttctggtgctttccttaattattacagcaccaaattcatagtagtctctttttcaaaaaatgtttgctgactgagtatttgctcttatgtctctggaattttttaaagcacgtattgtgccattcattatctaattgatagaatgagagtatataggatggctaacttcatataggaggataacccatagttttcagagtcaagggcactcagctttgaatctcattctatcctgtactagctggaaaaaataaagtagcttcactgagcctagtcttttacacaagtaaagtaggtgtgctttctattacatgctacattctatgcagatgaagtgaaaaaaaaaaaaaccaacttactatcagtcagctcgctggcaggaaacataggacatattcaaatgggaaattgagggaagcaacaccttgtaaaagtatgggcaagtttaaaggggacctacaaggtaatatgaagtatcctggaccagcaacagtgggggatcctcgctatgcataggcctgaaggggagtgataggaatgaagtttctagaacccagaaatagtgttagggtgtaggagagtgccttctggaacggaggcctttggtagaagaatgaagctgaaccatagcctggtagggcatgagaacagggagtaaatacaataacttgacttgattcccactctcccattttctgctagggcttctgattggacaaactcagtcagaaaggaatccactaatgcaatttatagaaattagcctctagggaacagagaagggtggaactgagaggataataaacatatctagctatctatggatctatcatggacttagtgactgctacttagcatatagggtggccatataatttattgtccaaattgcaatacttttgagaacaaaaggagacaccactattaataactgcactaggacaacaggcataaagcagagctgagccaggcaaattaggcttactgttaccttactaagaccataataagcctaggtgaatatgaattgcctttccttttttaaccacttttctcagattctttcttttcttataatagtgtaatgtgagtattttgagaaagaagattggattattttaataaagcaatctagactcatacccctgtggcaggctttccaaagtcgtaattattactgagtcccttgctaacatctgccagaagagtgcaaaggatttaggttattcgttaaacttaaatcctgattatcttgtttagtagtctcccattgcttagaaacctcttttgagcactgaagacagtggaagcagcagaaagtctattaataaatgggatatacatgctttgcatgaagaaatttggtgagctatttatttttctctagccatggtctttctatttctatcttaaacccaagtacttcacatgtaggttgctttgtttttaaagatatctatgattagtatttttagtttgtgttaatattggtgattgaccaggaatggtttttaatgtcttatttcaagcaagaaataagaatactaatgaatacagggaattaatgatatcaacaaacatttcagcatagatacttgtaagttcaaagaccaaaaatattttatttaagtgaagaaatgtcagtaggattaaatggaataaagtgcatttggaacaaaggaaactctatggaaattgtagtttaccttgtatatatgtcttgactgtgattttttgacagcaaacttgagaaataaacaatcctggtgatgtctgcttatcagtgttccattttcatattgacgcatttactgcctcgtttgtgacatccctgccaacatcaataacctgctgcttccctttcctggcccactgactttttgaaagtgcttgctttgcccaactttgatgtatccatttgttcataggatcttgcactgctcctttgccattcattcagatttgaatgaagtctcctcaaggagtgacttactcctttcctctgaagacttccttttagttaacaattggtagattcacttgactgtgagtctaactgattggggtgacatatggctctctcagccctagtgtttttccaacccttttgaaagacagggtataatcctaactttccaatgagttctttttagaacttctttattttattttattttttttgagatggagttttactcttgttgcccaggctggagtgcaatggcgtgatctcagtcaccatgacctccatccacctcctgggttcaagcaattctcctccctcagccttctgagtagctgggattacaggcatgcaccagcacgtccagctaatttttgtattttttgtagagacagggtttcttcaggtttgtcaggctgctctcccattcccgacctcaggtgacccgctctcctcagcctcccaaagtgctgggatcataggcgtgagccattgtatcctgccctttctagaacttcttaatgtcacctctacaaaaacaaattaaggaatttacacaatttggtattggtaaacatgatttttttaaaaagcatatgaattataataaaatattttttgctaccaaatacaattttttaaattgaaaagtagaaatggaaaaattttaaccactgaaactgccgtataaaggtaaagcaaatatttgcaaataagctggttaactaatgtatctattcattcacaaaatactttttaagtcctgttatcaccagatgttccaggcataggggtacaatggtgagtaagataggcatgttctctaatctaatggagtttaaattttaaatagggaagacaagcaatgaacaactacaacacaagtaaacagtttataaaccatcagagactatcaagtgctatgtgaagaatgctgttatggagtcacagagttgctgccttctaggttagggaaagtcttttgaaggaggtgactgttaagctaatgtctgagtgacaaggggcactagtcaagcaatgatctggggagatacttttctagtctgtaggaatctccagcacaagggggctggggctagaaccagcttggcaggttctaggcaccagaagatggtcagggaggttggagtgagcagagaggagagtgctatgagatggcagggagggcttactagattctgttgggctttgtaaaccaggataaagagttcagattttattctttgttctctggaatataattgaagtgtgttatataaggaagtgaaatgatttgatgaacatatttagaagatcactcggacagctgagtgaagaattaaccacacacgtaagccagaaaggaggcttgaagattattgaaaagctattgcaccaccagtgatagatagtggtggctgacaataaggtagtggtgacagcactggagagaaataggcagaatggggtcaagttttgctttgttggatgtttgactttagaaagcagtctataggaatataatagttggtgactagaatcaaaggattgtttgtttctttttaacagaacaagacttcctaggtaagaactcagaagggacttatatgtgctctagctatactacttttttcctgtttagttttcttggcctattatctggaaaagtgctactcaacctttctcataaaatattatgggaaaagtctccatagttgcctctcaacctgtccatattgactgggtgctttgtgttagtctaactcccagtatcctttgtgtacacaattgtaattcatacatttttgtgctatttagaaaagggtgatggtaacttctaaagccgagttgaaagaagcatgatagaaagggatgctgtgtgtaagtaggttgttaggtagatgaaatgacccatgctgaatgaatgtgacaaggaagaaggggatttgaacgaatcacccttagacaaaacaccgcctgtaagtgattctaaggatgcattacagaagcccgttacaagtaagtgaagtcttcctacaagcccacagctgatatcttgattaaatatttagaaggagctcttaggaaaatagaaaaaagaggcaagtgaaggggcaaggaggaaaaatttagagtggaaatggaacttaagcagagtcaaagcaagaagaagggagagtctcattctccatttgcttcaaaaacaaaaaccaagaaacaacccccgccgccaaaacaaaaacaaaaacaaaaaaaacaaacctcagtctgtgaacaaagcccaggtcaatatttggtagtaagaacattgactttagagtcaggcaggcctgagtttgaatccacattccaagttacatgtgtgtccttctgtgcgtaagagagggatgcttatacacagcatcccttcctatcatgcttctttcaacacagaattgcctttgagtctcaattttttcatatagaaaatggagttgtaatgtctaaatcatagtgaccctagaaaacatttaatgagatggctgtatttgactctaactcctgtctgtttatctaagtgtctttggcaaaagacttaatcttttaaaactttgtttcctcatctctaaggcaggactaatatctatgtcacaagattgttgtctaatacattatcattaagtgttattatttttgaaggttcattgtttaaaatctcagaccagaaaaggcaatcaataaatattttttcctttgttattttcttttcttcaagtcttgtatattattactgttcatcttccattacagaaaatcactcccgtacacaatgtttataagttggttttcaagtttgcttaaataagtacatacttgctttgaactatttttctcctgggatctctgcataatttttttcctctcagtttggtgtaattactaatggcttctcttttcactctaaaagtgtcccagtttggacaacaaattatgtcatcaccccacttatggtttctattacttatgtaatcatccaatgtataatttaaaatatatatcttttaattttatgaagaaagagtcatgtcaggatgacatttgtaaaacagttttctgaaacaaagcagtatcttgtttactgaatatgcaatgaacgaatccactggcaagccctgattgattaggacactcatgatgatctgtcactcctggaacatgctggggcagaccagttacattcttgtggatcatttcctcaagctgcatgtcatgaaagtgctcatgatgttagaatgcaatccactctttcctaagtgcaggtgcgtggtggtctctgagattcagatgcccctatgtgcattggttgagttgtcccttgacacccatgtcagggatgcttgtaaaagcaacatgactgtctttagggaaaatgaatttttgaagtctcaacagaaagtatagctcagtgcttttgggggaaccacagggatgacattttttgggaatggtgatttcatttctcaacttggtcatatggtagagaaaaaaaaggctcttttaaaagtatagtctggacattgccctagtaccacatcagattggaaaactatgaaactttgaattcttaatatttcatttctccttaaacgggttataataacacatctatttttttcatatttgattcatcatttgattgatttttatatgttctagcaggaaaggagctaaaaaattcatagtattataattaacaaatgtcaagtacctttacaatttatctcattctactttctatgccaacctctttcctatcacaatataactagaaattcatataaaacagtccacatgaaatagcatctgctttcagctggctttctaacttctcagagttagatacatgaaaaaaagttgaagaaaatgagaagagagtaaaaaataactgttaaattaagtttaaaatgaatacttcagggcaggatttgggattctgtggataattcagtctacctaggaaagaaaatctctaaatacattattattttaaaaccaagtattagagggtttagacttttaaaagcattggatataattttggatgtctggcagaactaggatatcaacttttattaaaacagtccttttaggaaaaaacatgaaatattcattgctgatattattccaaattttcttctatattaaatctggaattagaatagggtacttttaatttttataatggtaggtacattgtgctgtaataatattagctccaatttaaggtcttggcggatgctaggtctttgaagtttactgtctcatgtaatcctccccaccttcttaagagttagggttatcttcatagcacaggtggcgaaactgaggttactaacttggtcaaagccacacaattagtgattgatggagccagttttcaatgctagaacttgctcttttaccatgttacagaatgtagtttgtttacaagagttattatgttttttttcctagatgtcatcataactttagtggaagtcacaatttactgcaatcataatgtttgctaaacacctctttatcccttacttatcagattgccatcattagccttaactacattgctatttatatgacctttaccttctacttttctatggttaagtagatatgaaccatttcagccttctttgttaaggaattttggatatttcttggttctggtcttccaacttaacttctaatatactaagtattttgtgccatagttaaacgtttactaccattgacaagaactgtcagcactcaaaacttttttataaagaaaaaatagcctacaaatgttaagattcagattgttgaattttaatcaataggaagctttgcttaccctctgcagtgaaattttctaactgagattaaacgtggttcctattctcagctgtgccccagtgaatgttcatggagtcattgtattgtttcttaatttcttctttttaaaaatattgatgtactccttaaaactgaaagaaaataacaccatgtgtccagggatttggaagcatagtctgaagtaacttctaatagcataaagtttcaagttttgtttcatattaaaaattcatgtgtgcactgtaacttgtatattcttatctctgatataaatatattgtctaaaatactttcacataaaactggtatttcaggaagacgtgctacattttcctctggtatgaactgttttggaaaactaacttacgttttctggtggcacacatagtctagtttgaaaatcatgaagctaaagaattttctccaggaaatcctattagaaaaaggagccactcatccatttattcattcaacagatattctttcctgaattcactctaatgactatggggacattgggcacaggctaatgactaatttcatcaaggttcttgctttcatgggtcttacattctgaggaggagtattactaaataactaagtaagccagaaaatgccatatgacaatattaggatgaaaataaagcaagatattgtgattggaataaacatggactttttcggatcccataggttgagaaagatctctctggggatataactttttaaacggacacctgaatgataggcaaaagtcagtcatacaaatatatgttgcagtaatttccaggcatatagttccagcatagagcaaaagtcttagggctgaaatgagtgtgactttgtcttttatcagaaagaaggcaagttgtatagagagagtagaataaaagtgaggcctgtagtcccagctactcgggaggctgaggcaggagaatggcgtgaacccgtgagacggagcttgcggtgagccgagatcttgccactgcactccagcctgggtgacagagcaagactccctctcaaaaaaaaaaaaaaaaagtgaggccgggcacagtagctcatgcctattatcccagcactttgggaggctgaggtggatggatcacttgaggccaggagtttgaggccaggaatttgacaccagtctggtcaacatggcaaaaccctgtctctactaaaaatacaaaaattagctgggtgtggtggtgggcgcctgtgatcccagctactaaggaggctaaggcaggagaatcacttgagccagggaggcagagtttgcagtgagctgagattgtgccactgcactccagtctgggtgacagggaaagattctgtttcaaaaaaaaaaaaaaaaaaaaaaagtgaatgatgaagtgaggggaccagattgtcaaataccttgtagactgtggtgccaagagtttgggctccattctcagtgtgaaagatgccagttgggggtttgaaatgggaaagtgacatgatctggcttatccttttaaaaggtcactgtggatgctgcatggataatggattataagggtaagaatagaagtagtgtgaccagttaggtgtcctatgaaatggtacaggtgagagatgatagtggctcagactgcaatagtagccatggctgctattagtggtatattttagaagtagacagaagactcactcattgtttagacagactgaagtgctggggtaaggagaagagtattgtcagagattttaacctgaacaacttggtgtgtctctttttttgtaattgagattttattggttgtgtgataattagtatatacatttcaatttgtacaccattgatgagatggggaggatcatgatttgaggagaatgaacaaagtatctgttatggaaaatgcttactcaatatttaggtgaagaagtcaggtaggatacagaagccagagaaagtctcaggcaaacatgttccagagagcgagaaaactgtaagtacagaggctagaataagcttgatgaattttaggaccggcaagagagccagtgtgtttggagagtggagcaagagagacacactggtagaacagagatcacagagatgactcctataggcaggatcatttatggcctgaaggtcatgcaagataatttggattgcattctaagtgtggcaggaaatcattggtggatttaacccaagtaaaatggcctgatcaacatttgtaaagtgatcactttggttgttatatgaagaaccaacggggaaaggacagtgcagagagcaagagtagaagagggagataaaaagcttactaggaggctttcggagtcagaaatactggacgtcttacaatgtatggctgagttctgtaccatgacaaacatttacaccaatattccatgtgttgtttgaatactcaactgaagattcatggaggtaataaacctattttcaattctataatatatataaatacaaaccatttttgcatagttttattgtacactaagtttttcaggaatacaattattgcacatattgaagaaaatgttgtacttgtttcgttcagaactataacaataactattcaccattttataaaatcaagtcattgatggtaatgccacccctggtatttaaattggtgtggccaatatctcataccagtatatatctgtgtttgtaattgctatcttattgattgctctatgtataggtataagcaactgatttcaacatgtcttgtagcatagtagtatctacgcatttacatattgaaagacatcttatggggtactatactgattttttgtagtgtatataggttacagtatctatgaattttatttcagagtgataaactattgctatatgaaggaggctattagagtgataagttgagaaccacagatctatataattatggataatctggaatcttaagtttatggttatgaccagtttaggctagatgaaattagaattggtagtctcttatatcaatgtaattttcccaggaacacatagctaatcagccacttgtgctagttttgaatttagcccagagtgtctctaaagcccatattcattaccattataccattatatcagggtaaaaatttattttcagaagtttattcattgtagtagagtatgctgcttaaattcttggtgcaaagaaaatgttttaaagctgtgtctctattagcaataaaataaatttgttgattcagccaatttagtgatacaaataattacatttggaggattagaacagatcaaatttttttggtccattatatgatgaacaaaatctgattgtggtttcttttcactcagatccagttgttgagatatcttacagaaaaggctaggttttctcatttttcattttaaacgtgaaaacaggttcctatttgtttctaattatcttctcttatcacaaacttgcctcatacttggttagataaatgcttcaggactatcacaatggaaaacatacatacttttattttaagattttaaaactactaattgtttattagaaaagatcttcagtttttatctctgattttccctttgcaaattcacatagtgaaatgttctttttggtgtcaatgttttatctcatcaagtaccaacaatattattattctgcagaagaatagctaagaaggaattaacttggcagtaattctcataaaaaagtaattttgaacagatatgacagttttgtgagccattgtccaactatcaccaaagcattttaatttgaacgttaaaagaatttgcaacagttaagaaagatagttgctagggaataatatatcaacacattgtgtactatatcaaagagttttttgatagggttttgatgatggggaaaatacaagttaaaataatctgtcttccgtttgggccactttgcattggaaattgatgtggttttaaaagattgatttttaacgtttcctttttattgtggggcaatccacaatatcatggaggatttcttaatcttcatgttgcaccttgctcttcatggtgatttgtgctgtctttgtcttatggatagaaagggaagatccacttactatgtggaagatatagaagaaattaattacactgcctgtggttattatcttcacagaatcaaattacttggtttaggaaatatttcatgtgttaaaaatccagtgtgaaccagagatactgcacctcaaccaaatgaatggtgaaacctgaagataaattttcttttcattactctgcctgtgaaaggcagcagagcacatgtttaaaagctctccagtgaggcacctgagagaaactgtcatcgtttctttaccaaattgaattgtaaactcttcctatttaggatcgtttatgagcagtttgaatgttatttaacaagcataatgttgtggagtagtgttacatattgcctaagaaggaggtttctattacttctatttatcttttgcatcagtgtttgacaggtaacagatgaaattccttttctaaaattaaatcaggcttcatttctgtctttcatccattaaatcaggcttcatttctgtctttcacccataaaggatgaaacatcatttgcttcttagacagttcctgtactctatcatctttcattacttttataagttctgtcataaatgctttacctctttggccttggcttctaacggcctattatagagataagtgtctgggtttgataatataaaaaccttagatgttgctttaccctcaattaaaaagtactttaaaagcagcattagagtacaatgtggtctttcacttttttattatatttgccttcttaaatagttttcgttctttatgaccatgaagagcagtgtttgcagagaatttggggtagctccctttactgaagtccatagctgtacacctgccttctggacatctttacctggttatcccacagcaccttaaatttagcctgatcactgttccttcccatgttttctctattacagaaattggcaaatgatggtctctgggctcaatctagtccactgcttgtttttgcatggccttgtaaagtgagaatatttttatatctttaaatggttgaaataaaataaaaagagtaatatttcatgatatgtgaaatttagatgaagttaaaatttctttgtctataaataatgcttttttggaacacagccacacttggaaagtttcaccactctctcaactcctaatcttaaaaccactgaatcaccttccaacctttccttttattcatattcatattctgttaatgtatataaggcatatctccaaggccaaacttctctttactgtaacctttatctcttgcctggacgattgcaatagttttccataactcctgcttctcttcaataaaatgtaattctataatggtatcagaattatcatctcatgagcattaataaattagatcatttttctcccatgttaaagatgtcattgggatccttctttccatagaacccagtccaaactccttagcactgtaacaaattctttcattcattggccctgattctttttctagtctcatctcctgtggctgcctgttccctcctcttgcacctcttgcatcttaaattcctacaagacagtacttcttattgttctcccccaatatgttgatttctttcaagattctctgccttcgtaatgcggctgtcttatctttattccccttttactactttttacatagcaaacttgatttaagtttttgagattcagcttaaatgtcacatttaagaatccttttcaagggctttcaggtaaaattaagtgttctcccactgaatttctgcacttgtgttttaatcatctatgtagaagttggagctcttccccattttgtatcctcagaacctagcatttgttacaaagatagtcagtaaatatttgttggctgaataagtgctcatttactttagaaagattcttcagtttaattcagcagaaccaaaattctaaaaataataacaatcaagtctattattctatatggtctggaatgaacctctgaatctttgtgggtgattatctaaaagtctctgataagcatctagaacagtcttccttatttaattctgtggtttcctaacttgcaaatttattgaataaaatgtaccaatttatctgttaactatttgcttcccaaataattattcatgatcccaattaaagaaaaaaaaaaaagccctccgtattctaacttttgttgtctgtgttatgttgatttagttttaatcaatgaattaattatttctataggcaatagttaaattttcaaattcagctttttctggtgctttttggtatctcaaagattagaatggcaagaagatcaggtcatgtagaaatagtacatggctctatcacctcaaacttttatgcaaattatcctagctggatcattacatattgcatacatgtattgaaacatcacactgtaccccataaatatgtacaatgattgtgtaaataataaaataaaacttaaaaaaattatgtgttatgtttcacttattcaaacccgatatttatttgaggaattagctaagcttctgatgtcctatcattccccatgctctgtccttggattcacattactgcttgttagcatatccatgggaggctagtcatgggccttactgaactattatatatgtgccttacatagactggttggatgggaaagaatataaaaccatctaaataaagattttaagattatctatgagtttcattcttctattattttcctggctccatttagtgtggacaataatggtgagacaaacttataattatatagttctttatacttatttaaagtgctttcacctacattatgcctcctgctaggaaggcataggtggtactgttacagagatttttcaagtgaaatggatgctcaggaaaatgaaattactttctaaaactcttacagttagagatgtgataagagtaaaacttagttcctgactccatgaaacttttctgattttttcttcatataaaatatgtgctcattatccaactattgcctctgggctctaaaactacccttccatactctgatctgtggtacagggataggatttgcagggtcctgctctccttcattagatggcctcctgttagtttctgccaatagagggcacatgaggaggctagacattgctggaggaagagagggattttacctctccctttttgctgctgtttctgtcagcatatccctagtaattgaagttgaatggaaacttatcttggccttccccaaatcagcctcatcatacttccttagagctaccagcatccacaaagcagtgcctcttctcagaggttcaagtcccagcccctcctgtgaacttctagattctgatcgctaccacacctctcatatttctcaatacttagtcatggtagctgctttctgcaattattacgtctgtgctactttagtgttccattcatgctttctcagtcccctaatttaatacctgtgaaatcacttccctaagttatatgcacgctattgaaatacctggtttggtttttgttttcctgaaaaaatcctgcataatggtatgcttgttatcaggagtagtcacagaaaatatactctgggattaggtgatattctggggttggtttggttatgtatttgtctttgtcttggaagcagtactgatttttttttgcttatagtatgcagtggcgctcaattaaattattatctatggttgattgaaatgaagtgtctgctgaagcaagttgttggagggattaaatgggtgggatagctttttatgacttcactgaggagctttcgaaaaagaaaagggcaaactcctttctttaaacccttgtttcaaatcactgttagataatcagagagctttcatagcatccctgaaagattttattccttattattgcgggccaacccactagaaagagacataaaattacaccaccctccctttgttcaattatttcacctggggaacttgcagtacaaagggatgtttttgtttccaaaccccttcctattacttccagacccagaactagaatcagatatcagaatactccagaggaagaatgaagtctgacccaggataagataacttatattctagaatgaatgaaaaattttgctaatttatatcaaaagtttcaagggttttagactaaggaggagatatgtaatgatatatatatagcataaggttaaacttactgctatggttaaattggcagaaatttgtgatttcatgttttagtttgtttagtattttagttccagctctctgctgaaagtggttgtaaaaatttatctggttagtaactgaaactttgactcagtggtagcctaaattcaatgaggttgaaatcctagaacttctgtggcatactatgaaggaaggaataaaagagcatatggaggtaggtaggtattttggagtagatttattccatgtgtcttgcacaatcgattctctccatgccatcaccaccacacgagacactgtattctcagagagatcccaaaggacattcttttaacttaagcattgagaaatacattgacaaatagaatgccccagaagtcactctcttctataagccagagatgatggtgggagatgctgccaatgagatagcttcctgaattcactggggtttctggaattctacaggggcaaggtaattccaagtggtaatgcctagcctttagaattaaggggagaccattagtagaaggcaggagtagccaattagcatggagcatttttattatctgcatggattttttggttatagataattatggtattcataaaagcaaatatataaacacttttctaaaatatcacttaatctgtaaaaaaaaaaagataaaattgtaggtctggtggccaggaacttgacttgcatcaccacagtgaagggtcctggcctctcactgagttcgtaggttaagtcagctttcagaactggaggcaaaatcctcctaaaggtgaatcctaaagtactttcacaagtatatataaaatcttccttcaagttctgcccaaaaggacctgcaaccactaactagggtgactatgcacttgggagagagaaatgcccaaaatatatagggattagtaaatgttgtgtctaaatttatactaattcatggacccaaaatgctactgcagtccactagtcaaagtggagattgtgcttgtcctgacacagagccaggactagggtaaagcaagccaggcatgtagggcatacaaaattgtagactgcactcacaggtttatgcaagtgctgagtcttcctgaagtctcaatcctgaattaacaaatggagttttgcacacagtttatccccttagtgggtccatggacccatattgaaattacttctctggcatctgtgtgaataattgcaacacactcaaacggcaactgtcaggttccatacatttatccctgattcatgaagtgaaagtttttctggcaggatgggacatgggtaaacttctggaacttttcatccctgccaggacggtgaacctaaagtagtactgcaaccctagagaaactgcagattagtgccaccaccaaaagcttgaaatatgcaggggtggtggtttccattatgtcctcattttatttccttggtcgtattttgaagaagatatatgtatcttaaagaattactgtggattatcttaaatgtaatcaggcattgattccagttgcagctgtggtcccatatgcggtttctttattgaagcaaatcaacgtagccctttggacgtggtgcacagtaattgatctgggcaatagttttgtctctatgactattgcaaagatcaccagcagcagtgtgcttttacctagcaagatcatcagtgtatctttaaagtcttacctcagggctatgtcaacatttctctctgccataattcagtcctcaaagattatggtggcacaaatcttggttagcttatttggctttgggggacaacataaaccacatttctttgttgctccactgtgtctactgagtaactgaaaaggcatctcatagaaggaaaagcctctgcagctagtaacactgcagtgcaaactactcttctacataggcctagtgtcccagtagacataataatatttgatgtatctggaaatggagatacttgtggaacttcttaaaaacccttataggagaattagggttatagtctctatggtttggagaaaagctatgtcaacttctgcagttaactaacctcttttcaaaaaatggttcctgcaaagctatcaggccttggtagcattggaatacccgaacatggatcatcaagtaaccgtgcaattttagctgccatcataaactatttgattgggcatgtgtgcaacaatttatcatgtgtggaagaatatgttagagaccaggcttaagcagattcagaaggcacaagcaggtgtctcaaacttttactacatataatccttctgcattacctctcctccctcaatgcataactaagccctcatgggggaatttcttaggaatagttgagtgccaagagaaaaactcgattgaggtacttgagtgatccgtttgaaatggtcagagtgtgaagatgttgcattctatgtaaatgttcaacaaaggcactgccagagaacaggctcagaacaaccatgtggaatagaagacccatcctctggttgtcagttggcctctctcctcagccattctcattccgactcaatgggttcatggtcatggtggccatggaagcaaaactagacactattcctgggctcaacaacacgaatattcccttaccaagactggtccaattgctgccagtcctgagtgactaatctgacagttgtagaggctaaggctgtgtcctctgtgggtaccccattgaagagggaggaggagtccctcttaggagcagattgactgtattagacagatttgttttcattgtctaaaaaatgtttttgagatgcagaatggtgagagtgagaagggggtgagtgatgagaaattaatgggtacaatatatatttttcacacgatgaatacacgaaaattgcagacttcaccagtacacaatatatccatgtaacaaaattgcacatgtgctccataaatttatagaaattaaaaaacaaaaatattttaatatgttttaatgattattgactatattagtttgacttttactatttaagctagaaacctgtatccttgacttccatctttaatttgctctctagcacttcacactcactccacccaatatttcttataattacaaggaatttatttggcatttgtaaacacattatgctttttaagcttctagcaggcccagcttttctattctacctggccaaaataatattcagtattcaagacccatcttaaatatcacatcctttaattcctgacaacatttcctatgtatttacagcataatatttctcaggctattattaagacatgttataagtgcatgtttaccccatctaaatagtatgttccacaaggagttgccaatgctattattgcatcctgtccttctgcttccaactcaatgactattatattgttggttctcagtatgtattaatgagtgaatggaatatggtgctttccactttgtttctgcttttaccattacattgaatggcaatgagtatatatatatatactcatcatctcatacagatccatcaggatctgtaggtcagtttgaataatgatagtaaagcagtaagacatatgagagatgagcattggtctaatattcaaaggcctaactctaggatttgctagctgtgtgaccttgagaaagtcacttaacctccctgagctttgatttcttctcttctaaaactaggcctcttttaactttgtaattctactgcttaattactcacttcaaaaaaagaaataaattgtattattggaacaattaacttttagaatttccctttcttattctttattttcatatagtttaattacttaaataatgcagataaaagcttttttttcttttgaaaatgatcaatgcttaaaactttgctaggatacaaaacataaatctttaaataatttaatatgcactcatatatatgaatatgcaaattttaaatggaattaatttgaagctgaaaatatttataacatgctgttacaaaggattcatcctacatttggaatcactatagtgacaaagagccaaatcatggtctataaagaattcttaattcttttcttcactcagaaaaatgatcaaacatgaggaacctgatgtctgttagttaattcattcaactgacatgaaggaagatatgtttttccccctttgcttatctaggtgttctaaattttgtcattcggtcaaaatagattaagagatatgtgtacctagaatgcatgtttttcttttcttttttatttttttaaatttttttggttttgagatggagttttgctcttgttgctcaggctacagtacaatggcacgatctcagctcactgcaacctcatcctcctgggttcaagtgattctcttgccttagcctcccgtgtagctgggattacaggcacctgccaccatgcctggctaattttttgtatttttagtagagatggggtttcatcatgttggtcaggctggtctgtaactcctgatctcaggtgatttgcctgcctcggcctcccaaaatgctgggattacaggtgtgagccaccatgcctgcctagaatatgtgtttctctatatccaccccatacaattttttttttacagaattgcatttactgaattggtggtatgctattatcatactatgaagaatgctataaggaaattatgaaattcacttttgatggattgttagcaagaacatccttgatattctctatatcttgctactcaacatgtgttccatgacgagcaatgccgacaatacccaagagcttattaaaaattcagagccacaggccctacctgtagatgaactgagtcagaatctgcattttaaccagaggctgaggtgatccatatgcacactgaagtgagagaagcactggacaccatgaccaaatagtgtcctttttatgagattcctcataaaattggcttatgataaagtttatttatcttaaaatagtaattatatgatatgacagtatacataattaagaaaaaaactgtgcttctccaaataagagtatttgttattgttttcaatcttttgaacactgttgattgttggttgatctcatttccctatctgctttggcagtgtgtgctaccacttttgagtactgtatggtagtcctctttgaaagtacttttcttacccttttatttgttgatttgtatgtcattcacatgctccctttgccttgataccttcagtttttaaaattgttaaatggtgtattaggtgctttgaattcttggtgggatgagtataaagaaataaaaccaaaataaagagcctaaatatttccaggatttgttatataacttgagcattgcaaacctactctttcctctttgccacctacctctctgtaacatcataattaatgttcattatgaagatttttgaggcactctgggggttacagttatcagagaagtattaattatactcagcacactatactgtacttactgagccagaaacatggactaatatgttttataaagaatttaaacaagggtggaaaacccaaaagatttctgactaaatcagaacattcacttcaattaaaacattccattttatgagaacactggtgaatatgagtctgttaagtctttatagataaattatttttctagtccttttttaaaaccaaagtacaatgattttctaagaatctagaaattatttacatcaaatttgtactgttaaaacaagtttcaggtaaattctgagctaatgttaggctatatatctttaccagcaggcagccaagtagttgaacttactgcctcaggaatccattgaaccaatagtggctgaataattttatgaccagtaataaggctcacaagttatacatgctaagagaggggtaatcaaatcttatgcttcagggcataaattaatcactgcaggggtcagaaaagaatctcctttgccctatgaacagaattgaataattaggcagtatctgtattgatactgttttaaagccttgttcttaagcatcagaattggttttaagaacaattttgtgacttcgtgggggtgtttgagctcttgattagaagaggaggggtcctgcaagttgagcagtttattctggcagacagaaaggttgggcagcttcctgattccacactgttcaacctgattttcattaaaagctcaaagtccctgctgttaaaatgtctccaggcagctggggcaaatgggcctccttgcctatctggaaatcttgtggtgggttttcatcttttaatcaattcttccatgagggaggagggatagtttactaatgtgcgaggtttgttctctgtcttctgcaactcatattttacattttaaagaagcatttttctggattgaggaattaagccttgagtactttttcaggaaaacaagatcaaggggaaacatgataatcaaatgacattgaaggccaaaatcaactgccaaactcataaatcttttcaggtttttctacatggttgttgaacaaagcatgtcaactgttacgttttttgttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccgtgttagccaggatggtctcgatctcctgacctcatgatccacccgcctcggcctcccaaagtgctgggactacaggcgtgagccaccgcgcccggccgttacggttttatgataacacaaggatactgtattccatggaaagtagattttatttcctacatctttctgctatagctctatcctcagcagttttaaatttagatatggcaacataactttcaagttatctccctggagtattcctactaaaaggaaaactaaagggtgaaccatttccaagtaatgactgcctacgagtggcctagattctcaatacacctggagaagaaaacaaagactttacggacatacttattttttgaccccattggccttctagatgtttgtatatttggttctctttgttcttactttgttttctttttgaagtcagtaacatattgttaggctagtccagcatgggttagacatatttatttttgatgtaaaatagtatatttttttcatgaaaggatttactatatcctttctagaggcctaacactgaggcaggcatgtaagttaaaataaaggcagcaagttttctctttggaagctcataatctggtttggaaacataggccatagccggaaaacacagttaagtcatgttacaagcagtcaggttaagtgtcagaataatggtgtcaacatgggctggcacaatttatggaaggagtgaggctgctctgggtactgaagagtatgcatgctttttttggggtatgggaagaaagctatcacttgggagcatgagtgtgtgcatgtaggggtgtgtatgcatacatatgtatgtgaggggatggagatgctgcagaatgaacaaggacttgaattcaagaaggaactgaaggtaaacagggtcatgtaaatggaaggaagcctgacctctgaggaactgaatgccagggtaagcgatattctaaagagattataaagccattgttgaaagcaaattttgggaaggatatggttacaatagggaagctgggatagaacaggaaagggccagggtcaggaattctgactagaatgccatccagttgtgaggcaattatgttcacattatctgccattcacttgggtttcacaactagaaattcttcttgatcagcttggctttttatttcctctgaaagctcaaggttgttctttgccaaaagagagtcgagaagtggagcttgatttcactgacatgtgctaatgtgactacagcactggtatagactcttaggagctagattcaagcatctttatgtttagatcaaaaacgaacacaagtatgtgcccctaaatcagtgttgaactcggtatgtttaatttcaggatcagttttctttatgttatttttttccaaccaggtatccaatattttttacaaggccattctcttgaattaaatatacattagatatctcatctagataataaatctttgtgtcagcacctatcctgatctcaccagatttcattttgcagcatttccctgatgcttagcaaagtaaatcaactgctttgacaaatgagtagcttaaactccttcaaaaagtcagtcaatagtgcccaccgaatgaaaattcttccctctgtgtcttgggaatacaaaaagaactggatgactagtctccactcctcataagatttcaatcgaatgagaaaaagaaaaagcacagactaagcattaaatgaaaacataaaaaatcctagaataataacatctctgcatcaaataattactgtgtaccaaaaactttacaagcattatctcattgacttcttatgtcagccccatgggttgtgttatcagcatgaataattttgcagatgaggaatatgaaactcagagaggttagcctccttgctcatggtcacacatctagtaaattgcagagtcagaattcgaactcttatttatctctttcctcttgctgcttttaggatcctttctttactcctgacctttgacagtttggttataaaatgcattgaggtagtcttctttgggttaaatctgcttggtattcggtaactttcttgtacttgaatattgatatctttctctaggtttggaaagtttattattccttagaataagctttttacccccctctctctctacctcctctttaaagccataactcttatatttgccattttgtggctattttctagataggctttctattttctacaagaagctttcttgtaggcatgcttcattcttttttattcttttttcttttgtctcctctgactgtatattttcaaatagcctatcttcaagctcaccaatcctttattctgtttgatcaattctgctattaagagactctgatgtgttctttagtatatcagttgcactttcaactccagaatttctgctcgattcttcttatttatttctatttctttgctaaatttatctgataggattccgaattccttctctgtgttatcttgaatttctctgcatttcctccaaaaaaactcttttgaattctctttgtgaaaggtcacatatctctgtctttctggattgctccctggtgccttagtttgtttggtgacatcatgttttcctggatggtcttgatgcttgcagatttttttttttttgctacctgggcattgaagactgaaatatatattgtagtctttgcaaccttggcttgtttttacccgtccttcttgggaagcctttccaggtattcaaagagacttgtgtgctgtgatctaagtttttggtcactgcagccatatctgcattagggagtaccccaagtgcaataacactgtagttcttgcagatttacagagttatcaccttggtggtcttggataagatccagaagaattctctggattaccaggcagagattcgtgttctcttcccgtaatttctcccaagctaatggagtctctctttctgttctgagctgcctggagcttgggaaggggtgaacacaagcactcctttggccaccaccactggaactgcacagggtcaaacctgaagccagcacagcactgagtcttgctcaaggccccggcaaccactgtttggctactgccttgaatactaaaagacctagggctctacaatttacaattagcaagtgtcaaagccaaacaaggccctgggtgggttcagaaatgcagtctaggatccagggtctagagtgtgaaatcttttaaacctacctggtgccctaaactactgcagctgagctggtactgaaaccactacacaaagtctttcccactcttcccttccctttctcctgggagaggagcctcttcctgtgtccatcaccaccataggcccatggagagtattgccaggctaccactggtattcacttaaggcccaagggctctttactcggcttgtggtggatgctgacagacctgggactgactcacccttcagggaagtatgcttccctctggcccaggataggtccagagatgccattcaagagccaaggcctggaactgggtacccaggaccctgcttagtgctcttccccactgtggctgagttggtgtctaagcttaagacaaagtcccctttacttttccctctacttttctcaagcagaaggggtgtttccatagccaccacagatgttaatgtgctgggtcacacatgaagccagcatatatctgtgtctcgcccaatgcccacagtatgtactacctggttactgctgctggttattcagggcccaagggccctttattcagcagaggatgaattttgccaggactgggtctttcccttcaaggcagcaggttcctttctggcctaggttgtatctagaaatgtcatcgggtagcaagggcctggaattggggcctcacaactctgcctggtgccaaatcacactgtggctgagctggtatccaagttgcatgacaaagtcctctttactcttccctcccctctcctaaagtaggaaagagggatctcttttggaacttggagctgccctgcctggggttgggggatgggtggcacaagcactcccttagcttccctggttggtgtctcattaggtcacatgcccctaagttcattggctctgagcccagcacagcactaggacttgcctaggagttgcagtccttgtggtttagacagcctttcaagtttatttaggatcccagagcactttagtctgtggtggtgaggcttgctgaaactcaagttctgattgctgcaataggcaattcccctctggctatggctggtccaaatgccccctctgtgggtgctggccaagttctgtctagctttggcagcactgtgttccaatgcaaagttccacaatcactacactctccctcccgcaggtgcccaggttctctctccataccacatggcgaactgctgtgaggggatggggtaagggtggcatcaaaatttgagattgtctttcttattctcttcagtgcctctttcagtgatatgaagttgaaaccagatactggtttttggttcttctgaaggtgcttttattgtgtagatagttgttaaatttggtgttcctgcagggaggacaattgggtgtcaggaggaggcttctattcggccatcttgctctacttccccagaatctgaactcttggctcttgaatttttcagccagatctcctttcaggttgctataatcagttataaaaaggcaaaaatgccaaagttattgtttcttaattaaaaataaaatgatttgggaaggttacacagagtctgacttaggagccactagggttgtggagaaaacacacgggttagataagagtcttcaagagaaaattccaggtgagggaaatggcaggcttgtaattacaatgcaaaagactacgggtgtgggacagcaaacaggaccagtgagttgacgtgagagatgaagggagaggtgtccccaaattaagagcattataagaagttgaaatcctgacttgaaatcttagtgctggacacataaaacattatatgtgtgtgtttgtgtgtgtatatttacatatacatatatatataaatgtattagcagttgtcaatgcatatatatgaatatacatatatgtgtacatatatgtatatttacaatggtgggttgtaggtgctgagcactaatgtgagtttcacatggcaaaaacaaaagagggacagcagataaggtgaaaaagccagcatctttgggtattaagaaacccagaaccacaggacttaaattatccttaaaactccttatggcagtaaaggaatgtgagcgtcagaataaatttcatacctaaaaatttcacatcttactcttttttatattacactcctcaaaacttcagaaagtcctcccatatcatctcccctttaaggtggccctgactatagctttaatctgcaattctttgtataaaaagttctaggaaatggagtttagccaatataattttcccaaaccttggaccatgggattaggattaatcgaggagaaaaacggcaccaatattgtttgcatgagattataaaatgtcagtgtgacaaaattttttgtttagaaaatttataactaaatttattaagtacagatttttatccaatttattgtatcagacagcaataattcaaaagaattccacctctgcattaccaaagggcaaatataaaagataagaaaaatttaaacttgtgaaaaatatgtttctgtacttttcattgcctttcaaccattttgaattctttggattttggtgttaaaagggtattactgggatatgtctgtgtttctaggctgatgaacaatgaagagtacatgatttaaaaaaacctgcagggaatatttaactagtatgtaccagcaataaaatatttaaaaacttatgtactagttggtaaacagtcattgccctgagccattggagtgtcttcccctacaatcctttcctcccactgctgcatggggcactctagtctctggcccttcccccaggattatttcttcacctccctaatgcacagtatctaaagggttgattagtacagcagtgaggctccaagacactgctctggtgccccagtacccaccttcatgttgtatagttgttaaccattttgaattgcaccccaagaaataacatgcaagttactgggtgaatgtgattggaaatgtaaccatgtcttctcttactcaagtacttctgtttgtacctctttctttccctacttttcttcccttagtaggtttgctaagaaacatacacatataactttggagatgatgcatcctttctcttgagttaagtgtgtctctagctgtattcatgtcctatattcttgttctgattttaagaaaaaaaatgttgaaaataataagagtggtattttggtcactgtatttgcctatgggctcaaaacaagaaggatttattatgtatgtttccccaaagcagaacagttctgagattgatgaaaaaactccaacaaattgactgactgatctttagtgagtcaacctctgcaaaatgttcctaggattcggctgaaagagataatgtgtggattaaaaaaaaccccttagatgtatctaagattcctgaagctccatcactgaattaatcataactttgaaacattagttaaagactaccctctaagtcccttttctgacttttgatttttcactgagaagtccagaataaaggtgccttcactttctgggccacaaggcactggaatgaaatcttttgtaataccaatgagacttgtgctcccatctaagagatgctagctccctcctgctacatatgtggtaagcttatttttctaccacctgtgaatatagtttaataatgacaaacttcttgatctttacatcattcatgtctattttaaagtgcatttgagaataaaggattctaggttttcctaataaatattaaactttaaaataaaaactggatcatgtgggtgtattcttctctctgtgtgtatatatatatatatatacacaacatgtagatatgcatgtgtatacatatacacatagacacagagcccctatatacatttattttggcttgatgactcaggatgtaaaatgttgtttctcttaatgtttaataatacattaatgtatttctggtacaatacttctttagttgcttataatattccttatgatgtggaactgttctttacatttctacttgaaatgcatttgctctctctcaacatagagtatttatgcagttttacttacagtgacaaagagatatttctttgaacatattatatgtaaagcaggcttgaactcagcttttgattaaaacatagttatgtggccttctagctcagctgtaattgcatttaaaattcctttctgcactctactgaagaccgcaaaccaatattaataaagtaggcttagagcagtgtagcacctgagcaattggttcttgacaaacgttatttacctagctagagtttcatttcagagctaacatgtctctgtgctacttgaataaagcactcatctgaaaactctgttagacattttaacccaatttaatttattccctgaaagtttaatcccctgttgaaaagagtagttgcaaattttctggagttacaattcactgaagtgaaaaatagttaatgacatcaagagtttagttaaaaatctttctcaaaatgtaaaacagggggcaagagttaataggatattttatatagttatatttcaatccttttccgaatcttcctaaagtcacttgcttctctaccattaaagaggtatgaaatgagttacttagacatctccaggaagtagggggaaaaaccacttatatttgaaaccagaaaagcaaatctcttctgagctttgtcatttaagtggcacattcagtccttttatattttataacaccctttttgtatcacatccaccaaacgaagcaaatattaggtgccggccatctacagctttctacctaactgtatgaggaagcagggtacagtctgcaacacagaatgctttggcactcatatgccatcaacccagacttgattttatgcagtaaattgtccaacagaagtctatttatctgttattgaaatatttttggtttcactgccaaagaggataaaaatatgggtggagagaaaataaaatctgaattgactttgtttttggcatagtagaaagcattttggtcccctttatagtctcttaaaaatttaattattcatttggcagatatacctctatagcacaactggatagttgttttaaaatatgcaaagcgcagatttcagacttaataggagataatgactgctttatagcctgtcaggtcatggcctacttggcctagttacagagatattgcttcatggttcagtgctccaagagctgatgatggctccaggccagcaaaggtgtcattgacataatagaaagtaaaggtttctctggaactctaatgggatgctccataaagcatagatcaaaaatattatggcttggatagtacaaccctagtggggacattgggtggtatttttcctccatatgtcattaagaaaacaaccaaaaatttatgtgcaaagtcataatttcacattctaaaagtaggattattaatgaaaattatattatatttggtggataaccatttgaaaaagataacagtgttctggttgcctaaatgacttggaaagtcaccatttaggcagttcccataaaaaaggcatctgccttaagagctgtcagcctgcagcctggctccagaatctaggctcttaccactatgccatactacttaaaatgtgcaatgttttccgacgtgaatttaaattatggaaatgaaatacttttatacaaaactaacgacatagatcaatataattgtattgattattaatgagtaaaaataaaataaaaaatacaatattattaaccactgagaagaacagcttatgtacattctaattctcaaaataacactgggacagggggattctatctctaaattagaataagaaaatttagattcaagagattatggcttcataatcaattgtcatttggctatgaagtccttgctgaatatccttgagtgtctgtataagcacctggtgtattatgaacagtatgatctgcttgtcagctccttttggagaatgatgattgaggttacactttaacttgaagttcaaggattggggaatgcctctacttggttaagtgtccattcttggttcatatctgttcaatgaactgaatcaccaaaatgtacactcttaaatagcaataggtagtacaaccacctttcatttggtaataccagtaatagtaatcttgtggttttgggtcagaacagcaggataagaattcgaatgctgtttcttgtatgtgtgattctaaggccatctcttggggcagtgggtcttgcatttctctactctatcattaggttactggtatctacatcacaggcagatctgtggggatcaacccactcacataatgtattaacatatgatggaaatgataaacactatgcaaatatttgtttaaaaatctttatgattaaaataaaataatgtcagcctcagactgaaagataagtttagtaaatccagcaaatggattttaaaaaacattagcttcgcttaaacaaaatgtgaaatgaaacagaccacaaaatgacaagatttaatgagcttattatcagtaaaacaattgaatataatgcaaattaattacctgtaaaattatattaaacaggctaaatgacttactaggcgatgattttgcatagtacaataatattttactctctgcaactactaaaaacattgcttcctatatgctcaaaccaaggaattccgtttctctaatatcaatttgtcaatctaaagttctagaactttcctataaaatgatttgcagtgcacatcagtacaacccaaactgagggacattttaccgattaatagcctatgctgttcaaaaatgtaaagaaccagaaatagaagggaaataagctgtagagtcatgacaactgaatgcaatgcaattgcatgtattggatatagattctggactagaaaaattggtaggcataatggggtaacagatgccattagaataatggcaataggttaaattatggtaatatatcaaggttaaatttcctgattttgatagttctactgtggttacataagataatataattttcttagggtctactccaggacctgcttaagggtaaatgggcatggtgtctcaaagttactctcaaaatggctcagaaaatttatacacacatacatacatatatgcataaatatgagagagagtaagacagcaataaagttaatgtgatcaaatgaaactaattggtgaatctcggtaaatggcatatggaagtttcttgtaactttttgtaaattggaaattataccaaaataaaaaaataaaaatctaaatacgtttttgtgcagatttaaattaagatggatagtctttgcagtctatttaagaaccaagattacttaaagaaagacagtttcacttaaaaatgcatttcttgtggctcacgcctgtaatcccagcactttgggaggccgaggtgggtggatcacgaggtcaggagatcgagaccatcctggctaacacggtgaaaccctgtctccacttaaaaaaatacaaaaaattagctgggcgtggtggcgggcacctgtagtcccagctactcgggaggctgaggcaggagatggctgtgagcccaggaggcggagcttgcagtgagctgagattgtgccacgcactccagcctgggcaacatagcgagactctgtctcaaaaaaggcatttcttgattgtttaaacgatcatccagttcgaaaaaaccataaatctcataccttcctttaacattatgtgagactatgaaataaacattttaattaaaaggaaattaatgatacacttagaatatgctatttaatttcaccacccccatggcaaattccatgatccttcgtaaatattacagatcaagttaccttgggtttactttagtacttcctgttgagagttactgactttcaaggcttgtagcaggagagaacctccaaaataccaggacctttattcattagagggtgaaaagtaccaatgatgtgggttatatggaatgagttgacttagagatggatttgaagtatgcgaaaaaaaaagacttccatggaataattttttaaaaattttaatattatagttatttaacaaaagcttgctgatggatttatttatttttgcctgggatagaatagaaaatctgacattttacttttactttccccttttaaaagcaagacttctgaaaataggaatgaatgagattttgggaaacacatataaaacattttcccttcagagcctgaagaataattgcctctgtgttatcatttgcttgactgaaattctgttacaatggttctctcatttcaattctctccttcctcacagtcctcactgttcagataaaagcctgggaagatctgtgcacaagtttgtgtccaaagtcaacccaagagaccccgaggtgtaattgcaatagactaggttaatgcctcttttttaggggtttgcaaatggtgccaattttctagtatctcttcctttcacaaaattaaaacttgccagcaaagttaagcaagttccttgttttgaagtgatttggtgatttccagagctttgaagctttaaaagctctgaagaagacgttaaataccagctctcaataaaggaaaaccttggaatgcaagaggagtgggctggatggtaacgaaccttcatcacaattttggctctgctcctaaccatcttgatagccttttgtgagtcactttagctctatgaggctcagctttctaagttataaaatatgttcaatggccccttccagcctcagatgtttagtgattgtaactctcaacagtcatggattttcatgacacaaccacagagcaaaaatgtcacagtcaaactgtgtttatttacactttatcaactgtagagtcaagccaaaaatgccttcaatactcacattttaatatcgttttaatttgtgctgttaatgaacacttttacagctctattttaaaccgttgcaaacatacccataaaattgtgtttgcttcgcattttaaaaaccccactgcatttcccaagcaaataggcatttatgcaaacaaatagcctaacacgtgtctaactgcctgtttcaaagcaattattatttgtcaatacaaatgtccacttgagtagtgcaaagaaaatgctcccagaaagtttggcaggctctgttctctgcttcaattctatcagtattcttttcattaccacattaggatcaaatttctagaaattcaaggaagaaaatgtagaatatgatgctaactttcttgccactaagagaccatactcactattttattaagttttgctaatgtttgtcaagccccccaaaatatagttttatgctcatctaggtattttgctcttattcagttttgtcttaagtaaaaatacatttatttggggatttttggtataacatttttggttataatggcctgtagcagtcacttgtattttccaagaagaatgccaccttttcttcttgtgccactgtgcatgattacagaattacacaaaacctccacaaaggattacaatacaaacacctttatatctgccagatatataatatttaggaaggatttgtatagggtgctatgagtggatcaatgattgctgtagaaatgaagtttatggggagctagataatgcggagttagcttagctaatgggaatgtgtagataggattccaggaaggggaagcagcttatacacaggttctaaagttggaataaagagagcacatgaaaaagtctgatgtgcaaaaatcctgagactaaagggaaaagtagccaacatgaagctagagacatagacacatgttgcattgacttagactactttccaataagtaagcaagtagataagttaataaataatcaaataaataaataggtaagtgtatctgagctttgaacatcctttctctcaggaatagggcccacaataacttctttagtggatgacggcttttagtagtagttccttcaacaacagctgctccttccaggtcactaaagctcacagaataggtggttcccacagagtgcctcagccagcagttaccacaaaagttcctgtccatcttttttcaaagagacctgggacccttagtgacacaatcctgtctttcagcaccatgaatagaggcagctgtcatatgtcctagctgtgccctctagcggcagctggaatgttacccggctctttgaaaagggtaattaaaatacctctcagtatttgaagtcagtgagtttagggacatactaggagaggaaagtcttccccaacgacctgttctctcagtttgcctatgatgccttctatccacagtgctcaaggtaaaacaaactgctaataatgagtaagccattttaagctacattaaaagagggttgagggaatttctgaaaatatatacaaattttcatccaacctctctattgtgacttatcttacagcatctctagtcattttgaggttatgtctgcctcattctctctatgacctatttcatcttatgatgtttgtatgaatacccttctttgatttaatggaactgtttacttaagacttggctctttttgttaccaaggatattttttcttttaactccaggagcaccactcagttttgtgtctgattaacttttcttaacagaatctaaatccagaggccatctttttgcttatttatgagatctctctggctaaacatcttttttcattagcacatgtctcttcagtatgagatttcacacaccatgctttaagaacctgggaattgaggaaaatggtgatgcaagaccaaagcaaaatctagcccaggcttgtggacagcagcagcatctgattccaaatctggcagtaactggttaagagatctgcagagggcagagtatagtaacccagtgctaggaatcttgcaagggagaaacagaaggtcaaggaatggatgttaccttcttagggaagagctttttaaaagaattctcaagggaatagttttcttatagaaatagtggtgtttgatattctcagtgcatgagttgtatcttccctgagctatgccgaagaacccattgtaggacaggcgctgtgactcacgcctgtaatctcagcactttgagatgccaaggcaggcagatcacttgaggccaggagttcgagaccaacctgggcaacatggcgaaaccctgtcttgactaaaaatacaaaaattaactgggcatggtggtgggcgcctgtagtcccagctacgcagtaggctgaggcatgaggatggctagaacctgggaggcagaggttgcagtgagctgagatccagccactgcactccaacctgggcaacagagtgagattctgtctcaaaaaaaaaaaaaaaaaatccatcgtagggcctggtactctaagttggatgtgtttttaccacttcttgctctggccaaggcatgattcaccaaaaatatttatttacttaatgtaaaaaattcttgaaggaattcaaactccagcatcatccacctttgttgaaagggtgagaggtctattctatctactagactttattttttcttagacaatgccacactagaacattggatttgctctgcttcagagagttggagattcccaggacttttataggagtgtggagaggctctatttccaggatctttacctatttttttttatttctgggttgaccgacattgtccactcagcacctggaaagttctgagcactgtccatgcacaatactctgatcagaaaaagacactagaagggtttttgaatcaatctaaggtctaaatgacacaggaatgttattccttggcaactaatctccattatttaatttatataacgcttccttctaacaaaaggcttccaggtgaaactctggataatcagagtgtgttaatttaggcatattgtatcaaaaatatcaaagtcattatttccttaggaatttggacttctattggataagctgtgttattattgctacaaagtgtgtttttatataaagttgtatataagaacatctgtatgtatattattaataccagtggctaataggtacaaatgtcttacatatactattctgaaaatatggttggaaggtaagtcaatccttcctcgtttgcttctttttctttttttttttttacactttactgcaataattttcatttttttgtttgttttttttaaatgtattattattatactttaagttttagggtacgtgtgcacaatgtgcaggttagttacatatgtatacatgtgccatgctggtgcgctgcacccactaactcgtcatctagcattaggtatatctcccaatgccgtccctcccccctccccccaccccacaacagtccccagagtgtgatgttccccttcctgtgtccatgtgttctcattgttcaattcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggcgtttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagatggtatctcatagtggttttgatttgcatttctctgatggccagtgatggtgagcattttttcatgtgttttttcggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctattcactctgatggtagtttcttttgctgtacagaagctctttagtttaattagatcccatttgtcaattttggcttttgttgccattgcttttggtgttttagacatgaagtccttgcccatgcctatgtcctgaatggtaatgcctaggttttcttttagggtttttatggttttaggtctaacgtttaagtctttaatccatcttgaattgatttttgtataaggtgtaaggaagggatccagtttcagctttctacatattgctagccaggtttcccagcaccatttattaaatagggaatcctttccccattgcttgtgtttctcaggtttgtcaaagatcagatagttgtagatatgcggcattatttctgagggctctgttctgttccgttgatctatatctctgttttggtaccagtaccatgctgttttggttactgtagccttgtagtatagtttgaagtcaagtagcgtgatgcctccagctttgttcttttggcttaggattgacttggtgatgcgggctcttttttggttccatatgaactttaaagtagttttttccaattctgtgaagaaagtcattggtggcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttttactttgattttgtatcctgagactttgctgaagttgcttatcagcttaaggagattttgggctgagacaatggggtttcctagatctacagtcatgttgtctgcaaacagggacaatttgacttcctcttttcctaattgaatactctttatttccttctcctgcctaattgccctggccagaacttccaacactatgttgaatgggagtggtgagagagggcatccctgtcttgtgccagttttcaaagggagtgcttccagtttttgcccattcagtatgatattggctgtgggtttgtcatagatagcttttattattttgaaatatgtcccatccatacttaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattctgtttgccagtattttattgaggatttttgcatcaatattcatcaaggatattggtctacaattctcttttttggttgtgtctctgcctgagtttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagggtgtatgtctcgaggaatttatccatttcttctagattttctagtttatttgcatagaggtgtttatagtattctctgatggtagtttgtatttctgtgggatcggtggtgatatcccctttatcattttttattgcgtctatttgattcttctctctttttttctttcttagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatctccctctacacactgctttgaatgcgtcccagagattctggtatgttgtgtctttgttctccttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtatggtgctgaaataaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctatattgggtgcatatatatttaagacaattagctcttcttgttgaattgatccctttaccattatgtaatggccttctttgtctcttttgatctttgttggtttaaagtctgttttatcagagactaggattgcaacccctgcctttttttgttttccatttgcttggtagatctgcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcagctggtaccggttgttcctttccatgtttagcacttccttcaggagctcttttagggcaggcctggtggtgacaaaatctctcagcatttgcttgtctgtaaagtactttatttctccttcacttatgaagcttagtttggctggatatgaaattctgggttgacaattcttttctttaagaatgttgaatattggcccccactctcttctggcttgcggagtttctgccgagagatccgctgttagtctgatgggcttccctttgagggtaacccgacctttctctctggctgcccttaacattttttcctgcatttcaactttggtgaatctgacaattatgtgtcttggagttgctcttctcgaggagtatctttgtggtgttctctgtatttcctgaatctgaacgttggcctgccttgctagattggggatgttctcctggataatatcctgcagagtgttttccaacttggttccattctccccatcactttcaggtacaccaatcagacgtagatttggtcttttcacatagttccatatttcttggaggctttgctcttttctttttattgttttttctctaaacttcccttctcgcttcatttcattcatttcatcttctatcactgataccctttcttccagttgatcgcatcggctcctgaggcttctgcattcttcatgtagttctcgagccttggttttcagctccatcagctcctttaagcacttctctgtattgattattctagttatacattcttctaaatttttttcgaagttttcaacttctttgcctttggtttgaatgtcctcccgtagctcagagtaatttgatcgtctgaagccttcttctctcagctcatcaaagtcattctcaatccagctttgttcccttgctggggaggaactgtgttcctttggaggaggagaggcgctctgctttttagagtttccagtttttctgctctgttttttccccatctttgtgattttatctacttttggtctttgatgatggtgacgtacagatgggtttttggtgtggatgtcctttctgtttgttagttttccttctaacagacaggaccctcagctgcaggtctgttggagtactcggctgtgtgaggtgtcagtctgcccctgttggagggtgcctcccagataggctgctcgggggtcaggggtcagggaaccagttgaagaggaagtctgcccgttctcagatctccagctgcatgctgggagaaccactgctctcttcaaagctgtcagacagggacatttaattctgcagaggttactgctgtctttttgtttgtctgtgccctgccccaagaagtggagcctacagaggcaggcaggcctccttgagctgtggtgggctccacccagttcgagcttcccggctgctttgtttacctaagcaagcctgggcaatggcgggcgcccctcccccggccttgctgctgccttgcagtttgatctcagactgctgtgctagcaatcagcaagactccgcgggcataggaccctccgagccaggtgcgggatataatctcctggtgcgccattttttaagcccgtcggaaaagcgcaatattcgggtgggagtgacccaattttccaggtgccatctgtcacccctttctttgactaggaaagggaactccctgaccccttgcgcttcctgagtgaggcaatgcctcgccatgcttcggctcgtgcatggtgcgcgcacccactgacttgcgcccagtgtctggcactccctagtgagatgaacccggtacctcagatggaaatgcagaaatcacctgtcttctgtgtcgctcacagtgggagctgtagactggagctgttcccattcggccatcttggctccttcgccttcgtttgtttcattctagacagagttgcactttgactttaagaagctaaaaatttgtctattaccattcatataatagccttgttatggaaaaatcatttgtattgaccactaattcaggtagaaagaagcaattcctacatatagaacacttctctcttcctgaaaggcatctgtatttactgacaaaatgaaatcgttttatgggtaatacaaaagtgattctgaagtgtctgttttagcaaagaaatagtcttttaatgtgttattttaaatgttttattcattattataaccatgtactcaggggtccttagatgagatacgccttataacttttaaaaaaatgtaatataaaatataagctatttttttctgggttattgtctccttgttagtggtgaatcagtgagtggtgaggaaatgtgaaggcctaggatacaactatttactattgtagactttataaggactatacccttgggcttcatgaaatttataattttttaaatttttaaaaaaattttactttaagttctgggatacatgtgcagagcatgcagatttgttacataggtatacatgtgccatggtggtttgctgtacccatcaacccatcatctacattaagtatttctcctaatgctatccctcccctagccccctactacctgacaggccccctgtgtgtaatgtttccctccctgtgtccatgtgttctcattgttcgactcccacttatgagtgagaacacgtggtgttttgttttctgttcctgtgttagtttgcttagaatgatggtttccagcttcatccatgtccctgcaaaggacatgaactcatccttttttatagctgcatagtattccatggtgtatatgtgtcacattttctttatccagtctatcattgatgggcatttctgttggttccaagtctttgctattgtgaatagtgctgcaataaacatatgcatgtatgtgtctttatagtaggatgatttatacttctttggatatatatacccagtaatgggatggctgggtcaaattgtatttctggttctagatccttgaggaatcgccacactgtcttcctcaatggttgagctaatttacactcccaccaacactgtaaaagcgtttctatttctccacatcttctccagcatttgttgtttcctgactttttaatgatcaccattctaactggcgtgagatagtatctcattgtggtttttaatttgcatttctctaatgaccagtgatgagctttttttttaatatgttttttggccacataaatgtcttctttcgagaagtgtctgttcatatcctttgcccactttttgatgggattatttttttcttgtaaatttgtttaagttatttgtagattctggatattagccctttgtcagatggatagattgcaaaaattttctcccattctgtaggttgtctgttcactctgatgatagtttcttttgctgtgcagaaactctttagtttaattaggtcccatttggcaattttggcttttgttgccattgcttttagtgctttagtcatgaaggctttgccatgcctatgtcctgaatggtattgcctaagtattccagggtttttatggttttagatcttatgtttaagtctttaatccatactgagttaatttttgtataaggtgtaaggaaggggtccagtttctgttttctgcatatggctagccagttttcccagcaccatttattaaatagaaaatcctttccccgttgcttgtttttgtcaggtttgtcaaagatcagatggttgtagatgtgtggcattatttctcaggcctctgttatgttccattggtttatataactgttttggtaccactaccatgctgttttggatactgcatccttgtagtatagcttgaagtcaggtagcgtgatgcctccagctttgttctttttgcttaggattgtcttggctatacgggctcttttttggttctatatgaaatttaatgtagttttttctaattctgcaaagaacgtcaatggtagcttgatggggatagcattgaatctataaattactttgggcaatatggccagtttcacaatattgactcttcctatccatgagcatggaatgtttttcccatttattttgtcctctcttatttccttgagcagtgatttgttatgatttccgttcttttgtatttgctgaggaatgttttactttcaagtatgtggtcaattttagaataagtgtgatgtggtgctaagaagaatgtatattctgttgatttggggtggagagttctgtaaatgcctcttaggtcctctcggtccagagctgagttcaagtcctgaatagccttgttaattttctgtctcattgatctgtctaatattgaccgtggggtattaaagactcccacttttgtgtggaagtctaagtctctttgtagttctccttgaagaggtccttcatatcccttgtaagttgtattcctaggtattttattctctttatagcaattgtgaatgggggttcactcatgatttggctctctgtctgttattggagtataaaaatgcttgtgatttttgcacattgattttgtatcctgatactttgctgaagttgcttatcagcttaaggacattttgggctgagaccatggggttttctaaatataaaatcatgtcatctgcaaacagggacaatttgacttcctctcttcctatttgaatttcctttctttctttctcttgcctgattgccctggccagaacttccaatactatgttgaataggagtggtgagtgagggcatccttgtcttgtgccagttttccaagggagtgcttctagcttgtgcccattcagtatgacattggctgtgggtttgtcataaatagctcttagtattttaagatatgttccatcaatacctagtttattgagagtttctagcatgaagggttgagttttattgaaggccttgagcaggtattgagataatcatgtggtttttgtcattggttatgtttatgtactgtattatgtttactgatttgtgtatgttgaaccagccttgcatcccagggatgaagccgacttgatcatggtggataagcttttggatgtgctgctgcatttggtttgccagtattttattgaggattttcacattgatgttcatcagggatattggcctgaaattttcattttttgttgtgtctctgccaggttttggtaccaggatgatgctggcctcataaaatgagttagggaggactccctctttttctgttgtttggaatcatttcagaaggaatggtaccagcttctctttgtacctcggtagaatgctactgtgaattcatctggttctgggctttttttggttggtaggctgttaattacgccttaatttcagaactcattattggtctattcagggattcaatttcttctttgtttagtcttgggagggtgtatgtgtccaggaatttatccattttttctagatcttctagtttatttgcatagagttgtttatagtattctctaatagtagtttgtatttctatgggatcagtggtgatatcccctttatcatttttattgtgcctattcgattcttctcttttattctttatttgtcttcctagccatgtattttgttaatcttttcaaaaaaccaactcctggattcattgattttttgaaggattttttgtgtctctatctccttcagttctgctctgatcttagttatttcttgtcttctgctagcttttgaatttgtttgctcttgcttctctagtttgtttaattgtgatgtcagggtgttgattttagatctttcctcctttctcctgtgggcatttagtgctataaatttccctctaaacactgctttagctgtatcccagagattctagtatgttgtgtctttgttctcactggtttcaaagaacttatttatttcggccttcattttgttatgtacccagtagtcattcaggagcaggttgctcagtttccaggtagttgtgcagttttgaatgagtttcttaatcttgagttctaatttgatggcactgtggcctgagagactgtttgttatgatttctgttattttgcatttgctcaggagagttttactttcaattatgtagtcaattttaggataagtgtgatgtggtgctgacaagaatgtatattctgttgatttgggatggagagttccgtaaatgcctattaggtcctcttggtccatagctgagttcaagtcctgaatatccttgttagttttctgtctcattgatctgtctaatattgacagtggggtgttaaagtctcccacatttgtgtgacagtctaagtctctttttaggtgtctaaaaatttgctttatgaatatgggtgctcctatattgggtgcatatatatttaggatatttagctctgcttgttacattgatccctttaccattatgtcatgcccttctttgtcttttttggtctttgttggtttaaagtctgttttctcagagactaggattgcaacccctacctttttttttttatgctttccatttgcttggtaaatattcctctatccctttattttgagcgtgcgtgtgtgtttgcatgtcagatgggtctcctgaatacagcagatcgatgagtcttaactctatccaatttgccagtgtgtgtcttttaattggagcttttagcccatttacatttaaagttaatattgttgtgtgtgaatttgatcatgtcagtatgatgctagctggttattttgcctgttacttgatgcagtttcttcatagtgttgatggtctttacagtatggtatgtttttgcaatggctggtactggtttttcctttgtatatttagtgcttccttcaggagctctcgtaaggcaggcctggtggtgacaagatatctcagcatttgcttgtctgtaaaggatttttatttcttcttcacttatgaagcttagtttggctggatatgaaatcctgggttgaaaattcttttgtttaagaatgttaaatattggcccccagtctcttgtggcttgtagggtttctgcagagagatccactcttagtctgatgggcttccctttgtgggtaacctgacctttctctctggctgcccttaacattttttccttcatttcaaccttggtgaatctgacaattatgtgtcttgggatggctcttcttgaggaatatctttgtggcattctctgtatttcgtggatttgaatgttgacctgtcttgctagattggggaagttctcctggataatatcctgaagagtgttttccaacttgtttccattctctctgtcactttcaggtacaccagtcaaaggtaggtttgttttattcacacgttcacatatttcttggaggctttgttcattccttttcattcttttttctctaatcttgtcttcacactttatttcattaagttgatcttcaatctctgatatcctttcttccactcggtagattcagctactgatactcgtgtatgtttcatgaagttctcgtgctgtgtttttcagctccatcaggtcatttatgttcttctctaaattggttaatctagttagcaattcatccaaccttttttcaaggttcttagcttccttgcattgggttagaacatgctcctttagcttgggggagtttactattaccaaccttctgaagcctacttctgtccattcgtcaaactcattctccgtccagttttgttcccttgctggtgaggagttgtcatcatttggaggagaagaggcattctggatttggaatttcagtcttttgcactggtttttcctcatctttatctacctttggtctttgatgttggtgacctttggatggggtttctgtgtggatgtcctttttgttgaggttgatgctattcctttctattagttttccttctaacagttaggaccctctgctgcaggtctgttggagtttgctggaggtccactccagaccctgtttggctgggtatcaccagaggaggctgcagaacagcaaagattgctgcctgttccttcctctggaagctttgtcccagagggacacctgccagataccagctggagctctcctatatgaggtgtctgtcgacccctgcttgggggtatctcccagtcaggaggcacgggagtgagggacccacttgaggaggcagtctgtcccttagcagagctcaagtgctatgctgggagatctgctgctctattcagagccagcaggcaggaacatttaagtctgccaaagctgtgcccacagctaccacttcccccaggtgctctgtctcaggaagatgggagttttatctataagcccctgactggggctgctgcctttctttcagagatgccctgaccagggagaaggaatctagagaggcacattggctacagtaggtttgctgagctgtggtgggcttcacccaatccgaacttcccccagcagctttgtttacactgtgaggggaaaatcgcctactcaagcctcaataattgtggatgttcctctccccaccaagctcaagcatcccaggtcgacttcagactgctgtgctggcagcaagaatttcaagccagtggatcttagcttgctgggctccttgggggtgggatccactgagcaagaccacttggctccctggtttcatccccctttccaagggagtgaacggtttcgtctcactggagttccaggcaccagtggggtaaaaaaaaaaaaaaaaaaaaaaaaaaaaaaaaaccctgcagctagctctttgtctgcccaaatggccacccagttctttgcttgaaactcagggccctggtggtataggcacccgagggaatctcctggtctgtgggttgtgaagactatgggaaaagtgtagtatctgggccagaatgcaccgtccttcaaggcacattctctcacagcttcctttggctagaggagggagttccctgaccccttgtgcttcctgggtgaggcaacaccccaccctgcttctgattgccttccatgggctgcacgcactgtctaaccattccctgtgagatgagctgcgtacctcagctggaaatgcagaagtcacccgccttttgcattgatcttgctgggagctgcagactggagctgttcctatttggtcatcttgccagtcacctattttcctcttttttctttctttaaaataaccttagcatactgtaccttttttctttataaacttttaattttttaaaacttttgattattgtgtaataacacttaggttaaaacacaaacacactataaagctgtacaaaatattttctttctttccatccttattctataaactttttctattttttaaatttttatatcttttgctttttaaacatttttaaaaatgaagacacaagcacacatattagcctaggcctacacagggtcagcatcatcaagacattattaggtgataggaatttttcagctccattataatctcctgggaccaccattgtatatgcagtccatctttgtctgaacatcagtaggcagtgtgtgactgtacctctaaagatgaccacagagttgtcagaattatgctaattcccacttcagtttgtttggattatttgagctgatgtaatgtttccagtcaggagacaagtatagaatagcagtgcacattctgaaagccttattttcctttctccttcagggtttcataacctaacttggcataataggtctcatgtgttgtgctcaaactgcatgtaacgctatatttatgccttatatttgtagcccctatatttataccttagtataaaagaaatgaaggaaataagtgcatatcctcttatctgatttttacccagaattacatagatagcttgccattgtttggatggcaagaagaataaatacaggcatgtatttatccccatgacatgcactacatacaaatttttcagttttgtcttcacaaaaacccaatgagttaggtattatctaaattttttaaatggataaaatgtggctctaagagatagacaatgatgaagtagcaggatttgcatttagacctatgatctctgactgcaaagcccattctcttagttcctatgtaatacaggctcctggagcctactgggttaagagagagccatgaagctccttttctgcttttccattgttaatgcagctctgtggtacctgaagcactgctttgcatgaaggaaatgatgtaccttttttgttgcttgttttttgcttttgttttttttttcctttaaatttatttatttattcccagctttactgatatgtaattgaccaataaaaatggtatatactcaaggcttataatgtgatgttttgatttatgtatacactgtgaaatgattaccacaaccaagctaattaaaatatccattacctcacatagttaccattttgtgtgtgtgtatgtagtgagaactctcctactctcttagcaaatttcaagtatagaatacattgttaataactgtagtcaccatgttgtacattagaactccagaacttattcatcacataatcaaatgtttgtatcctttaacaaacatctttcaatttcctccattccccagcctctggcaaataccagtctacttcctgtttctgagttccacttatttggattccacatacaagtgagatcatgcagtatttgtttctgtctagcttattttacttagcacaatgtcctgtaggttcatccatgctgctacaaatgacaggatttccttctttcttaataattttctcatccattatgcatatttctcattaattatatagctcatatcttctttttccattcatcccttgatggacacttaggtctatatcttggcaattgtgaataatgctgcaatgaatataaaatgcagattttttttgagaccctgatttcattttctttggatataaacccagaagtgggattgctggatcaaatggtagttctatttgtagttgtagttttttgaggaatctccagattgttttccataatctctctaccaagttataatcccatccacagtgtacagctgttccctttctccacatcgtgttcagcactgattattgtttgaccttctcataatagttatgctgacaggtgtgaggtgatatatcactgttgttttgatttacaggaaggaatgtatttttgaggtattaaaacactactttcctctggcttatgtaaaatgcaggtactttgggtattatcaataaaatacaggctctaaatttgtaagaaaggaatctctgagtgccatgtgtccccctaaaatattgattgtgaatcaaataacattcactattaaaatagatgtagctaagaatatgaaccatacaggtaatttattaagtgcttactctatgctaggcactccttctgccaagatacacatggcataaaatagaaagaacatctttcaaatattcttaagactgtagtcttgggaaactaaactcttgagataattgtatgaaaaagagtctaacacatctttaaatagctgcctacctttctctaaactagttaagaaagggtctagtgaaaacatgggcaccacgtaatctaccttgtaagattcagagtgcctgagatagaattctaaatttctttgcagagagaaaaagcaaaacaaattaaaagatgaaggaatactatatccatgtaagtctatggccagtaaagacacttttgggtatggatgactcattttatcctatatgaacttcttttaaagtaatcatacaaatatatacacccagaaaaaatgaaaattcaatgagagaggggagtgggatatctgaaaaagcaatgagcaaagaaaacattggaattgaggctaaaatagtaactatgtaacctggctataaaacaatgtaataattaaggatctatcacacaaaacgtatataaaatgtaaaaatacggtatattcataatatagaattctaactatacttaagtttaaaataaaggtgatgtgcattgtagaatgtttagttaataaaatacaggtgatatatctgaatatactagctgagatgtgtctctgagatattttgttaattggaaaatatataatgtaatttataaaatagacaccatgtatgtaagatatttatatatgaaaaagaaaatacttaggaacaatatataccaaaatttgaacaggttttatctttggtgggggtgggattgcaaggaagcaggggttgatgatgaagaacatcttttacattttattttattaatttcctataatgtttaatgttttaataagcataaattaatgtaaaatttcattattgaaatggcttttaaaaataaaggatatatcctgtggaatagtgagaagtagcttaccagcagtgattttggacaagtgctatttgagtttccatatctcttcagtaagctgaagactttgctattgacctcaaagttagtgagtgtgtgcgtgtgtgcgtgtgtgtggtttaaatgtaatacaatgccatatgtaaagtgctaattacaatgtcagtgatatagtgtgcccttaaccaatagtagtcaatattatgcaacatatattgaacataggtaaccataaaccactaaaatgaagttgtaatcatagagcaatgtttgtttgttggttacttattcaccagtgagcaatgttgcttgagcaatagttttttttttaaacatttttgtttgtgttcatacatttggtgaaataaatataaatttttcaaagcaatcttgagattatttatgctgaacagtaatagatcaacagtaaaatatgcaggttggtaaaagttaaaagacatctcatttctcatttataaaaagagatatacaaatgtttggagacacttctagttgaagattgtatatataaaagagatatacaaatgtttggagacacttctagttgaagattttatatataaagaagtaaacattttgtcacgtacagccagaatagttgaagtgggagtgaagtcgagaagtggtttattcccccaaaatggtgtctttcaacaatattttaaaagataatgtattggcattatggcattattactataaacctattatgagatgatattagaacaagcagtgtgtaattatgctcctaagacatgtataggaggagctagagcaaagtgtggcaactctttttttttcttttcttttttttttttgagattgagtctcgctctgtggcccaggctggagtgcagtggcgtgatcttggttcactgcaagctccgcctcccgagttcatgctgttctcccgcctcagcctcccgagtagctgggaccacaggcacccaccaccgtgcccggccaatttttttgtattttcagtagagacggggtttcagtgtgttagccaggatggtctctacctcccgaccttgtgatccgcccgcctcggcctcccaaagtgctgggattgcaggcatgagccaccgcgccctgccaaagcatggcaactcttcatgtgctcacacttccaccatccaatggtggttttttctctctagccccaaactcagtttctgtcctaggtatgctcctttgatgttagatctaagcttggtctttgtttaatgttgaagaaaatgacccttgtctatgcccctatttgtatatagtctcaaaagaatcatatatttaaaaatgcatacacttatgttaataatctttatgtctgaatgtttctgaaacaatgagacacatcaaatttgtggaaatggtatcattgaactagagagccagctcctttggtaatgggcattggccacttttgacatggaaaattatcctcaggaagtatatttggtgttttcattataatattatagaaaatatttatagaaaaaggtccatatgctttggttttttgtttgtttgtttgttttttggtaatcatctttatgctatagtccttaccacttctgatgatcaactggctcctcttctgcctgtcctcaaagtgctaacatttttaaagatattcttagcatacttctttattaccacacgtttcttgcacaataccatctactcatactacaaaatcaacatcaccatccctctcatgtctccagaccttcagatccttgttcccagtttcctagtggatggcatcaccagaatgacttcccacaggcgcttaatctcccaatatttctatgagttttaattttattttccagccaacttgttaccactgttttccttgcagatgcaagcaagctttctcaaccttttttatgtttctatttagccaagaatcatcaagcttagttaatcctacgtctgaattatcccttagatccatcatttcttcctctttttctctgctactgttttggttcaggttcacttctttttcaaatgaaatattgcaattagttatttaattagtctcccttccttcaaggtctctattaaaccaccctttaatatctactcagcgattcttctagagccaggatgacctacttaaaaagaaaacaaaatgaaatgtagtgactccctatttcctgtaagattaagtttaaatgccttagcagcacctttacgatttggccgtagcctgccttctacaagtttttggcaagctcttctatttctcctctaaagtaatgctccctggcgttcagcagtaagaagctattttctttttttcccctttctttattgacaagtgaaaattgtgtataattatggtgtacagtataaggctatgagatatgtatacattgtggaatggctaaatcaagctatttaccatatgcattatctcacatacttgttttttgtgtatggtgagaatgcttaaaatctactctcttagcatggtctcacttaaatgtggagtgtaaaaaagttgaactcataaaaacagagtaaaatggtggatacctggggggtgggggtgggtggagtagagagatgtttgtctatgaatgtaaaattttagttagagaataataagtttttttttcattcttacatttgacacgtcctttctctgctctgtgctttggcactgtctgccccgaaacagagtcttgctctgtcgccaggctggagtgcagtggtgcaatcttggctcactgcaacctctgtttccctgattcaagcaattctcctgcctctgcctccctagttgctgggactacaggcatgtgccaccacgcccagctaattttttttttttttttttttttgtatttttagtagagacagggtgtcaccatgttggccaggatgatctgatctcttgacctctttatcctcctgccttggcctcccaaagtgctaggatttcaggcgagagctactgtccccggccctgttctttattcttggaagaactcctctggcccatgcactagctgttaaagtaccaagcctcttttatctaccacatctaaggatcatctcttctgttataccttctctacctttcaactttgactatgattgctggaatgttacacatagtgctggttgcatcacactgtgatggcttaattgatgcctccagtagactgtgaacttctcgagagccaggaccatgtgccattgatgtttgcatttctttattccactcaatattcttgtagtctcactatacagctattttgttaataagacaaaagaaattggagttgttagtcttgaacagctctggggactttgctaaggaaccttcctgtttttttccagatttatattctcttttagacattgccctactcccttcctaagtaaaaagcaaggactgagggaataagaatatttaagacagtgttaatgatgattacagctgaaacctgctttgattctttacccacactgagatgttccagagaggcttcctgactgtcagcaccacttgaagcctttcccattatatcactgaaggcaaataattcattgcatttggaagctaagctgtttaataacaaaggatgagcataattttagctaacttgagttcaatcacttactttatttgccatatatttaggcagtcacagcagcactttcaaaaatatatgcttgctttctttccttttcaacatttcaattcatgttacattgtttggagttcaatatatattgatgctatccttaatataaatttaaaaaattattttattgtggtatgagcacttaatgtgagttctaccctcttaacaaatttttaaactgtaaaatacaatattgactataagtacaaatgttgcaaagcagatctctagaatttatttcaacctgattaactaaaactttatgctcattttctccccattttcttctcccccgctttcccccacagcatgcttttttttttaattgtttgctttatgtttgtggttatattgaagggagattttctttcaagaatgctttatgctcttaaatccgattataaattaataatttacataaaatattatgtagtgagattcagaggtaaaaatatctggtgatgacaacagctaagacgactattgaacagtgttccaggtactgtccttagtaatttgaatggagtgccctatttaatcctcacaacagccctgtgaagaagattgatattattcttctattccctagaagagagaaacagtgaagcttaaacaagttaagtaacttgcccacatcacacagctgttaaagatcagaacctggactgggattcaggcagtctgactccagagtgcactcccataattactacagctgtggataacataatttagaactaaacaatttttattctacctgaaaatcagaggtttgtctgtcagaggagtcttagcaactttttgaatagattgattcttccttcttgaaaccatattcactacttccacaagttttactttcatttccccctatgctactggtaaattgagctgtaaatccctcttttcctccttctttgggataatttcgttactgcttcattagccagtgcatcatgaaagcatctcaatacagccctttgctgatgctgagatataagcactaagccactactaaatgcattcctgtatttattctttttgccacacaaacaatgggaaactgtctagataattccaggcaaaagccagagaagaggatacacatgtatttgttttatactgaggcataaatgtaggaactgtgataagggcaatgcttatgtaactaggcaagtgcagattcagatgtttaatcaattagattttattcacgcacacacacacacacagtctcccaaatccaaaggtatgtactatttttactgattaatgttagttttaaattttacattatagctactctgtgttacagaaaaatagtatcttttgaaatgcagtaccttcagaaaatgagtgggaaagctgtagttgtttttattagttttataactataatgaaaaatactaactctggagctgctaaggataatccttttgatgtgagagtaaatatttttccataatggaatggctttattgtcaggatagattggaaatgtattgcttttttcttaagaaaagttatatattcctatgcataatcctcctctcccaaggaatatttttcctttcaactttatcctattagaaattaatatttagtccttattaaaaattacttgtgctaaagcaacgattttgctgttattagtcatttctactgtttgaatgtggtccatttctgcgatactattttggtatgaagaaaatctgtaaacaggaaagagtttgggtacataggggaaaggagagataccaaagcaagggttgagcaaaagtgaaagggaagtacttacaactaaaaaaaagttggcagcgaagataaccttctgtcaatttcctatattttccccaagaccactaatggccgtctgatagccccatttgactccacagcagggtgtttgcttattgtggggagcagacactttaaaaggactgactgcatacacgaggctggtccgtgtttctcttagatgtgaccttgccctgacaatagtccagagactgattctccattggtcagtgttatctattcttccttcatctctgcacacaatggccctctgcatctttccatgagggcattgctattgccttggggatcacagcagatgcaactgtactcgagctagcagcctcaaagagttcacagttttttttgttagcctacccagagtttcagttttggcttttcagggtgctgtcatgggatacaaacgcatgatgaagttgcgttttatctctgatgcaatgaattttcatggagacaaacttgcagggtttttaagctcagcattattaggaagatgacagcttcagctggtattctttctgtggtgagaatagtccagccacactcatgttacctcaatttgaacaggcaaataggagactgcttcttggcttgaaaagaaggtttacaagatctaagagcttttgttctagttgagatgacgaaggttctctgcatctatgtccctgggggagcccatttttttccacattccaagcacttggctgtgtaatcctgtgcaaaacttctcccaggcaagatctccatatgtattatttggttgctttctctaattctcctcaaacatcagcttagtattcacaataatagctacatttattgagccctttccaaatgccagccactgttctaaaggttttacctgtttagctcactcaatcctcacaaacttatgaagtagatatcatattgcctacattttacagattcaggaaacagaggcagagggaagttaactaacttgaccaggggcacacagcttggcagtgtcagagctgggagggaattccagggagtctggctctagaatttatggtcttgctctccagggattgagagcgcatcctttcagtaacaagtggttgagtaaaatgctattttcaggtcacatttgtatcctaacaagagtcccacacagctaagtctagggaagtgtccctggaacacagctataattcctaatgggcctgaattttaaaaagctttccaggaatgaccattcattttaagaacagtgtggaaggagactggagggtccaatgaagctgctgagtagtaatcaggctggtatctgagacaagactcagaactggttctccaggggcatggcaatataagtctattgtgaaatgtggctttttaatgggtagctggggactccattcaacagccttaccttaaaacagcaagtccgcatattgaatggtttactggtcttggctattttagttcccgtgggtccttagttctgttagctcctgtccttgattcttccatgtcaggataagaagttactgctttaactacaggccagtgtggtcattgtggccactggttcttctgtatctctgtgcagttcgaaatacaattctttcctaagaaataattttgcggtcctaggagaacagtgtctgcatgtgactctcacaatccaccctgaagtgacctctcagtcattgaccacatgttgttggtttctctagaactgacaattacttaaagtcacgttcctagatcacatgttaagccctgcaaggtaaaaaattatgtcttattcaatatattcattgcttattataggtgatagtaaacatgttattttgttttgaccggttaaaatataccagagtctctttgcaagactaacttttctaatatgactgtaatatggataacgaaatagtctaaagggtgtcagttgacatatgtctgagaatcacagtttatttcatatttatatatttcttctaacaaaatgggatacatgtgcagaatatgcaggtttgttacacaagcatacatgtgccatggtgttttgccgcacctattgacccgttctctaagttccctcccctcacctctccacccctcaacaggctctggtgtgtgctgtttgcctctctgtgtccagagaatcatacagttttaaagcttagggtaattttgaaatagaaaaagaacataatgatttataaaatttgatttcaaaaatgtttgaatttttgtgctaagaagtaattactttggtttatatttgaatttactttgctttattcatgctgggtggccttttcttccattaaccagtggttttatataattttcaggtcatatttagtagtttttccacccacatctcccttcttccattgttatacaaaaatataagtggtgttttatcacatattaaaaaatattggccagatgctgatggtgcttttaaaacgtaattatttaattctgagactctgggagagggggcttagatctctgctttgggtgttcttctcagatgcggtgcttttaaaaaaaagtgtaattatttaatcctgagactcagagaaggcttagatctatgcattgggtgttattctcagatgcagagatgtaaatgccatttttctcttctgttttcaggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaata

SEQ ID NO: 131 - DNA, 112167 bp, Homo sapiens
gggttttgatcatgtcggtatatttatatgtaaatacaaaactgtatcactgtaagatattgaatatgaacattacaattattttctgaatcagactcagtccattgatattaaatacaaaatgaaatgattgtaaaaaataataatatacacattcaaagagcttattacagtataaaattattgaggtctgatcagctgccaacctcatcttctgtcacaggggaaggtttaggagttcctgggattttttgggaatgtggagtgctgaggactcttgatttatccctagcacataaggatgagtgggctgggagcaggcagggacaggttgggtgggtaggggacaaacagtgattgcaggggaccacctcactcagccagggggtgaagctttttattgacacagaacccacccagtttgagggtctagcaggctagcaggcaggaagagatgggcatctcggtagacagggccaagctgcataaaggaaccatccagcaaaagaaaaagggccccagctcatcctcccagggaggtattttcttagtggttttttctttctcatacctgggctccccctccttccttctaagattcgtaccgattgcatttggctctggctgctcagtgagttcatctctaccctccgcctcccatccctgggatagtgaaagcaaagagagagtatggaatcacagtggaggtctgttccccaaattggccaagtaaatgtagaaaaatcatcggataagggaaatccatgctgagctaacccagtgtcaccacaaactaatacattcttggctccaacaggtggcaactggaaggagataagtcattacttaaggaaggggccctgtggcaggaacatggaggagatgtgtgtgtgtcctcttccaccactctgtagcctgacaagaggagacatgatcaccaacccaagctagtccaggataaatagtagggtccaagaagcaaggagtcctgaactgcaacacggagccccaggaacttctggaaaggagtatcgtgtgtatatgtatttatagaatacgatcatattatcacatacaatatatattatatacacacgtacatatggacccatacacataagtgcacacacacacacacacagaatgacagaaaggactggaatacacgccctacttataaacgtgcttggcactcaggacgatctctagaatatgtaacttggtcaagctctctggggagaaaggcaaatgctcatcaaacctccccataaaatcctaggaaagggaaggagtgggagacaggagacctcagaaaaagaatggcgggagaaaggaggagggaggttccttccccacttacctcggggaccctagcaaaaatcaatagccacaatttggttttaataaggcacagtttgatagcagatgctaggaattaagaacacattgctactggccctttctagtggcaatttcaccacatttatctagccaaagggaaaggctgccttgcgtgcacacgtgtgctgggagacacaagaaagaagttgatccatggcttcagcgtaactgatggcaacctataggctcagcggtgtccagggtagtttaaggaaggctggccaacaggtaggaggttcgtaggagagttactgactctccacggccagcaggttttggccagaggataccatgccctccttctctgcgaactccaggatggccttgtagcaaaaatagtactgctcaggggtctggatgctgaaggccctctgggtcctcatgcgtgacaccgtctggaacacattaagggtgccaagctcctccagctgtgccaggcagatgtccagtgagcagaaggtacctgaagaaggaaggaagtgatcacatctggtttacctctcttctcttcctccctctaccaaataacccaggcagaactgaatgaatgacttcacaggcaaagtgcctcatggcagaaggccaggtggccttaggcctgaaaggactcaagaaggaggtcacagggagtgttggaggccagagaaatgagaaggcctcttatttctcaggacatacacttggggtaacaggaagtggaaatgggaaggtgacacaggggaacttcctgcttcaatcccagacagacagactgacagcactcccacacctaatttccagagtccacaagtttttcagaggcctaacaaaaacctattctcaactttctcccaaagggacctttgaaatagaaaggccaacatttcctaccatgtacatgcccttaaggcaaaagctgctaactggctccagaatggagaacacagcacagggtggggagtccctccagggagggctggatgggaaggaagcagcagcccagctgagctctctgggatacctgcagtgacagttctaacaggtgacagagtcagcgttatgatggggtgtataaaacatcaacccctagaggacttggcttgtgaaatatatattctggccatcacttggtccaccaaaaggacattagatgagggatttttcacagcaattcaccaccaagggagcaagtgagttccttctccaatcacagatgtgggctaagagctttgtttttcctcgtccacccctactgcccctgcagacaccaagagctgcattaggtgcgttacctgtcctgccaatgcctgcactgcaatggaccacaatgggtggctcagggcactgccctttggagcgtgctcccatgttgctcacagccagactctgctggtttctgaccactctcaagaagtcaatgagggaagctgctgaggaagggacaccatagtctggccagctcaagaactggaagtgggtcacctggcgtttctgccgttccttagataagaaaagaagtaaacgttaacaaggttatttctgcctgcccctagctacctctggcttttccagattctcaacaccctggttatccctaccaccaaggctcctatccaccactgtcaacttttcccataattgcttctttactacaaacccaaaggaagggttggttaattggaaaaggcagaattcctatactgtaagatccagaattttttttgagacaggatctcactctgttgcccaggttggagtgcagtggcacgatcaaacttactgctgccttgacctcacaggcttgtgccaccatgcccagctaatttgttctatgttttgtagagacaggatctcactgtgttgcctagattatcttgaactcctgggctcaagtgatccttccacctctgcctcccagagtgctgggattataggcctaagccattgcacccagccccagatttctaaaattataagctttactcctatttaatgttcctatcgtgctgcagtaatatggctatattggctgtgagttaaatatcctcatcctgtccctagaaaaacagaagcaactcataacttccctggtatcctacctattccctctggagattttcattacagtaattattctccccctgtttcaacaaggtgagaaaaaagaaacctggatttacctctgtgttgtgaatttctagcgttgttttcttataatgattcatgttctccacgcctagattggtcactgtgaggaagccaaatcggatccgagagtctttttctaaaggccagtactggccacactttctcctgccgccttcctcaaagctgaagacacacagagcaaggtaagccttccatcgttcctctccacagcagtaacctggcttccccaaagacctgatatacccccaggcagcaatatcatctcttgcattgcttctaacttacaccattgattctcagcagaaaggaaaggaaacctcttcattctaaacaaatgtactcacagctaaagtttctgcatgtactcatatagcagacagttactgagcacttactacagcatttggtctttttcctaatacgcaatagtacgtctcacatatgtgggataaatactgggtgaacagagacaaaaacagtatagtagctgggtatagtggtgcatgcctgtaatcccagctacttgggaggtttaggcaggagaatcacctaagaccaggagtttgagaccagcctgggtaacatcatgagactccatctcaaaaaagaaaaagaaaaagaaaaaaaaagagtagagaaaatatgaaaatatgataggtcagagagaactctctgataaactgataaacacacatctactggtatgttagcaggaggtttgtgtaaaagcctgaagtcccagcccaggcaacatggaaaccctatctctactaaaaatacaaaaattagtcaggcatggtggtgggtacctgtagtcccagctacttaggaggctgaggtaggaggattgcttgaatccaggaggttgagactgcagtgagctgagatggcaccactgcactccagcctggatgacaaagtgagactctgtctcaaaaaagaaaaaaaaaaaaaaaaaaggcctaggccaggcgcagtgactcatgcctgtaattccagcactttaggaggccaaggtggcggatcacctgaggtcaggagttcgagactagcctggccaacacggtgaaaccccatctctactaaaaatacaaaaattagccaggcatggtggtgggcacctgtaatcccagctacttgggaggctgaggcagaatagcttcaacctgggaggcggaggttgcagtgagctgagatcgcaccacttaaggttgcagtgagctgagatcgcaccacttaactccagcctgcacaatagagtgagactcttgtctcaaaaaaaaaaggcctaaatctaccttgccaccctccagtggccccaaagtattccaaggtagaacttctcccactacctcctctccaaataagtggtggttataacagtgctaaggaagggaatttaacattcacattcatttttttccttcctcatctgaaataggttattccttaaatttgccagatttgtagaccaaaatttcaaaaatattcctttcattaaaatcttccggccaggcgcggtggctcacgcctgtaatcccagcactttgggaggccgaggcaggcggatcacgaggtcaggagatcgagcccatcctggctaacacggtgaaaccccttctctactaaaaatacaaaaaattagccgggcgaggtggcgggcgcctgaagtcccagctactcgggaggctgaggcaggagaatggcgtgaaccccggtgggggcagagcctgtagtgagctgagattgcgccactgcactccagcctgggcgacagtgagactccgtctcaaaaataaaataaaataaaataaaataaaataaaaataaaataaaatcttcctggccaggcgcagtggcccacgcttgtaatcccagcactttgggaggctgaggcaacagatcacgaggtcaggagttcaagaccagcctgaccaacatggtaaaaccccatctctactaaaaatccaaaaattagctgggcatggtggcacgttcctataatctcagctactcaggagaatcacttgaacccaggaggcaagggttgcggtgaactgagatcgagccattgtactcccacctgggtgacagagcaagacaccatctccaaaaaaaaaaaaaaagatattagccaggcgtggtggcacatgcccgtaatcctagctattcgggaggctgaggcaggagaattgcttgaacctgggagacggaagttacagtgagccaagatcgtgccacactgcactccagcctggtggcagagtgagactccatctcagaagaaaaaaaaaaaaagtagcaacaaatggagagcaaagggaatctggtaattcaggagtcaggaaggcagcacccctctggaaatagggaacagataaaaggagaattgtcccatgtttcccagaacttcctttagtggataaggccaggacctcaaaatagggtataactggcacagggttgccagagccagggattaaagctttaacaagttagatctattcatctccaccatacccgggttgtggattagctaagagatatctcaaaatctttgccctggctttcctaatcctcaatttttttttttttaattgagacagagtctcgctctgtagcccaggctggagtgcaatggcgtgatctcagctcactgcaacctctgcctcctgggttcaagtgattctcctgcctcagcctcccaagtagctgggattacaggcacgcaccacaatgcccggctaattttttgtatttttaatagagaaggcaccatgcccggctaattttttgtatttttaatagagacggggtttcaccaggctggccaggctagtctggaactcctgaccttgtgatccgcctgccttggcctccctaagtgctgggattacaggcgtgagccaccgtgccaggctgaccctcattatttctaaaagctaaacttccctctttaatcacccatgcctagggacagagtggaggtggagacctttggaaaaaagggattaactcaccgggtggtcatgacaatcaccaagactttttgctcccataccatgagccagaaatcacgataggtattctccaaaggacctgaaataaaaggagaagacaagaaacatgactctgggaaacactttttttcttttgtaggcgcttctgttttactccccaatggtaactccaaaccatagatggttagctccctgctcatctttccacatccctgctattcagtatagtccgtggaccaatcacaccagcatcgtatgggagagtgtaagaaacatgaatctgcatgtcaacgagatccccaggtgagtcgtaggtaggtttgggaagcactgctacataccctctcagagtcttaatcatcagaacttcagccatcacatccaggctgacagtgtcaaactgtaagaatctctagctgttttcatctcacctaagcttcagttttataatcacagattgcttactaaaccattaaccttctgtttcccataatctcagatccattatgtctgtaactaagtctcctccttcaaaattagctttatcttggccgggtgcagtggctcatgcctataatcccagcactttgggaggccatggcaggcaggttgcctgagctcaagagtttgagatcagcctggcaacatggtaaaaccccatctctatgaaaaatacaaaaattagccaggtgtggtggcacatgcctgtagtctcaggtacttgggaggctgaggcacaagaattgcttgaccccgggaggtggaggttgcagtgagccaagagcgcaccactgcactccagcctgggcaacagaacgagactctgtctcaaaaaaaaaaaaaattagctttatcttgcaactttcttatctctgttaacaatactagcattcttaaatcattcagtcttaaaaaggtgaagtcaacactgacttacccatttccttcatctcccagaagcagtcagtcaccaaatcctagagattttttacctttgaaatgtttttggtttttattcttttgccctcatcttctccccatcctgttcttcctgctcgatttcactgacacaaagaccacgtcatcttctaagttactgtaacaccctcttagtctacttttttgaataggcctttttcccttccaatctactctgggaaaccccaccagtttaatctttcttaaaaattacttcatcagaacatagacacaccatgctcactttggcctctattctttcgctcaagctgtctccgtcacctccaatgctattcattttctacccattttcaagtgccacctcttccttgaagctttctctgaccaccgcattccttgtgaagcttcttctcttttgcttttgatggcacagctggatctatacaggttgaccatttaatttatatactcttccatccattattttactttgtgggaattaatgatatctcactaaacatggtcctaaggacaaaggattacaggtgtgagccactgcacctggccaaattctcctttgcacagggctgagcactcagggctgagcactcagcaataactttgaagatacttgtgggctaccaactccactttgatcaagacagtaaccggccggcggcagggctcacacctgtaatcccaacactttgggaggccgaggcaggtggatcacttgaggtcaggagtccgagaccagcctggccaacatggtaaaaccccgtctctactaaaaatatgaaaattagctgggcacgatggcaggtgcctgtaatcccagctactcgggagcctgagttaggagaattgtttgaacccaggaggcggaggttgcattaattgcattaaaccaagatcgcaccattgaactccggcctgggcgacagcaagactccatctcaagaaaaaaaaaacgtaacaactcaagataattccttatactttctgggtgtttctttcctctctgctttcaggaaagcagggcagtactaatggttaattttggtctagaagtctgctggttctactacccttattgctaagtcttttagcaagcactaacatgatactggaataccctctctgcagaagtggatgatgtcaaaaacgtgagatcttagaaatacactaaatatccaataagagaggattaattaaattatgacgtatcaggtggggtgcagtggcgcacgcctgtaatcccagcactttgggaggatgaggcaggcagatcacttgagcccagaagtttgagaccaacctgggcaacattgcaaaaccctgtccctacaaaaaatacaaaaactagccaggtgtagtagcacatgcctgtagtcccagctactcaggagactgaggtgagaggatcacctgtgtgtgcctggagaggccaaggctgcattgagccatgatcgtgaaccatgatcataccactctgtcacccagcctaggtgacagagtgagaccctgtctcaaaaataaataaataaataatagcataccataatttatacagtctataaagttgatgttgtaagagctgtattttttgctatggaaaggtattcacagataccattaaatgaaacaagagatagtatagaaagagcacatttggttaaattaaaagtttagttttgttttttttgagaccgagtatcactctgtcgcccaggctggagtgcagtggcgtgatctcagctcactgaaacctctgcctgccgcgttcaagcgattctcctacctcagcctcctgagtagctgggattacaggcatgcaccactacgctcggctactttttgtagttttagtagagagggggtttcatcatgttggccaggctggtttcaaatacctgacctcaagtgatctgcccgccttggcctcccaaagtgctgggattacaggcttgagccaccgtgcccggcctggttaaatattttgtatgcctatatctgcatgtatgcatagataaaggtctaggaggagatgctgtaaaatgttaacattatctctgggtcctagggttatgagggattatttttgttttctaaatgttctacaatggacatgcattaccctagtatacacatcaagaagacagtaaggacaccttttccacatctctgaccctcagcctcatccacatcctactctcctgcaccacagcaactctcatatacttcattttccacattcagaccactggcagaattggagtactgagcagtcagagcatatggtaactcagttaccagactggggctgggcaaacttctcacaggctcaagagagatactaagaagggaaagttgtacttcccagcttagaccctttaacagtaaacttctctcaagaaataaagtcagcagtttatactgacataggtgaaacaatccacagacatggcttgtaaaaacttctgaaccaaacaaacatgggttcaaaccctggttctgccacttactagctgcatggtccaaggtcacgtaaacttttgggtttcagtttgctcatctataaattaataaacctcccttgcagagtctctataataattagatagcatttatgcatctgatatataataggtcttctcaatagatgacatcattaatagaaatataggccaggcgtagtggctgatgcttgtaatcccagcactttgggaggccgaggtaggcagatcacttcaggccgggagttcgagaccagcctaggcaacatggtgaaaccctgtctctaccaaaaatacaaaaattagccaggcatggtggcaggtgcctgtaatcccagctacttgggaggctgaggcaggagactcgcttgagccctggaagtggaaggtgcagtgagccaagatcatgtcactgcactccagcctgggcgacagagcgaaactccatctcaaaacttaattaattaattaattaaaaataaagaagttgcagacattatgatattttattcctaaatacttgagcacttactaggaaaacaaggacctcctcctatagaacattaccattatcaccttaagcatacattaaacatggatacaatgttggctaaaaaaaatctccaattgtctcaatagtttgtcttcaatagatttttttctcccagttgaggatctaatcagatactctttttttttctttttttttttttttgagacagagccttcctctgtcgcccaggctggagtgcaatggcgcagtcgcagtccactgcaacctctgcctcccaggttcaagcaattctcctgcctcagcctcccgaatagttgggactacaggcacccaccaccacacctagctaatttttgtatttttagtagagacggtgtttcaccatattggccaggctggtttggaactcctgaccttgtgatccgcctgcctcggcctcccaaagtgctgggattacaggcatgaaccaccacgcctggccgatcctctttttttttttctttttgagcgcaatctctgctcgctgcaacctccgcctcctgggttcaagcgattctcctgcctcagcctcccaagtagctgggattacaggcatgtgccaccacgcccggctaattttgtatgtttagtagaaacgtggtttctccatgttggtcaggctggtctcgaacttccaacctcagtttatccacctgcctcggcctcccaaagtgctgggattacaggtgtgagccattgtgactggccctttaatttatttatttttgagacaggatcttgctgtgtcagccaggctggagtgcagtggcacgatctcggctcagagcaacctctgcttcctgggctcaagtgatactcccccctcagcctcccaaagtactggagttacaggcgtgagccactgtgcctggccatggttctctttagtctccctttaatctagaacagttctctgcctttttgttttttatggcattaactttggagagtctgagccagttttcttatagtatgtcccacaatctggattgtttcccatgactagattcagattttaaaactggcaatacacaatgcaggtgatattcatttctcaatgcatcatatcaggaggtgtacataatgtccctttgtcctttactggtgatactaagtttgatcacttgattaaggaggtatccaccgtatcttgctctgcagtggtcaaagggccttacgcccatctgatggtctgttgtctttctgtattatgatttcctcctaccatctttgaaagtgacatgatattcttgagatggagaggccaggtcaggaagagtactaggatcataggaacatttatagaaactccacctgaaatcctcctagaggctgggcatggtggctcacgcctgtaatcccaacactttgggaggccgaagcgggcagatcacgaggtcaggagttcgagaccagcctgtccaacatggtgaaacccagtctctactaaaaatacaaaaattagccgggcgtggtggcacacacctgtagtcccagatactcaggaggctgaggcaggagaatcacttgaacccgggaggtggaggttgcagtgagtggaggtcgtaccactgcacaatagcctgggcgacacagcaagcctccatttcaaaggagaaaaaaaaatgagaaatcctcctagagctcagtattccactgtcagacttattagcacatactatctatgtcagaacatttgctggagtgctctgtgatggtataggaaccagcctaggcctattaggacagcaatactcattcctagattggactcaatctctgggaagtccactgctattcttggcctctcactagacaggaagagcatgaagagctcactggctgatgcattctgatgccctacacccttgccaatactaagaaatagccccaaaacttgcaggcagtagtgttatgtgtttaaatctccagtttatctctatgcggtgagtttccaggcacacctggtacagaaaccccaaactacttatttgcttttctcaaccaccacccatctttataaaaggccaggatctagtggccaaaacctccactcaagttaccattcgtttaaaaattatgctatcatttggcacaaggaatcataagtagatggcacaaaatcaacatgggagggacggaccagcttaccttgtgtgccaatgtaagcattcttctgcttgtagccatccatgaaactggcattgatgtaatctgtctaatgataaaaaggagacatcactatagctacacagaatacaccatttgggtcataaaatgatgtactcagtaagtaaaacccaaggtgtgaatattctcttcttgttgagcagaaaatgaggagtgaaatggccagctcaaaccctcacttcaataaatggtgctgggacaagtagatatctacatgcataaaaatcaagctgactccttcctcacactgtaaaactgactcaaaatgtatcacagaccaaatgtaagggattaaaactattaaaactctcagaataaaatataagagtaaatctttgtgaccttgggttaggcaaagctttcacagatatgataccaaaggcgtaagtgacaaaagaaaagagataaattggactatattaaaattaaaaacttatgccaggcgcggtggctcacgcctgtaatcccagcactttgggaggccgaggagggtggatcacgaggtcaggagatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccaccgccgccccacagccgggaggatggagttcagcgggcagcggagctgtctcagtctttgccgccgcgccggcgagcgccgcccgcgaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccctctgggaggtgaggagcgtctctgcccggccgccccgtctgagaagtgaggagaccctctgcctggcaaccaccccgtctgagaagtgaggagcctctccgcccggcagccaccccatctgggaagtgaggagcgtctccgccgggcagccaccccgtccgggagggaggtgggggggggtcagcccccggcccggccagccgccccatccgggagggaggtggggggtcagcccccccgcccggccagccgtgccatccgggagggaggtgggggggtcagccccccgcctggccagccgtgccgtccgggaggaggtgggggggtcagccccccacccggccagccgccccgtccggaggtgaggggcgcctctgcccggccgcccctactggaagtgaggagccctcagcccggccagccaccccgtccggagggaggtggggaggtcagcccccgcccgccagccgcccgtccgggagggaggtggggggtcgccccccgcccggccagccgccccgtccgggagggaggtggggggggtcagcccccccgcccagccagccgccctgtccgggaggtgaggggtgcctctgcccggccgcccctactgggaagtgaggagcccctctgcccggccagccgccccgtccgggagggaggtgggggggggtcagcgcccctgcctggccagccgcccctccgggaggtgagggggcgcctctgcccggccgcccctactgggaagtgaggagcccctctgcccggccaccaccccgtctgggaggtgtgcccaacagctcattgagaacgggccaggatgacaatggcggctttgtggaatagaaaggggggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctccttaagagtcatcaccaggccgggcgcggtggctcacgcctgtaatcccagcactttgggaggccgaggcgggcggatgacgaggtcaggagatcgagaccatcctggctaacacggtgaaaccccgtctctactaaaaatacaaaagattagccgggcgtggtggcgggcgcctgtagtcccagctactcgggaggctgaggcaggagaatggcgtgaacccgggaggcggagcttgcagtgagccgagatcgtgccactgcactccagcctgggcgacagagcgagactccgtctcaaaaaaaaaaaaaaaaaaaaaaaaaaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaatacaaaaaaatagctgggcgtggtggcaggcgcctgtagtcccagctacacgggaggctgaggcaggagaatggcataaacccgggagatggagcttgctgtgagctgagatcgtgccactgcactccagcctgagcgacagagcgagactctgtctcaaaaaaaaaaaaaattcattcatcatcagccatcatggaaatgcaaatccataccacgagatactaatttatacccactaggatggctacagatatcaaagatagataatactgttggcaaggatgtggaaaaactgaaaccctcatacatgtgtaaaccctccttatacatggctagtggtaatgtaaaatgctgcagttactttagaaaacagtctggttgttcctgaaaagattaaacagttaccatatgacccagcaattccactccttagcaaaataacataggtgcatacaaaaacttatacataaatatccatagcagcattattcgtaatagccaaaaatggaaacaactcaaatgtccttcaactgataaatgaataaaagtggtatatccatacaatggaatattatttggcagtaaaaagcagtgatgtgatgatacatgctatgacatggatggacctagaaaacattatgctaaatgatagaagccagacacaaaaagctacatagtctaggattctctttgtatgagatccctagaacaggcaaatctatggagataggaaataaatcagagtgggttagagggaaataggtagcgactgccaagggtgtgaggtttctttgggaaatgaaaaaaatgttctaaagttgtttgtggtgatggtggcacaactctgtgaatatactaatagccattgacttatatactttaaataggtaaattgtatggtatgtgaactgttggaggccgaaagaatgagggtcatgatcaactcagtataccactggaggctacatgagcaaaaaggaaactgttctcatgaaagcaggatgttggcaaactgacaaactgcatctgccgcccagaaggaatgctgagggcagtcacgacccaggcacaagtgtttcttgtagttaggcacatctgaagcctgttagcaataatgtgtacctgtgatcaattaagcagctgaccaatcgttacctcctcctccctgctcttggtacccaataaatacaaagggctgtagaagctcagggctgcctttgctcactagaagcagggagttctcttcttccccatgttacccttcctttagaatagttatttttgtcttaagttttcattgctatgtttatcccccttcattcagtctcctaatgacggtctcaagtaataacaatagtaactgccctagtgacatctcaagcagtaattgtggcagtctgccagagtgaactatataactcaatagaaactgttatttacaagaaaagggtccatcaagacttgcaacactgtagcacaggaccaaatgagaggcaaggcaagcaagtaggaacacctggtccatcctgccacacacaaaaggcaaaatatgaatggagaagaaataaagctacatctcatacttaggaccatcaacagacgagccaaacacctggactccattattacctgaattaatgcaaagcaacttccagtcaaattcaaaggcatctcaatgaacagctcctgactacctctcttccagggtattctcccacctcctaatgtcctcagtcttaattacttcaacatcattttttataaatacctactcaaaagatcctttgatccaggctgataaaagagaaacatcaatcagctgcagttttatgttatagtataactagttgggagttgaatggatagaagcagtggaatggataagggaaggtgtgaagggttacagaaggacaaaagaaaagtttcaatagcaaactagggaaaactcataacccactgcattacagagaggtcagactgactctttcctcaacctatcactcgttctcctgtgggtcctatcactgggtgggcagtctgaactgtcagtatcccatagctaacctcctaagatatctccacctcatggtcaaacccatgttacttggatttgtgttcattagccagtcagtctaccaatttatcactctactatttatttagtcaagagtttcctccttagaaactgtttctttgactaaataaatagtggagtgataaactcggagttttccctcccatagcagctagtattgacctcatacgattactgtcctaccctgactcagacaacttcactgagctaatagaccacctgcagcagacccagcatgctaaaagcctcactcacttccaaacaggcttctcaatccagggtgcacccagtcagccaaagcccatcctctactcaacctggcacatgcaaatggtatacccactcgaggaccaaggggagaaggtatggaaaagcacaaaagatttacctagtatatgccagtcagcattagtaagaacataaggaggaactaacttcatgctttgaaaagaattgtcacttctttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtcttgatctcctgacctcatgatccacccgcctcggcctcccaaagtgctgggattacaggcgtgagccaccgcgcccggccgaattgtcacttctttaaagaagacattatttctttataactaagaattaccagctttagcactggtctctgagctgatttttaattcccagggaattaaatttttaatttcagcaacttcggaagaatcactggatattaaaactgaaggccgggcgcagtggctcacgcctgtaatcccagcactttgggaggccaaggcgggcagatcacgaggtcaggagatcaagaccatcctggctaacaaggtgaaaccccatctctactaaaaatacaaaaaattagctgggtgtggtggcgggcgcctgtagtcccagctacctgggaggctgaggcaggagaatggcacgaacccgggaggtggaggttgcagtgagccgagatcgcaccactgcactccagcctgggcgacaaagcgagactccaactcaaaaaaaaaaaaaaaaacaaaactgaaaatgacccagagataaagtatacacttgggggaaaattggaatagcaggaagaacaaacccggaacactatgttgtgagccattgctatagactgatcatttgtgtcccccataacttcaaatgtgtaatcccaaccccagaccctcaatgtaatggtattaggagatggggcctttagacaggtgattaggaccatgaggacagagctctcacaaatgggattagtgcccttataagacagaagagttctgaagtgctccctcaccccttccccttctgccatgtgaggatgcaatgagtagacagtggtctatgaaccaagaaaggggccctcaccagaccccaaatctgccagcacgttgatcttggacttcccagactccacaatagtgagaaataaatttctgttgtttataagccatcctgcatgtggtatttttgttacagcagcccaaacagattaaggcagccatgttcaacagaaactgggactaatagctttaaaattccagaagcaaatcaagtaaacaattcactaaaaaacctgaatcctccaaataacaaggtattgtatacttgaaaattgcggacagcatattttaagtgttttcaccacaaaacaaggtaaatatgtgaagtaatgcatatgtggtgttttttttttttttttttttgagacggagtctttgctctgttgcccaggctggagtgcactggtgcgatctcggcttactgcaagctccgcctcccaggttcatgccattctcctgcctcggcctcccgagtagctgggactacaggcgcccaccaccacacctggctaattttttgtattttttagtagagacggggtttcaccgtgttagccaggatggtctcgatctcctgaccttgtgatctgcccgcctcggcctcccaaagtgctgggattacaggtgtgagccaccgtgcccggcaaagtaatgcatatattaactagcttgacttagtgtctctgcaatccatacatattttaaaatattatattgtataccataaatatatacaatttctatcaattaaaatttaaaaacaactaaatgtcagaaaacagaatggaaaaatagccccataggtggaaattccatgagagtgttaagtccccaaagctaagtaaataatttttttttttttgctttcggcccgcaaagtaaataatgtcaaaaaaactaaaaactaaaatcaaaataaaataaaaaaaaagcctaaatactccatttactataaaaataaagcctccgctaatgtttcagtaaggagagggactacaaatcagacaatgatcttcatattaaccacaggatgattagaagaatctcccagtacactaagattcactcattcacaaatatgtcctgagtgtctgatatgtggcaggcactgttctaggtactggagacagggaagtcaacaaaatggataaatacaggtatctctgactccagagccccaactcaaccactgtactccactccttcagggcatatacgatgatgatctcagcagtactgatgaatttaccctccagccagccagtctcttagctcaaatgctcctgcaggaaaatcttctccaagggtcctggataggactgtgaattcagtttatgtgcttgaaacaacagggacaagagagttggaaaccatgatcctggggtcccaacccacatgtcatatatgcccaaatacaaggcagtaagttttccaaaaattattccccagaaagagaagggatataacaagtccttataatgtgtgtcatgttaaagaggtactatttaaattactttactgtgtgtcatgttaaagaggcactatttaaattactttactttgccggcgcagtggctcatgcctgtaatcccagcactttgggaggctgaggcaggcggatcaccccaggtcaggagttcaagaccagcctgaccaaaatgatgaaaccccgtatctactaaaaatacaaaaattagccgggcatggtggcatgcacctgtaatcccagctactcgggaggctgagaaaggataattgcttgaacccaggaggtggaggttgcagtgagctgagattgcgccattgcactccagcctggacaacaagagcgaaactctgtctcaaaataaataaataaataaaaataaaataactttactttgaacaacctcagtcaatgctgggttttttttttttatgagatcacctaacaaaattgggtttttcggagatatcacctaataaaattggtatatcagaagggaaaaaaaggaagataataataatttagtcattcatctcaaaattctaaggttggatgttgctgtaaacaagttatattaaaaaggaattatggccaggcacaccggctcatgcctgtaatcccagcactttgggaggccaaggtgagaggattgcttgagcccaggaagaacttaggcaacacagtgagaccctaggtctacaaaaataaaattaaaaaaaatcagccatgtgtaatggcgtgtgcctgtagtctcagctacttgggaggcagaggtgggaggatcgcttgagcccaggagttcaagggtgcagtgagctacgatcaagtcactgcactcaagcctgggtgacagagtgagaccctgtctcaattttctgttttttaaggattttacaaaggaataagtgaatgaatcatattataggggatgcataagatgcaggatgaattaaaaaaccaacttgtcctggccgggcctagtggctcatgcctgtaatcccagcactttgggaggccgagacgggcggatcacgaggtcaggagatcgagaccatcctggctaacatggtgaaaccccgtctctactaaaaacacaaaatattagccgggcgtggtggtgggcacctgtagtcccagctactcgggaggctgaggcaggagaatggcgtgaacctgggaggtggagcttgcggtgagccaatattgcgccactgcactccagcctgggggacagagcaagactccgtctcaaaaaaaaaaaaaaaaaaaaaaaatttgtcctaatgttaccctaacagattttcctggtttaggataaaatttccagtcacaatgccacacacttaaaagtaaataaagatgttgtactctggaaaaccttgttagactgactcaaaaattggcctgtaattccagcacttagggaggctgaggcaagaggattgtttgagcacaagagttcaagaccagactaggcaacatagtgagaacttgtctctacaaaagtatttaaaaattagccatgtatgtggcacacacctgtggtctcagctacttgggaggctgaggtacaagaatcacttgagcccaggaggtcaaggttgcagtgagctgtgatcactgtacctagcctgggcaataaagcaagaccttgtcttgagggagaaaaaaaaaagtggctcaaatgtgacaaagacactaaagttaaaggtgtatgtaaagtgtttgaataaaatgttcattaaatatctctgttaatagattacatatgaggcttttaacatgtagatataatcaaattaatatattaaataatatagtcatttgaccatttcatctctatccctagacatttatgtatacataagttgtccacaatttcctcagatacagatggagaaatcagaggtcacttataatcaaagttgctttgtattgatgcatatatactcaccaaaggaattgcactatatgaccatgactttacaactaaggagtaaaatgataaataatttaacatctatgaagcacctacaatacaacagaccttgcactatcagcattcacataaagaatttcatttaatttccactcaatactgtgagatgggcatttgaggacttgcctatggtcacagactagtatgtagcaaaatataaactcaaacctaatctctctggcctcggagtctactttcattctaccgaagtattagtaagcttcactttggaagaagctctatttcccccagtgcacctaaaaagattacatttatctgtctacctgagtatggccacttcgctttgttagcttcactctagtttggtccaggcagggtacatccccataacggtttttctctaggtttcctggagacctgaaggaaacgaaacaaacaagcaagaataaagaaaaagtggggacagtatgtatgtacaaaatctgaccatgctaaaggggtgtcaattactcttaggggtggagacatggaagcttttcaatttctagcccatacagttccatatcatttaacattttttgtggtaagtacatactacttctaaaagtaaacatatctccattcaaaagagagagggagaccaggcatggtggctcacacctgtagtcccagcactttgggaggcaggaggattgcttgaggccaggagttcgtgagcagtctgggaaatgtaatgagagcttatctcttttttttttgagacggagtctcgctctgttgcccaggctggagtgcagtagcgtgatctcgactcactgcaagctctacctcctgggttcacgccattctcctgcttcagcctcctgagtagctgggactacaggctcccgccaccacgcccagctaatttttttgtatttttagtagagacggggtttcaccatgttagccaggatggtctcgatctcctgacctcatgatctgcccgcctcggcctcccaaagtgttgggattacaggcatgagccactgcgccctgcctaatgagaggttatctctagagagaagtcaaaaaattagccgggcatcatggcacacacctgtactcctagctgctcaggagtctaaggtgggaggacggcttcagcccaggaagtcaaggctgcagtgcgctatgacagcgccactgcacaccagcctgggtgacggagagaaaccctgacttaaaaaaaagagaagctgggtgtggtggctcatgcctgtaatcccagcactttgggaggccaaggcgggtggatcacctggggtcaggggttcaagaccagactggccaagatgataaaaccctgcctttactaaaaatacaaaaattagccaggtgtgatggcacacacctgtaatcccagctactcaggaggctgagccaggagaatcgcttgaacctgggaggtggaggatgcagtgagccaacatcacaccactgcactccagcctgagtgacaaagcaagactttatctcaaaaaaaaaaaaaaataattaaatttaaaaacagagagaaggagtggggatgggagtcccaaatggccaaggcagaaattggtactaagaagtggggtgcttctgtaacaaataactaaaaatgtggaagcagctttggacctgggtaatggacagagctgatagaatttggaagtacatgcagaaaaagcctatgttgccataaacaggcataaaaggcaattctactatgggctcagaaaaagaagagctatagagaaagcctcagtcttcttagagattacctaagtgatactgatcagaaaactggtagaaatatgggtggtaaaatccattttgatgaggtctcagacagagatgaggagcacattagtaaaaagagagagagggagagaaggggagagaaatggggtataccaccaaaaaactccagctgcagataaaaatttctactacttatttgtcaaaagatgttcaaaccaaatctcttcaattccaatttcattttctttttgggacagggtctcaaaggtctccagggtcgcccaggctggagtccagtggcacaatcacagctcacttgcagccttaatctccctgggctcagtcccagatgcacaccaccacgcccagctaatttttaaattttttgtagagaaagggttttgccacattgcccaggctggtctcaaactcctgggctcaagcaatcctcccgcctcagcctcccaaagtgctgggattataggtgtgagtcaccgagcctgaccttaaatgccagtttaacatggtaggttgataacacatattgactgcactccattcatccagtagcttcactaaaatgatgaaaaaggagtattcactacaaacccaaaaagtgacagtggagacatcagcacacaaagagtgttcaactcattttgacagagaaaaagcagataggaggattttggctgacgtggccagacacagaagctaggaccaagggaggtacctatagagagacaagatggcacacccttagaactcccttaccatggaaagcaaggtgaggaacagagctaaaaatgggaataaaatgaaaatctgaatgttatgtagtgaaaatccctgacccattctcattgtcctgacctacactcatatccaagtttggatcccctcagcggatccaaaggacaggagaactcttcactggataaagtaaacagcatcaggtgaaagaattctgtcatttggagaatacccaacaaaaagctagttgtctgatcattataatctgaagctcatccatgcaaaacgagcttccatgcagcttgtttttgtttttgttcatcactgtctgcttttgtaaccatgcagcttttaaggaccataaatgtgaactaaaagccaaggatctcaatgtaattaaggaaagcccttacacaaagactttaatacacaattcaaataacacaattcaggcttgtcacggtggctcatgcctgtaatcctaactctttgggagggccaaggtgggaggatcacttgagctcaggagttcaagaccagcctgggcaacatagcaagaccttgtctctactaaaaattaaaaaaattagctgggcatggaggtacaaacctgtagtcccggctattcaggaagctgaggtaggaggatcacctaagcttgggagacagaagctgcagtgagctatgattgcatccctgcactccaccctgggtgacaaagtgagaccctgtctcaaaatcaaacaaaaaataaacaaacaaaaaaacccataattcaaacacatgggggctacagaagtttaaaaaaaaagatagtcaataagagaaaagtaacctctaaaaggctatcattaatatcctcaaagagaaaatagatgatacaattatacataaaacaagaagagagtgcaatgaaaaaggaacagagaagaaaagctcttggaaattaaaaataatatccaaaataggaattttaatagacgagataaaagagaaagttgaggaaatttccagaatacaaaacaaaacaaaaaaagtgatgaaaatatgagaaaaactggccaggcacagtagctcatgcctgttatcccagcactttgggaggctggggtggacggattacttgaggtcagaagtttaagaccagcctggccaacatgttgaaactcgtctctactaaaaatacaaaaatcagcagggcatggtggcacacgctttgtagtcccagctactcgggaggctgaggcatgagaattgcttgaacacgggaaatggaggttgcagtgagctgaaattgcgccactgtactccagcctgggcaacagagcgagactccgtctcattaaaaaaaaaagaaagaaagaaaaagaaaatatgagaaagatgaagaaagttaagagaatcattctgggacacaagtcagcaaactatgccctggccacttgtttttgtaaatgaagttttactggaacacagtcaagcccatttatttctgtactcactaagtatatattgacagtgttgagtcagtaaactatgccctggctacttgtttttgtaaataatgttttattggaacatagtcaagctcatttatttctgtactcactaagtatattttgacagcgttgagtacttgtaacaaagactgtaaacctcacaataccgaaatatttactatcttaccctttaagaaaaagtttatcaatcccatatatatatatatatatatatataaaatctatatatttacatatagagagagagcgcgagcgagaactaacataatacaaggaaagaaatcatttaaaacacagtgtaataagaaaagccctagaactaaataacaaaccttcagattaaaagaatctatcaagtaaccaatgtaataaattttaaaagaggacctacactaaggcacatcattgtgaatctttttttttgcagggggtggacagagtctcgctctgtcccccagactggagtgcagtggcacaatcttggctcactgcaacctccgcctcccaggttcaagggattcttctgcctcagcctcccgagtagctgggattacaggagcctgccaccatacctggctaatttttatatttttagcagagacggggtttcgccatgttggccaggctggtcttgaactcctcacctcaggtgatctgccctcctcagcctcccaaagtgctggggttacaggcttgagccactgtgcccagcctctctcaatccttttaaatgatctattgtttttctttttccttccctgggcattttaaagataatttctttttctgtttaagaaatttagactgggtgcaatggctcactcctgcaatcccagcactttgggaggccaaggagggcagatctcctgaagtcaggagtttgagaccagcctggccaacatggtgaaactccgtttctaccacaaatacaaaaattagccaggcatgatggcacacgcctgtagtcccagctactcaggaggctgaggcaggagaatcacttgaacccagaaggtggaggttgcggtgagctgagattgtgccactgcactccagcctgggtggcagagtgagaccccatcttaaataaataaataaataataaatagattgagaaagaataagatcagacaattcacagacagcatcactagtaattggaaaggcattgccttaaaaattctgagataaagttatttctaacctagagttctatactccagcaaaatagaataaaagaaagaagatggtctacaattaggaaacaagatccaacaaaggaaagagggaaaactgcaagataaaaactgaggaacaagcctagagaataaccaaccacagtttagactagaatgaaagaaaaagttctgaaagtgaggtctcaggaaaaaaaaaatagatgcaattgattatctgatacattcaatcacttggaaactaatgataacactgtaaaataaatctgattgggcatatagaaaaataatgaagggccaagcacggtggctcacacctacaatcccagcactttgggaggccaaggtgggcagatcacttgaggtcaggagttcgaaaccagcctagccaacatagtgaaaccatgtctctactaaaaataacaaaaaacattagctgggcaaggtggcaggtgcctataatcccagctactcaggaggctgagatatgagaatcgcttgaacccagggtgtggaggttgcagtgagccgagatcgcgccactacactccagcctgggcaacatcaaaacaacaaccacaacaacaaaacaaaacaacaacaacaacaataaaaaacaaaagaaaaagaatgaggaacatatacagaaaactaaaggaaatgaaaaaatctggtaattaactccagaagaaacaaaaaattgaattgataagatcattaggccaggtgtagtggctcattcctgtaatcccagtattttgggaggctgaggcaggtggactgcctgagctcaggagtttgggaccagcctgggcaacatggcgaaaccccatctctaccaaaaatacaaaaaattagccagacgtggtgaagcatgcctgtggtcccagctactctggaggctgaggtgagagaattgcttgagtttgggaagcagaggttgcagtgagctgagatagagccactgtactccaacctgggtgagagagtgagagcctgtctcaaaaaaaaaaaaaaaggctggacgtagtggttcacacctgtaatcccagcactttgggaggccgaggcaggtgaatcacttgaggccaggattttgagaccagcctggccaacatggtgaaatcccatctgttctaaaaattaaaaaaaaaaaaaaaattgttaatatatttgatcatttcatagtagcccatgtagctctccagtaaaaataatttacatagtcataataatgtacaatgacgattcaatttaagaatgttacatataattattggaagagtagtcaaaatgaaagtggagacatagtataagagctaaatgagcacctacaataaaagtcactaaaagtattattaacttttttttttttttttgagacagggtctcgctctgtattccaagctggagtccagtggcacaattttggctcactgcagcctcaacgtcccaggctcaagtgagcttcccacctcagcctcccaagtagctgggattacaaacacacgccaccacaccaagctaatttttgtaatttttgtagagacagggtttccacctgtctctacatgttgctcaggctggtcttgaaatcctaggctcaaacgatctacccacctcagcctcccaaagtgctgggattacaggcatgagccactgtgcctggcatattataagcattttaatttagaattagggatgaaataccaggggaaacagctacaagagttgaatacatgattataggtaatggaactgagggtaaaataggaatttgctatttattttgtcattgcttgtcttctttagaactgtttggttttgaaaaaaattatttgcatatattaactgaaagcaaagaaattacaaaggtcacacatataaaataatactctatattgttcatgagtgcttatgcatatataacagtataaacaaaatcaactagaaagaaatatcatattcatactagtagctgcttatgatgagtggggagaactaaggatgcggattagaaggaatttcaactttataataaattctttctctcatataataattaaaaagacagctgggcacagtggctcatgcctaaaatcctagtgctttgggaggctgaggtgggagaatcacttgagcccaggagtttgagaccagcctgggcaacagagcaagactccatctctacaaaaacttcaaaaaaattagcaaggtgtggcaccccatacttcttgtcccagctactaggaaggctaaggcaagaaaatcacttgagcccaggaggttaaggctgccataagctatgacagtgccactgcacctgcactccaacctatgcgacagagcaagaacacatgtctctcttaaaaagaaagaaaaaggccaggtgtgggggctcatgcctgtaattccagcactttaggaggccaaggtgggtggatcacctgacgtgaggagctcgagaccactctgaccaacatggcgaaaccccgtctctatgaaaaatacaaaaaattagctgggcttggtagcgggcacctgtaatcccagctacttgggaggctaaggcaggagaatcgcttgaacccaggaggcggaggttgcagtgagctgaagtcacaccattgcactccagcctgggcaacaagagcaaaactctgtctcaaaaaaaaaaaaaaaaagatgaagcaaatataacaaaatattaacaagagtcagtgttgattctgtggtaggaacatagttgtctgtaaaatcttaaaaaatttcagcccagcgcagtggctcatgcctgtaatcccagcactttgggaggctgaggctggcggatcacctgaggtcaggagttggagaccagcctagtcaatatggtgaaaccccatctttactaaaaatacaaaaaaaaaaattagctgggcgtggtagcaggcacctgtaatcccagctacttgggagactgaggcgggagatcacttgaacccatgaggcggaggttgcagcgagctgagatcacgccactgaactccagcctgggcgacagagcgagaccacatctcagagaaatatatatatatatttctcccttcctatacgaatatgcctagtgaataaaaccaatcctaaaagattacatacagtatgtatgtaatttttttacattttatgtaatgttacttgatataacaacaatttggaaaggacaaaattagagaaatggagaatagattagtggttgcaggggttaggaatggggaggtggtgggaaggaggtatatgtttactatagggcaatgaggctgggcacggtggctcacacctgtaatcccagcactttgggaggccgaggtgagtggatcacctgaggtcaggagtttgagatcagcctggccaacatggtgaaaccctgactgtagtaaaaatacaaaaattcgtcaggcatggtggtgcacgcctgtaatcccagctacttgggaggctgaggcaggagaatcgcttgaacctgggaggcagaggttacagggagctgagattgcaccacagcactccagcttgggtgacagagcaagactctgtcttaaaaaaataagtaaataaaaataaaaatattgatcgcttctcagtcttttggctaagatcaagtgtaaaataaaaataatgaagggcaacgaggggagccttgtggtgacagaactctgtatcttgattatggtgacagatacacaaacctacatgtgtgacaaaactgcacagaactaaatacacaaaaatgaagtaaaactggggaagtctaaatcagattggtggattgtatctatattaacattctggctgtgatattacactatagttttggaagatgttatcatgggataactgtagaaagggtacatgtaatctgtctccattatttcttacaactgcaggtgaatctacaattataagaaaaagtaaaaagagaaaagggaaagaaagtctcttggtccaggggaatcctgggcaagagtgaatatacactgatagccacttcataatccagaattccaagggagacacagtttgttctttgtaagtagctctactgggagttggtgtaagtcagaggcttggagctgatgaggattctaggttctaaatcataaagtggggaatcagtcattcaataggcaagactaggaagtcctctcattagatgagagatctgttctctgattgtcaaatggtagctggtttggatgatggcaacaagacgatctaaacccacttttttttttttttttttttttttgagacagagtcttgctctatcgcccaggctggagtgcggtggcatgatcttggctcacagcaacctccgcctcctgggctcaagtgattctcctgcctcagcctcccaagtagctgggactacaggtgcgtgccaccacacccagctaatttttgtattattagaagagacggggtttcaccatgttggccaggatgttctcaatctcttgacctcgtgatctgccagcctcaacctcccaaagtgctgcgattacaggcgtgagccaccgcgcccagccaaacccacttttttaatggaggaggggagactccatagtagaaatgacatctcaagggcctcacagcagctggtagttgcaaaagcaccgagagcaaggtgaagaatccccaggataagtgtgcatcctcttagatcagcctagcatgcctccctgctccaacatatttccttgattcaagactgcaagggaggctgggcatagtggctcatgcctgtaatcccagcactttgcagggctgaggtgggcagatcacttgaggtcaggagttcgagatcagcctggccaacatggcaaaaccccatctctactaaaaatacacaaattaggccaggcatggtggctcacgcctgtaatcctagcactttgggaagccaaggaggacgaatcacccgaggtcaggagtttgagaccagcctggccaacacagtgaaaccccatctctactaaaaatacaaaattaaccgggtgtggtggcacacgcctgtaatcccagctactcaggaggctgaggcaggagaattgcttgagccgggagatggaggttgcagtgggctgagatcgtggcactgcactctagcctggccgagagtgagactctgtctcaaaataaataaataaataaataaacaaacatacatacacacacacacacacacacacacacatatatatacacacacaaattagttgggtgtggtggcacacacctgtaattccatctacttgggagactaaggcacagaatggcttgaacccacaaggcggaggttgcagtgggccgaaatcataccattgcactccagcctgggtgatggagtgagactgtctcaacaacaacaaaaaagactttaagggaataactgttctgtttgcaaaagagattggatataaacagggagtctggtagttgggtataggtagcacccataattccagcactttggaaggctgaggcaggaggatcacttgagcccaggggttcaagaccagcctgggcaacatagggagactctacaaaaaatttaaaaaattagccaggcatggtggtgcatgtctgtggtctcagctactcaagaggctgaggcaggaggatcaattgagcatcaagagatggaggctgcagtgagccatgatcatgccactatgcgccagtctgggggacagagcaagaccctgtctctaaaaaaaataataataataaaataataaatacaataagtaaaatgaaataaaaattaaataaaaataggggtctggagctggtagggaagaaacagagctgtatgagagaaaagaataatttcccttgttgatatatggtctgtgtcccctttttctcctcttattttcctttgcattcttgatctgattgacttctttctcaagtgcctcttatctcttactttccctatctcattattttccccaactcattattttccctctttgctttgctaaaagactctatccctgcatcttattcagaacacactgactacactggacaggagttacaagagagaagaggtactcacagaatcctagatttctaaaacatttaagctacaaaggtaggtgaatatcagagtccagtagtcacatattatacagaggaaaaccaaagtgctgagaagggaaataacttgtgtcactcacagagggaatttttggttaagttggaatatgaggctgggacccactaggatggcttccctcattttctttcttttttttttttcctcttcttttctttctttctttttttttttttttccttagacaaagtcttactctgtcacttaggctggagctcagtggcgtgatcataactcactgtggtcttgacctcccgggctcaagtgatcctcctgcatagctgggacaacaggagtgtgccaccatgcctggctaattttttcgttttttatttttgtagaggtagggtcttgctatgctgctcaggttagtctcaaactcctgggcacaaatgatcctcctatacctttactcccaaagtgctgggattataggcatgagccactgcccccagccctagtttctgtagttttcaacagtcacagctcactagctggagagaaagagatttctggggcagccaattaaaacatggtaagagaaatgacagcaacatggtaagagaaataatctgaccaggtgcggtggctcacacctgtaatcccaacactttgggaggttgaggcaggaggatcacttgagcctcggagtttgagaccagcctgggcaacatgccaaaaccccatctcttcaaaaaataaaaaatgagctggacatagtggcacatacctgtagtcccagctactcaggaggctgaagtaggaggatcgctttaacctaggaatttgaggaaaagaaaaggataaaagaaaagaaaaggagaagagaagaagaaaagaagagaagagaaaaaagaaaaagaggccaggtgcggtagatcatacctgtaatcccagcacttcgggaggctgaggcaggcagatcacctgaggtcaggagttcaagatcaacctggacaacatcgtgaaaccctgtctctactaaaaatacaaaaattagccaggcatggtggtgcgcgcctataattccagctacttgggagggtgaggcaggaagaatcgcttgaacctgggaggcggaggttgcagtgagccgagatcgtgccattgcactccagcctgggtgacagaacgagactccatctcagaaagaaaaaaaaaagagagggagggaggaaggaaggaattacaggtgtgcgccaccacacccagctaatttgtgtgtgggtgtgtatatatatatgtatgtatgtatatatagttatcaactagttacgagccagagttataaactagcgagatggttttgtgataggatttgagtagaatgaaaatctcaaggggttaaagtcctatgaggcaactgtactctctgactgtggattattttaagtgtaccacatacccctcctcaagaagtaatgttataccataaatgttatggggagaaactgcccaaatgaacagaccagcactcacactgagtactggaatagagagtagcctattttgaacctactttttttaaaaaaaacttgcatttcagaaaaatatccaaaaatatgtccaacagggttatcctgttggtaccaaagaccttcagaaatttcagagcataggatgttagcaagaagcacccaatggtgcccaggctggagtgcagtggcgtgatctcagctcactacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcatctctgcccggccgcccatcgtctgagatgtggggagcgcctctgccccgctgccccgtctgggatgtgaggagctcctctgcccggtcgcgaccccgtctgggaggtgaggagcgtctctgcccagccgccccgtctgagaagtgaggagaccctccgcccagcatccgccccatctgagaagtgaggagcccctccgcccggcagccgccccgtctgagaagtgaggagtccctctgcccggcagccaccccgtctgggaagtgaggagcgtctccgcccggcagccgccccgtccgggagggaggtgggggggtcagccccccgcccggccagccgctccgtccgggagggaggtgggggggtcagccccccgcccggccagccgccccgtccgggaggtgaggggcgcctctgcccagccgcccctactgggaagtgaggagcccctctgcctggccagccaccccgtccgggagggaggtgggggagtcagcccccaacccggccagccgccccatccgggagggaggtggggggggggtcagccccccgtccgggagggaggtgggggggtcagccccccgcccggccagccgccccgtccgggagggaggtgagggggggtcagccctccgcccggccagccgccccgtccgggagggaggtggggtcagccccccgcccggccagccgccccgtccgggaggtgaggggcgcctctgcccagccgcccctactgggaagtgaggagcccctctgccgggccagccgccccgtccgggagggaggtggggggctcagccccccgcccggccagccgacccgtccgggagggaggtggggggatcagcaccccgcccggacagccgccccgtccgggagggaggtggggaggtcagccccccgcccggacagccgccccgtccgggagggaggtgggggggtcagccccatgtccgggagggaggtcgggggggtcagccccccgcccggccagccgccccgtccgggagggaggtgaggtcagccccctgcccggccagccgccccgtccgggaggtgaggggcgcctctgcccagccgcccctactgggaagtgaggagcccctctgccgggccagccaccccgtccgggagggaggtggggggctcagccccccgcccggccagccgacccgtccgggagggaggtggggggatcagccccccgcccggccagccgcccggtccgggagggaggtggaggggtcagccccacgtccgggagggaggtggggggggtcagccccccgcccagccagccgccccgtccaggaggtgaggggcgcctctgccctgccgcccctactgggaagtgaggagcccctctgcccggccagccgccccgtctgggagggaggtgggggggtcagccccccgcccggccagccgccctgtccgggagggaggtgggggggtcagccccccgcccgggaggtgaggggcgcctctgcccggccgcccctactgggaagtgaggagcccctctgcccggccagccgccccgtccgggagggaggtgggggggtcagccccccgcctggccagccgccccgtccgggagggaggtgggggggtctggccagccaccccgtccgggaggtgaggggcacctctgcccagccacccctactaggaagtgaggagcccctctgcccagccaccacctcgtctgggaggtgtacccaacagctcattgagaacgggccaggatgacaatggcggttttgtggaatagaaaggggggaaaggtggggaaaagattgagaaatcggatggttgccgtgtctgtgtagaaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaatttaaaaaaaaaagaaaaaaaaaaagaagcaccaaagcagaaagtacctctttctgcatgcgagaaaccatcatttatgtgagagtgatgttccctaacataaggaagggtctctgctaagcaagtgaggggtggaaggagctgttgccagagcctaccagaagcatcctggtaaccagctgctggcccaaactttttctacttacatggaacagtggaaagtgccaacagggttctcacgacgaatgtcttcatattcctcatagattccttgcttttgcctggcattaacatagtccaccaactcttggatggtcatagcatggggacctggaacatgtactgagtcccagtctaaggcaggagggagggagaacaggatgatctcatcgaagggatctgggtggccgttcacctggggtaggaactggaaattccaagtggcgagatcaattttgacgtacccacccaggttttctggaagacactccctgggcagatgctgcgtgacctcagatgtctttaatatttgaatctggaaggttagaaagaaccatgtgagtatgtgggaggagggaaaggcatatagagtgacaaagaataaatgtatttatatcaggtttggaggatgggataagattttcttgaaatacaaggtatacttgtaaaagtagtagactacatttcatctgcctgagatttaagtcctatgaatttgccagataaaagtgtgaactcccagaatgtatataaaattcactcctggaattagggacactgttatacatcttctgaaaggacgatgtagtgaacaaaagctttatattattaacaaggcttcccagcatcgctgcatgctggtactctttttttggccactaagaatgcataggtagtagttatttttgtcaaccccatactcagacaaccaattctaaggcctgttagcttgtattttactcagcttggtataactgttcacaaagataggattctatgaaagcaagacacccagaggcagggtagcccaggaaaaatgtgagataacactttttttttgagacagggtctcactttttcacccagcctggagtgtagtggcgtgatgaaggctcactgcagcctcaacctcctgggctcaagtgatccttccacctcagcccctcaagtagctgggaatacagatgcacacaaccacgcccagctaattttttgtagtaaccataaaacttaattctgctctctgcttggacatagccatgctggaactaattagcttaactggttctccttaggatctctgtggaatggggattctcttcctcctaaaagctcatctcttttgctgtcgcctcttcttggaatgccttcctttcctcctctgcctcttcatggaccagcacagctcacctcttctgtgaagtctttcctgactgcctgaggccatatgctcctctgcgttcctgcagagccaaagtcctcctatgtgtatctctgtgttccctatcaagaccatgagctccttgagggtagactgtctcacttaatttttaattatcaggaaccagtgcttcgactacaaaaagtgcttaatatattttgagtttatacatgcatgtataattcctataattcaagtgcaagaacttgcctatggattcctctcaaagagttaccttagaaaagatctctccagctggcacggtggctcatgcctataatcccagcactttgggaggctgaggcaggtggatcacctgaggtcaggagtttgagaccagcctgtccaacatggtgaaaccccatctctactaaaaaaatacaagaattagctgggcatgttggcaggagcctgtaatcccagctacttgggaggctgaggcaggagaatcacttgaacccgggggacggaggttgcagtgagccaagatcatgccattgcactctagcctcagcgacaacagcaaaactctgtcgcaaaaaaaaaaaaaaaaaaagaaagaaaagatctctcctggctgggcacggtggcttatgcctgtaatcccagcacttttgggaggctgaggtgggtggatcacgaggtcagaagatcaagaccatcctggctaacacagtgaaactccgtctctactaaaaacacaaaaaattagccgggcgtgacagcacacgcctgtagtcccagctactagggaggctgaggcaggagaatggtttgaacctgggaggcggagcttgcagtgagccgagatcgcttcactgcactccagcctgggagacagagcgagactccgtctcaaaaaaggtggctcacgcttgtaatcccagcactttgggaggctgaggtgggcggatcatgaggtcaggagttcgagaccagcctggccaatatggtgaaacaccgtctctactaaaaatacaaaaattagctgggtgtggtagcgtgcgcctgtactcccagctactcaggaggctgaggcagaagaatcgcttgaactcaggaggcggggctgcagtgagccaagatcgtgccactgcactccagcctaggcaacagagtgagacactctcaaaaaaaaaaaaaaaaaaaaaaaaagaaaagctctctcctactctgcgtcattaggtctctaagcagcttccacagaaccaaatgttttcactttcatgtcctgtcttttaattgctgcaatcagtaactgagaccataaatcttttaatcatggaacacgcaggagattataacagaattaaagtttctggttttattgtggcggcggggtctcactgtgttgcctaggctggtctcaaactcctggcctcaagcgatcttcccgccttggcctcggactcccaaagtgttagtattataagcatgagccattacacttggcccagaattaaagtaattttgaacgcttttgaaattgggaagcaacaaggtattctgagaaaaaaaaatgccaggaataaatgtagaaagagacataacgaaaaactttcctccacaaccctggtggtcaagggattgaatgatgtttccagttgaacaaattctaatgccagttcaactaatgcagttatattacaagctgttaaatattaaaggcctatgcagcactaggataaattttggaagtagcagctatccctaagttacctccaggacacgttccttcagtactatcttatgcaaggtgctatagaaagtgagaaccagataaactgtgtttagttttgaacttcaagaagctcgtaggacagtaagagaggcagtctgtattgaactgactaatgcatcaggtagagaatataagtgaatgcactaacagaagcagaacaggctctagaagacacgccaggaggattttttgaaggtagaaaattaattggcaggaattcactgtatctattcacctccagataaaaaagggcaagcttgccttaccctctcccggactttgtccttcaggaggagactgatgatggaatagggcactcggaaccatatgggtgcccccacaatcagcaccttcttcaaacgagctggaaatgctccctgtggagaaaacacatgaggatttaagtgtaatggaacctgtgactcttcaagcccaagtttaggttttctgctcttctccccattcttacccagcagggggagtctacagcctaattcaggtttgatctcagcagctagaggaaaagtggttaaacaaactgaagaaattagaagctgatttacctttaaaaataacaatgttaagttcttgtctaccgtaagctttatggatcaaaaactattctgacttctcatctcaacagatatcctacacataccacacatcagcatacatatatgcctcttaaaaaagttatgttattaaaacttgaaggaaaaatgagatcatgaataaactgaacattaaacatttctcgaccaggtgcggtggctcatgcctataatcccagcattatgggaggccgaggtgggtggatcaccagaggttgggagttcaagaccagcctggccaacatggtaaaacccatcactactaaaaatacaaaattagccaggcacggtggcagacacctgtaatcccaactactcagaaggctgaggtaggagaatcacttgaacccaggaagcagaggctgcagtgagttgagatcaagccattgcactttaccctgggcaacaagagtgaaactctgtctcaaaaaaaataatatggctgggcacagtggctcacgcctgtaatcccagcacttctggaagctgaggcgggcagatcacttgatgtcaggagtttgagaccagcctggccaacatggtgaaaccccatctctactaaaaatacaaagattagccgggcatggtggcatgtgcctgtaatccctgctactcgggaggctaaggcaggagaatcgcttgaacccaggaagtggaggttgcagtaagccaagatcgcaccactgcactccagcctgggcgacaagagcgaaactccatctcaaaattttaacaataataaataaaaatttaaaaattttaaaaatttctctttcataacttttcattcagtctgatgtatgcataatctttttttaatctattcattcatctatgtatttaccaatcaataatctaatgtgcactatggcaaatgagatctaaaaaaaggagatatcctcatccacacaagatataaagatgaaaaaatcattcattcctaatccacagtgcttagtttttttgtttgcttggctgctctgtttttgttttgtattgtttttgagacaggatcttgctgttgcccaggctggagtgcagtggcacaatcgccactcactgagtcctgtacctcccaggctcaaatgatcctcccacctcaggctcccaagtaactgggactgcgccactacacttggctaatttttgtatttttagtagagacagggtttcaccatgttggccggctggtttcgaactcctgatctcaagtgatcctcctaccttggcatcccagagtgctgggattataggcattgagccactgctcctggcgtgaagttcttaattttcaaatggttaaatgtattactgttttcttttctggttagtgtgttgtgtgtcttaaatccttttctattttaatgtcagaaaaagtacttttttttttttttactgctgtaccaccgattccaccaatgtgtattaatttttctaatttggttttttattgtaaaatatacacaacaaaattgaccttttaaaccattttaagtgtacaattattggcgttaagtatgttcacaatgcagccatcaccactattcattttcagaactatttcatcatcacaaacaaaaaccctgtacccattaaataacatctccctattcccttctccccctagtccctagtaaccttggttctactttctgtctctatgaatttgcctattttaggtcctcgtattattggaatcctactatatttgtccttttttgtcttgtttatcctacttagcataatgttttcaaggttaatccatattgtagcatgtctcagaattacattgctttctaaggctgaataatatttcctcataaatataccacatttttcttatctattaatccgttgatggacatttgggttgtttccacttgtacacattggttgtttccacttgtccagatttgaggagctattttccacattgtttccacttgtccacatttgaggagctattttcttttaaaaatttaaacttttgtttttgtcctttttttttgagacaagttctcactctgttgcccaggctggagtacgatggcaccatcatggctcactgtagccttgaccacccaggctcaagtgatcctcctacctcagcctcgcaagtagcatgtgccaccatgcctgtctaattttgtatttttgtagaataaaaatacaaatggtttcatcgtgttgcccaggctggtttcaaactactgggttcaagcaatctgcctgccttggcctcccagtgttgggattccaggtgtgagcctccatgcctggcctgtttttgctatttaagactttaacctatctgaagttgatttttgaacatggtatgagatgtaggaatctgacatttttttctatatgggtagctgttttgttttccacctttacatattaaaaagtcccgtctttccccaacttagactttctatttgtcagttttaacaaagtcacaatatcctggggaataaatatgacataggtaatttaattaaccatgtaaccatcattctgattattcagtttgttttcaggcctaaataatcctgatatgctcattttatcttttccttttaattttttttttgagactcactttaatattttttttttttttagtctcacttggtcacccaagctggagtgtagtggcacgatatctgctcaagggttcaaccaattctcctgcttcagcctcccgagtagctgggattacgggcgtgtgccatcacgcctggctaacttttttgtatttttagcagagatgggttttcaccatgttggccaggctggtctcgaactcctggcctcaagtgatccgcccatcttggcctttcaaagtgctgggattacaggcatgagccactgtacccggcctccttttaaattattttaagaagctgtttctaagactgggattatttggctaaagattatgaatattctttttttttttttaagacagggttttatcaactgggctggaatgcaatcatatgatcatagctcactgcagcctcatatcctgggctcaagtgatcctcctgcctcagcctcctgggtagctgggatgataggcacacaccaccacatgcagctaaattttgtacagtcagggtcttgctacgtggcctagactggtcctgaactcctggccttaggcaattctcccacctcagcctcccaaagggctgagattatagatttaagtcactggagccagcttaaggtattatttttaattatctaaaataaatgtgcagtaaatactctttttatattttcctgattgtttccttagcatataatctcagaaatacaactgatcaaagggtatgtgcatttttaaggatttataatgccagatgccttccaaaaggtgttaacgacttactgaactgacagtatatgagggtgctatacagtcatttatttatttgaaaaacaaacaaatctttattgtctagaaatatatatttttaaaatcccccagaaaagacgctattctctcatttccccatcctcttcctcttccacacctctgagacaaaggacattattatactttagtaaaacttcatccagatgtccagacaataccccaactatgtattcttctgtatttgcaagctacatgttcttatagatacatctgtagatctggttcatctacagataccagttagcctttgtaatccattcgccacttaagtttcactgtcactggcttttctgttaatcccttgaggaaaggtttgggattgaggggtaaatcctttataaccacaggagaatgctgcaggctattcgctgctgaccaagctgccacccatccctggtgactgcagcaggtacccccagacagtcatgtaaatagactaggcccaggtctgcagttctttgctctgaaaaaagagacgtaatagcttctactttttatttatcattttgtggaaataacaggtgttttcctagaatggtttttgatttgctggtaaaaggaccttggacatttaggtcctgaaataaattgttgcatctttgaaggaaaagatgaaagtagtttatcacacttcagtgaagaggcctttggagaagtttgttctagatgctgtatattctccatagaggagtgctggggtttctccaaatcagtagaactaaagggtaactgaagagaacagagtgacatgtcagattgagaatcagtcttttgaggctgggcgtggtggatcacacctgtaatcccaggactttgagaggccaaggtggatggatcacttgaggtcaggagttcgagaccagcctggccaacatggtgaaaccccattgctactaaaaatacaaaaattagccgagtgtggtgatgagcacctgtaatcccagctgcttgggaggctgaggcaggagaatcacttgaacccgggaggcggaggctgcagtgagctgagatcaggccattgcgcttcagcctgggggacagagagagactccatctcaaaacaaacaaacaacaaaaaagaatcagtcttttgaaagtggcaaaaagggctgggcacggtggctcacgtctttaatcctagcactctgggaagccaaggctagtggatcacctgaggtcaggagttagagtctagcctggccaacatggcaaaaccccatctccactaaaaatacaaaaattagctaggtgtggtgacgagcacctgtaatcccaactacttgggaaattaaggcaggagaatcgcttgaacctgggaggcggaggttgcagtgagccgagatagcaccactgcactgcatcctgggcaaaagagtgaaacactctgtctcaaaaaaaaaaaaaaaaagaaagaaaagtggcaaaaagaataggctagaagatactagctacaattcctctttttttttttttcttttggatttctcaggaatgatttcttcctagttagaccgccagtgttgcatggtaaccacacccatgaaaagggccggaatattgaaaaactgcatgaaactaagcgctgtgggtcgggcacagtggttcacgcctgtaatcccagcactttgggaggccaaggtggctggattgcttgagctcaggagcttgagaccagcctaggcaccatggtgaaactccatctctacaaaagatacaaaaatcagttgggtgtggtggcacatgcctgtaattctagctacttgggaggttgaggcatgagaactgcttgaacccaggaggtggaggttgcagtgagccaagatcgtgccactgcactcagccttggcaacagagcaagacctggtcttaaaaaaaaggaacttctgttagtcaaagagcttcataaaaagtgaaaaaacaagctataaattaagagacagtttactgtgcgcacacattatatgtgtgtgtgtatatatgtatcttcatggattagaataatatattaaaaactattaatttctaaatggacaaatcataaatagacatttcacagaagaagaaaaaatatatagctaacgaatatatgaagatatagttaatttcactaataaaagaaacgcaagctataccacaagataccatctcatatccatttgattgggaaaaaaattaagaagtctgacattagtaagtgctggagaggatgtagatcaatggaaatcttcacacatggcaagggggtacgactgctttgaaacacagtttgacattgtcttataaagttaaatcttcacagactttaggacccaacaatctactcctaagtgtataccctagagcatgcattctcaatgggggagatatcacctcaccaaaggggtaaaattagtaggagagcagggtgaggtgagccagaataaaaaaaagaaatcgggccaggtgcagtggctcacgcctgtaatcccagcactttgggaggctgaggcgggcagttcacaaggtgaggagatcgagaccatcttggctaacatggtgaaaccccgtctctacttaaaatacaaaaaaattagccgggcgtggtggtgggcgccgtagtcccaactactctggaggctgaggcaggagaacggcgtgaacctgggaggcggagcttgcagtgagccgagatcgtgccactgcactctagcctgggcgacagtgcgagactccgtctcaaaaaaaaaaaaaaaaaaaagaaatcttacactttttatgtatacagagtacataaagaggccaggcacagtggccaacacctataatcccaacactttgggaggccaaggaggcggtactgcttgagcccaggaattcaagaccagcctgggcaacatagcgagactctgtctctatttaaaaaataaggccaggcgcagtggctcacgcctgtaatcccagcactttgggaggccgaggcgggtggatcaccccaggtcaggagtttgagaccagcctggccaacgtggagaaaccccgtctctaccaaaagtacaaaaattggccgggcggggtggcaggcgcctataatcccagctattcaggaggctgaggcaggagaatcatttgaaccgggaggtggaggttgcagtgagccgacatcgcgccaccgcactccagcctgggcgacaagagcaagactccatctcaaaaaacataaaaataaaataaaataaaacaaaataaaataaaaaataaattttaaagagtacatagagatatgcagtatgtttatggtattaaaatttcattagaagaggaattattaggggaaaaaatatttaaaaaggctccttagtgaggcaacaatgaaaaaaggttgagaaacactcccctagagaccctcttacacatatgcaccagaaaacatgtttaagaatgttcataacagcaccattcataacacaggttgggtattccttatccaaaatgcttgggactagaagtgtttcagattttgaatttttttcagattttagaatatctgcatatacataattagatatcttggggatgggacccaagtctaagcaggaaatttatgtatgtttcttcttttttttttttttttttgagacgaagtctcactgtgtcgcccaggctggagtgcagtggcacgatcttggctcactgcaagctccgcctcccggattcacaccattctcctgcctcagcctcccaagtagctgggactacaggcgcctgccaccaggcccggctaatttttttttttttttgtatttttagtagagacagggtttcaccatgttagccaagatggtcttgatctcctgacctcgtgatccgtccgcctcagcctcccaaagtgctgagattactggtgtaagccaccatgcctggcctaaatttatgtatgtttcatacacaccttatacacataagtatgcctcagattcccaaagtgctgggattacaggcgtgagtcatggcacccagcccatcccacttttatgactcagaatgttcctgtgcttttttttttttttttttttttgagacacagtctcgctctgtcgccaggctggagtgcagtggcacaatcccggctcactgcaacctctgcctcccaggttcgagcgattctcctgcctcagcctcccgagtacctgggactataggcacgcgccaccacacccagctaatttttgtgtttttagtagagacagggtttcaccatgttggccaggatggtcttgatctcttgacctcatgatccacccacctcggcctcccaaagtgctgggattacaggcatgagccatggcgcctggccgttcctgtgcattttttacccgaattcctcccatttcacttttaagatcatttcttgttctaaggaagcagagagtagtcatcatttacagatgacctttacattgaacataatgtctgaagtttgcatctttcctaaatcttttcccaaagaattaaaaaaatatatatatcccaagcattgaaggaaacttgagagggccctccatagccttaccttcagcaggtttaggactttcttgccaagatccagctcaaagttggcataattagaaccacacatgtcatagataaacaccagtccattcctctgagtttcaaagctgtaaatcaaccattgaacaaaaacatttgtaagtaagcagatggatgaggcaggttgaaagcctaatgccaaaacaaaacctgagagtatgagacacatctaggatcaaaacaactgcctgactgcacactggtcttacaaaaagatctcttatctttggtatctgctatgtttattaaggcagatttatccagatgtaccaaatgccaaactcgtaggttgagaatgctctacagcaactaagttatcaaaatctgaactgttttctcccacccctctgaatctacctacccaaatcatataacatattccgtactcaaccccaaagtttcctcttccatgaaagtttccctgataactgtaatcaaacatgctaccaattgttttttcccttaaagccccataaatctttctgtggatttttcttgtggccttaataaactctgtatagccatctgattctctcctaaaggacaagaacttgttgttccactcattacgcccaacaatccctagcacagcccttaaaaataaatggtcactgaattgtaattcagtagactggaagcccatctctaagaaaatatttcagacctgtgaaaaactgtgtagaacaaaactgcctctaagctcattgatagtaaatttgtctcttatgaccccatggaggaagagaacaaacccataaatggcctttggaaagcattcctaaaaagtagattaaggctgacatagtggttcatgactgtagtctcagtactttgggaggctaaggatggtggatagcttaagcccaggaatttgagaccaggctgggcaacatgacaatacctcatcatgtagtgacctatagtctcagctacttgggaggctcaggtgggagggtcacttgagcccaggaggtcgaggctacagggaggtcatgccactgcactccagcctgggagacagcgtgagatcttgtcttaagaaaaagtaagactgggcgcagtggctcacgcctgtaatcctagcactttgggaggccaaggcagctggatcgcttgaacccaggagttcaagaccagtctgggcaacatggcaagaccctgactctatttaaaaaaaaaaaaaaaaagagggaaaagaaagaaaaaaaagtagattaacaggtattaatagtaagccatggctgggtgtggtggctcacacctataatcccagcactttgggaggctgaagcaggtggatcacctgaggtcagcagtttgagaccagcctggccaatatggtgaagccccatttctactaaaaatacaaaattagctgggtatggtggcacatgcctgtaatcccaactacttgggaggctgaggcaggagaattgcctgagcccaagaggcagaggttgcagtgaatcgagattgcaccactgcactccagcctgggcaacagagcgagactccatctcaggggaaaaaaaaaaaaaaaaaagtaagcctattcccagaccaaactgaggaacatttgaagatacagaaagtattcctcagtccaatttcccagatttataaagatttctcaaagatgtactcttccaccaagccagatccgtacttatatgtgatctgcagacccaaatggtcattaggataaattatttgattggactactcacagatgacagcaagagttttcacatctatttagaattgagaaaatgtttggcacaaaactcattcctgaaatcaggagtctcaaagttattgttttttgttttgagacagagtttcactcttgtcacccaggctggagtgcaacggcgggatctcggctcactgcaacctccgccgcccgggttcaagcaattcttctgcctcagcctcccgagtagctaggactacaggtgcccaccaccacacttggctaatgtatttttagtagagacggggtttcgccatgttggccaggctggtctcgaactcctgacctcaggtgatccacccacgtcggcctcccaaagtgctgggattacaggcgtgagccactatgcccagcctcaaagttattttgtatcttactatttttgcaccagcacctcctgggaacctccatatcttcatccctttaacaaattccaaggcagaagcacccgcccatgagctaacatttcaaaaatgtctaattctgaggtacatgaaagtttctccagcagacttagtttcaactggcacctaatgtgttacattagtgttaaatctttactcctttttcttatttatttctttacttattttttaatttttagtagagatggggtttcattatgttgcccaggctggtctcaaactcctgacctcaagtgatctgcccccctcggcctcccaaagtgctgggattacaggtgtgagtcactgcgccctgcccttgactcctttttcacaaccccagagagactatgatccacaaaggtccaagatgctgttaaaatgtgtggcacaggacaggtccagtgactcacacctgtaatctcagcactttgggagactgagatgtgaagactgcttgaggccagaagttcgagaccagcctggtcaacagagtgaaactccgcctctacaaaaaaattttaaaattggacgggtttattagtacgtgcctgtggtcccagctccttgggagacagaggcaggaggatcatttgagcccaggagttgaggctgctgtgagttatgatgatgcaactgcacttcagcccgagcaaaagtgagaccctgtctcttaaataaaaagaaacaaagaaaatgtgtggcacaattattgaataggctatccagatctagatactttctatttctccatgagctcctcaagggtcaaattcaaattatgggctttcccctcatgactccaggttgtggcaggggactaaaacaaaaacaagtcagtgagggggcaaagagaatttaaaaaaaaagaagcttggatgcataatgaatgatccaggttctatattcccagatcaaagtgctcatcctgtgaaggcacataaaacatgaatgcagtaagattttcacactttagggtatagaatagatagatagatagatagatagatagatagatagatagatagatgtgtgtgtgtttatatatgtgtgtatatatatacatatacttttttttttttgagacagagttcgcttttgttgcccaggctgaagtgcaatagtgcgatctctgctcactgcaacctccgcccaagttcaagtgattctcctgcctcagcctctcgagtagctaggattacaggcacccaccaccacgcctggctaattttttgtatttttactagagacggggtttcaccatgttggccaggctggtctcaaactcccgacctcaggagatccacccccttggactcccaaagtgctgggactacacgcgtgagccaccagaatatatatatttttaagacagcattttactctgttgcccatgctgtagtgcagtggcacaatcatggcgcactgtagcctcgacctcccagggctcagatgatcctcccagggctcaggtgatcctcccagggctcaggtgatcctcccagttcagccttccgtgagtgtctgggactacaggcaaataccaccatgcctggctgcctaatttttaaactttttgtagagacgaggccttgctatgttgcccaggctggtctcgaacttctgggctcaagcgatcctctcacctggcctcccaaagtgttgggattacaggcatgagccactgcacccagtttaagatttacaatgggccgggcacggtggctcacgcctgtaatcccaacactttgggaggctgaggtgggtggatcacgagctcaggtgatcgagaccatcctggctaacaaggtgaaaccccatctctactaaaaatacaaaaaaaaaaaaaaaaaacgggcgtggtggcaggcgcctgtagtcccagctactcgggaggctgaggcaggagaatggcacgaacccgggagtcggagcttgcagcgagctgagatagcgccactgcactccagcctgggggacagaccgagactccgtctcaaaggaaaaaaaaaataaaaaaaatatttttttaattcttgagctacatgttacagaaaacaccaagaagtttaaaatacagtccctgacattggttttaaaaaaacggagaagccagatgcaatggcttatgcttgtaatcccagcattttgggaggccgagatgggaggattgcttaagtccaggagttcaagactgcagtgagctacaatcatgctactgcactccagcctgggtgacaaaccaagccctagtctcaaaaaacaaaaaagaaagaaactgaggataggagatccatgaggggctaccaatgaaacaagactgttacagatcactttgaagaagacggatgatggatatgtggatgttcacgataccattctctctcaacctacagagattcggatgttaaaaagaaagtttcctgccctcaagaagcgagtggattcatcatgttgcccagggctggtctcaaactcccgggctcagacaatctgcccatctcagccaaccaaagtgctaggattacaggcatgaatcaatgcgcctggcctcaatatagcacttctaatccggaggaccagccaaagatgtcgagagcagtaagaaactgtaaattacaagcaccagggaaaaaggaatagcagaacaacagcatgggaggacagaaataactctgcccaagagtgaagaaaccaggatcttagaaccagctggactaacatatgatgactgtaaaaaacttcttggggcttgagtttaattgtcaattgaattgtaacaataccaattaccttagcaggaagagagtgatgacctgagctggttctttatgcttatgcacctctttttattaaggatggtttttgcttaactttatacttctgggcttctccctgaatgtttttttgttgttgttgtttgttttgtgtgggcttttttgtggggttttttttgagacaggtcttgctgtgtcacccaggctggaatgcagtggcgtgatcatggctcactacagcttcaccattctgggctcaagtgatcctcccacctcagcaacctcccccacctcccccaagaagctgggactaaaggtgcacgctaccacacccagctaattttttgtattttttatcagagacagggtttcaccatgttgtccaggctggtctcaactcctggcttcaagcaatccacctgcttcagcctcccaaagtgctgggattacaggtgtgagccactgcacccagccctcccctgaatgttgagtctcaaaatcctctgaactaaacggcattattcctgttatgcagacaaagaaactgaggccttagaggttctgatatgagcaaaaagaaccagcacaggtcatctccccctcattcttttccaataagtagttttccatacactgaagattgccgataattgactttctcagcttctgttttcctgacatagagccaaggtggtaaagagaacgcccaccatcttgatagtgcctgcaaacatgccgagttctaaaggacatggattgttttctattcatagcattgcccagggcacatcctaggagaatggcgaaggcactgctgaatttaatcaagtaaaaaactgtcactttcctacctgcatgtagaatacctaaaaaataatctcaatgcttacctatccacagctctgtctagcaagtaaaacagagcctgaagtaccacatgttggactgacttgtggggatgatgcaacctggcagtaaagagggcaatggaggctcctgttgggtcccgaacattctaaagcaaataaaacaagaaacattaaaaaaatcaaatagaaaatcacagcaattactaagacttatatactggataagggtttgatacatgtagaaaacagatgctaacaataattccctgacttcaccaattgctgtccaaagggaagagtgttaatatcatcctttgtctgattctcccaggactccctggaccatatttctgtggtaagaaaaaaaaaacacattctctttgctcttcaactacagacagatcaaaggatggctgtgcactggcttcctagctaacttccctggcagaatggcaaaagaaacaagcagcaggagagaaccagggaacaggaccatgatttccaccctctgccttaaaagtgccattgtatgtttacttgaaaggctgaggtctcaactaagtggagagcttgcgttaaatatggaagcatgggtgtctgacacattgcatatctctcccaaagaccatgactaaccttaatggaccaactgaagaaacttttctaagtctactgtacaactgattttccataattcaattattcaattatcattagtaactctaattactagaaactattagtaattcaattgttactaaaataattttataccaaactgcatggctgtttcacatctgctcctaactgtggagactctctagattcaggataaggtatataggaacaaagtccaaacagggggggatggaggagggatagcattaagagatatacctaatgctaaatgacgagttaatgggtgcagcacaccaacaaggcacatgtatacatatgtaacaaacctgcacgttgtgcacatgtaccctaaaacttaaagtataataataataaaattaaaaaaaaaaaaaaaaaaacaaagtccaaacaggacaccagttaaaaaaggaagtaataaggccctacaagataggtccctaaacactcactaagatggtgaattttccactgaggatctcagaacgaagaggttcctcatgaggtttcagctttacaatgccttccttccttcgagtttcctaaaaaggaagcacagcaaaatgtattaatatgaaaatactgtatatccaggacagcaccatgtaaccaccaaatctcagagataaggtggttatcaatgaatgaatgaattataaatttcataactaaataaattttgtaactaatttcataaccaattctacttcatttagttgaattagaattcaattaaatgggccgggcgcagtggcccacgcctgtaatcccaccactttgagaggccaaggcgggcaggtcacctgaggtcaggagttcgagagcagcctggccaacatggtgaaaccttgtctcggctaaaaatacaaaaattagcctggcatggtggtgcgcgcccataatcccagctactcaggaggctgaggcaggagaatcgcttgaacccagaaggtggaggttgcagtaagccaagacagcaccactgcactccagcctgggtgacaaaatgagactctgtctcaaaaaaaaaaaaaaaaaaaaaaaagaattcagctaaatgaataatgaagtcaactaaatgaattatgaatttctttgtaacctgcctccaagccagtcaagcattttcggaattcctgtccaaagctactttatcagcccctcaggtagggtatttttctctgactcagtaagaaccctaaccctgaagagtaaccagtatgttacattcaggtgcaggatcaaggttcttaaacacgcagcagcactgacatggtaccaggacactaaaatatggacctcaaaaatgtctggatgcctacgttctcacatattttctaggtttaggcctctcctatgtttaaataggagccttctctccacctgatattgtctccaacagcagctaccatgacttcattttcctcaccctgatggccagattctttttttttttttaattgagaccaagtctcacactgttgctgaggctggagtgcagtggcatgatcttggctcactgcaacctccacgtccaagagattctcttgcctcagcctcctgagtagctgggattacaggcacgtgccaccatgcctggctaatttttgtgtttttagtagagacggggttttgccatgttgcccaggctggtctccaactcctgggctgaagcgatccacccgcctcggcctcccaaagtgctgggattacaggcatgagccaccgcgcccagcctcttcagttctcctcttaaatgacaaggttgaccacctacacttcctttttccggagacattctctacctttatataccgataacaaaaaaatattatcttggtttgtcttatttcatcaaccgcttgttttaaacctcttaggctgggcacggtggctcatgcctgtaatcccagtactttgggaggccgaggtgcgtggatcacttgagctcaggagttcgagaccagcctgggcaacatagcaaaaccccgtctctactaaaaatacaaaaaattagccaggtatggtggtgcatgcctgtggtcccagctactcgggaggctaaggtgaggtgggaggatcacttgagctcaggaggcagagatctgcagtgagctgagatcatgccacttcacttcagtctgggagacacagcaagactctgtctcaaaaaaaaaagtgcttccacagaatccagtgctgccttatcataacatttctacaactctttgtttattttctctttcttttttttttttttaaacagtctcactctgttgcccagactggaatgcaatggtgtgatctcggctcactgcaacctccacctccttggttcaagtgattgtccctcctcagcctcccgagtagctgggaatacaggtgccactacacccagctaatttttgtagttttagtagagatgcggttttgccattttgttcaggctggtctcaaactcctgacctcaagtgatccacctgccttggcctcccaaagtgctgagattacaggcatgagccaccgcacccagccctagtctctctttctaaatagtaatctctgcacctggaacacagtaagtataaaataagtatctgttgagtaaatgaatgaatattgaatgagctggtccacaagacagatgtaaccaaacttcagttaagctaatcctagtgcttgttatcccaatttttttttttagggagattttgtatttctttagaaggattctgaccccaaagtaacatgctgtatagtgttttatcaaagacactactaactgagaaagcaaacaagcacaaaaccaaagtctatgccccctcaaaaaacaaaaatcaaaacaaagtaaaatcctgatgccgctacatttgcataaagatactttaagataatggacctagctaatacacagttgctcttcttttccagtgttaaaacttcccttcctgaactgcccactaagctcatcattcatctgaatggcaagtttctaaaagccttagacaacctgaaaaccaagattttcatgtggccagaggccaatgaaaagagctaggattaaaactctaggaagggtgaacccctatcctgccaccaggatgctgtcaggctacttcctccgtctcaatcattagatgtggcatcctggtctacgatcaaaacttaggtacaaaagtagtgccttccagtagctgccttgcccagcttcagctctcacaagggctcctggatatggatccattttttatgaaagtgaggaggaacacttagagaaccaatgtgtgtgtcgagcatgacagggacaacagcaacacttaacccaactgccacaggtctggtctacccctgagccacatactctgtaggagtggaacaattctatggcacggagcacatcaaacttccttgccatgaggaacttgacagccacattccaagacagcggggaaacattgtactgaactgtccacttgttaatctcttcgagaaactgcttggtagcctgtttgacaaagaaagaaagaataattagtaagaagagagcatatttatggagtcaaaaaacaaacaagtgaaaactatcatcccttctccaagcaagtctgaacccagtttgctacagggagcagggaaagacaaacaaaaaggtagaaacaggtctgaaaccagacatagttaaaatttgtataattcaatgaggccagaagccagatctaggttcagaaaacaggacttagtgcaggtatgcatgaaaaaatgaggggggagaagagggatcctaaatgagatgcaaattactagtcccaaagcaaaaaataaaaaaatttaaaaattttgggaggccacactttgggaggtagaggtgggaggatcacttgaggtcaggagttcaagactagcctgaccaacatggtgaaactccatccatctctactaaaaatacaaaactagccggatgtggtggcgcacgcctgtaatgtcagctacttgggaggctgaggtaggagaactgcttaaacccaagaggcagaggttgcagtgagctgagatcatgccattgcactccagcctgggcaacaagagcgaaactgtctcaaaaaaaaaaagaaagaaagaaaaaaaaagaaaacaaaaagaaaagtggccaggccttccgaaggattattgcctaatgcagtgtagtatagcagtctcagctgctgctttggtcccacaagccaaatggacacagcaaaagaatcagaaaatggttttggctttggaatttgaggccagtaaaattattaagaagaacttagccaatcaaaagagcagctattctttgtgctaactgaccccactggacctcttcatgctttatatggcaaccccaaaactggatactagtacccagagtcaataacagcccctctggatagtggttttggaaaggggaggaaaattttcatttttactgtctgacccaggctggcaagatgcctgcttccagaactgtttctatctctcaactaattcatgttcttttatgcactctcatcctatttctccttacattataaccaatttcctttttagacaaactacttttctgtttcttcattttagaatgatttaaattgggatttttttttttctttttttgagacagggtctcactctgtgacccaggctggaatgtagtggcacaatcttggctcactgcagcttcgaccacctgggctcaaacaatcctccagcctcagcctctcgagtagctgggactataggcatggcatatgtcatcacacccagtaatttttttctttgttatttttagtagagacaaggtctcactacatagcccaggattggtctcaaactccggggctcaagcgatcctctcatgatccctctcaaagtgctgggattacaggcatgagccactgccctcagcacattttttttttttttttttttgagacaatatctcactctgtcacccagcagactgcagtgcagtggcacaattactgctcattgcagcctcaaactcctgggctcaagggatcctcctgtccccgccttccgagtagctgtgactacaggtgcacaccaccatgcctggataatttttttgattttttgtagagacgaggactccctttgttggccaggctggtcttgaactccagtgctcaagtgatcattccatctcgcattcccaaagagctgggattgcatctgtgagctaaattggaattttttttttagatagtctcactctgtcacccaggctggagtgcagtggtgcgatcttggctcactgcaacctctgcctccagggttcaagtgattcttctgcctcagcctcccgagtagctgggactacaggggcacaccaccacgcctggctaatttttgtatttttagtagaggcaaggtttcaccatattggccaggctggtctccaactcctgacctcatgatccgtccgcctcggcctcccaaagtgctgggattacaggtgtgagccaccgcacccagccaggaataatttttttgtaggcattctacactactaaaagcttcatgcatggctattctgtcccttccatccagaaacttttctcagctgtttgtctgcaatatgacgaacctgatgagaattctgaattttaaccatacctctattcccaatcaacccacagttatgacttatttattcatatttaataagcacctgttatttgttaagctaatacttgcactgaaaggtataacgaataaaaaaatgaggtttgcttcgaaaggtataaaactagcctaccatgtgaccatggacacggtaattctgtctttgctaatttttcaattgaaaaataaagggaggaccgggcacggtggcccacaactataatcccagcactttgggaagccaaggcgggtggatcatttgaggtcaggagttcgagaccagcctggccaacatggtgaaaccctgtcactattaaaaatacaaaaatcagccaggcatggtggtgcatgtctgtaatcccagctactcaggaggctaaggcaggaaaattgcttgaacccaggatgtggaggttgcagtgagccaagattgtgccattgcactccagcctgggtgacagagcaagactctgtttcaaagaaaaaaaaaatggctgggcgtgttggcttatgcctgtaatcccagcactttgggaggccgagggcagatcacgaggtcaggagctcgagaccagcctggccaatatggtgaaaccccgtctctactaaaaatacaaaaattagctgggcatggtggcatgcgcctgtgctcccggctagtcaggaggctgaggcagaagaatcgcttgaaccaggaggtggggttgtagtgagccaagatcgcaccactgcactccagcctgagcgacagagagagactccatctcaaaaaaaaaaaaaaaaaaagaaaagaaagaaagaaagaaagaaaaagaaagggagggctaggcacggtggctcatgcctgtaatcctagcactccgggaggccaaggcaggaagatcacttgaggccaattcaagatcagcctggccaacgtagtgagatcctgtctctataatagatatatatattacattatatatattacatattatattattatatattatattataatatataatatattattattataataaaatatatattataataataaaaatatatattataatatattatattataatatattataatataatttattatataatattattatattataatatattatatattattatattataatatactataatatatattattatattataatatactataatatatattattatattataatatactataatatatattattatataatatactattatatatattattatattataatatatataatatatattattatataatatatataatatatattattatataatatatataatataatatattattataattattataatataatatataatagaatatattataatatatcataatataatataatatatattataatatattatatattatgatatattatatattacgatatattatatattattatatattatattatatattataatatatatttttattattataatgtatattttatattatatataatatatataagaaaaataaagagaaaaagcataatagcaatgacctacttcggagtcttggcaacaagtcctaccttacaaatacaattcaaattgctacacactatttaaacaactggcaaactaaaatcccaggagagtcagcaatacctcataacagagcatctgattcatcccccaatttctaggaaaggacaaaagtactttataaaccccaggaaagtctaaacggcctgaggctgcacctgagctttagagccttacgattaaggcaacatagcttacaccattggagaaggaaagaaccagcaaaaccaatcaggcaaagtgcatgaaaagagccaagaaataaaggccatgaagaaaagctttcagaagatcattctggcctggaaccagctgaagccacgccagagaaatgagtcccagagaagacaacaggacaaacttagaatgctccttcagaaaatagtttgaattgcctctgtggagtgagtggccagcatcaaaatgaggaaagatggaaggaaaaagaagtgagcacagaaagatcccagaaataaaactctagccagtcagtaaattccccaggagacatggtacctgtttttgttttttgttttttctgctttttttttttcttttgagacagaatctcgctctgtcgcccaggctggagtacagtggcgcaatcttggctcctggcaagctccacctcccgggttcacgccattctcctgcttcaggctcccgccaccacacccggctaatttttttgtatttttaatagagacagggtttcaccatgttagctgggatggtctcgatctcctcacctcgtgatccacctgcctcggcctcccaaagtgctgggattacaggcgtgagccaccacccccggccgagacatggtacctgttttttaattaacctattatcctttaaatacagttctctagtgggcctctctgatgttgcttatagaataaaacaccagaataatagaacatatttttcctgctacttagctgggtatacaatttctaataaaaaataatcaacggataaatcaatgtataagtagaagtggaaaatgtaaatgaccaagaggtgatatgaactcatcacatatccatctgttaagataaattttcattttttggctgggcacagtggctcgcccctgtaaacccagcactttgggaagccaaggtgggcagatcatgaggtcaggggttcgagaccagcctggccaacatagtgaatgaaaccctgtctctactgaaaatacaaacaattaacagggtgtggtggcaggtgcctgtaatcccagctacgtgggaggctgaggcagtagaatcgcttgaacccaggaggcagaggttgcagtgatccaagatcgtgccactgcattccagcccaggagacagtgcgagactctgtctcaaaaaaaaaaaaagataacttttcatttttcataaataaaccatgtcctaataagagaaaggcatgcaggtttcacacacttccttcaaagtacatcttgccttcctttttattaagctcagttcctccaaggtccttaatgttctgtagctcccaagagctgttgccttgagctgacctctgtccccctgctggtcaggatgttattcttggctttaagcacaggaacaattcctcctggtttggcctgaccaggccttgcatgtagagtccagtgtactataaacagtgatgtgatatttacagatacaaatacacatgcgtagcacctgctctgttcagcctcagattcaccctcctgcacacccatccctctggtggaagagatgaacctctaaaaggagtcagaaagaatggcctcatcttcaacaaccttcctttagacagttaatcagatttctccctctgcttacacataggtttaacatgaccactgagtacaaagtaatttgtagctctgctggttaccagaaaaacaagtcccagcaactttaatcagcaacacagtcttcagaagggataattgaaattctcaaaattaaaactcagtttatttcctagtgaaagaaagaatgagccaaaagatgagtcacagcttagaaaatattttaactccaggacaatggtttgaatctatctatgcttatgaaacacaagttgttaacacctggcagctaaggaagagctggagttcaaacagctctggtcttcctttgggataaggtctgaattgatatatggagaaactaacattaccacttacaaccctccttaaccagtttttcaggtaagggtaagatttgttttgttttgcttttttgagacaggttgttgctttgtcaccgaggatggagtggagcaatcatggctcactgcagcctcgacctcctgggctcaattgatcctcctgcctcagcctttccaagtggctgagactacatgcacacgtcaccatgcctggctaatttttgcattttttagtagagatggggtttcaccatgtagcccaggctgatctcgaactcctgggctcaagaaatccacctgcctcagcctcccaaagtgctggaattacaggcatgagccaccgtgcctggcctcaagggtaagatttgttcctgcatagtcaaaaagcatactataattatctacttctcccacaaccatgtttaaataaataaaaacaagtttcttgactatggccatgaagataaagatactagagaacctgctataaaacagctgagaaagctgtcaattaagcagggtacaccctggacacaattcattagtgttgaaataatggtatcagagagaataaaaccaacaacatagcctccatgttacatcaaactcccaagagcagctataattttgagatgagctttgggcaaggaactagccactcaagaggacaagaataatgtgctggcactctcagttccacaggtagtaccttaaatcctatatcccaagacaacctaggagagtgaagagccagacctgtaagaaacctgctcttgaaataaacaaaaaacttctgtctcctgaaatatcagttacctagcaacaaaggagaaagtttagtgtggttttggggattataaagaaccaatccatcttcttattcactactgtgtgttatttgggcaagtcatttaacctctctgagccacaatttcctcaccttgaatgagaaacggatggaagagcacccactaccatacctagcacttggtagtctctgaatggatgaatgttcattctcttttttctttactctggtcatttcacactaaaacttctttcaacaaagatagaatttcttagaatcatatgacctctgttgcttccctttagtctgtatcaatgcaatctctctaatccattttatacaaaaccatacatttaaactagaaatatgtgttcaggctgggagtggtggctcacatctgtaatcccagcactttggaaggccaaggtgggaagactgcttgagcccaggagttagagaccagcctgggcaacatggtgagaccccatctctacaaaaaaatttaaaaattagccatgcatggtggcacatgcctgtggtcccagctactcggggggctgaggtgggaggagtgcttgagcctaggatgccaaggctgcagagggccaagatcataccactgcagtccagcctgggtgactgagtgagactctatctcaaaaaaaaaaaaaaaaggccaggtgcaatggttcacgcctataatcccagcaccttgggaggccgaggcaggtggatcacctgaggtcagaagtttgagaccagcctggccaacagggtgaaacctcgtctctactaagaaaacaaaaattaaccaggtgtgctggcttgcgcctgtaatcccagctactcaggaggctgatgcgggagaatagcttgaacccaggaggcagaggctgcagtaagccaagatcatgtcattgtactccagcctgggtgacaagaaagaaagaaaaacaaaagaaataaacattcaactgaaaacgattttttttttttttgagacagagtctcactctgttgcccaggctggagtgcagtggcgtgatctcggctcactgcaagctccgtctcctgggttcacgccattctcctgcctcagcctcctgagtagctgggactacaggcggccgccaccatgcctggctatttttttgtatttttagtagagacggggtttcactatgttggccaggatggtctcgatcccttgacctcgtgatccacctgcctcggcctcccaaagtgctgggattacaggcctgagccaccgcgcccggcctcaactgaaaacactttttaaaggaccaattattccttattcaaggctctgtggctataaagaaaaagctgaggccagaagtatttagacttcagttcccatctttttgtccctactctcagacttctctggcagctccagagattaacaatgccatcctaggcacaagctccttttaacagcgcaaactatggagaggtctcaatacaataaagaaacaggtgttgattacaggtgttgtgcagaacaaacaccatgaaaaaatgcagtcagtcatcctgcaatgaagacctaaataaggaaagtgattcaagataagatgcaatgtctggcttttaacaaatttgaagatacttctgtatttcaacaaatatgccatttctccattatttcagtgatggatgcattaatgaactaccttcctctcatgacctgtttcccccctctctccttcattgtgattactgcctttttatatctattgatctcttcagcccatattaatctgctaggtgagactctgagcaaagacacactggtttgctataaggcagcaagaggtttgatgaatttccaaactaaaactacgatttttccataagcactttgttaatgtaccaaaaaaggaaacaaatccagtccctttaatatttactggtttatctcaaatattttccacttctcaggaaaacattgccttttcttaaaatgtgattttaaaagagataatgctttcttaaataggctcttactgcatttgggaaaagttttaagtatattttctgattttatcgtattataaaacaatgtaataacaaaaatttgcaaaaagtaaaaggccagtcataatctgtgcacacacacatttaaagaaaaacttaagggaaggggaaaagaaaggattagtcaaacattcacaacaaatatttgctgagggcccattctgtgctaatcagtacagtagttgttgagaagacacaacatagatcgcttcttggcctttcgctaagatcaagtgagaagacacaacatagagacataaagaccctattccaagcagtttacaatcatttaactatggagacagatgtataaatacatctttaccacataatgtaataaattctaggaaggttctatgaacagaatgctatgggattcaaactctctctatggatataaaaaaaatttttttaggagtgccttgaaggatgagtaggaatctgtcaggcagagaaaagtattctagtcagagaacaaaatgtttcaaatcagggtcatgaaagaacagggcttattggggatatcatatagctagtgtgtccaatgtgtatgagggagaatggtgggagatgtgtgaacaggggggctgaaccagactgggaaggcccttgtatgctgtacttcaaattccagacatgatcctataaacataaaagattcaatagagatctttaagcaaagggatgagatgatgagtttggttcccctctcccacctcaaaaaaataactataagcagtggggaagtcagactgaaaggaaaaaaaatctagcaacagggaggtaagttccctgaagacagggatcatatctattttattcacctagttcctagcactgtgcctggcacaaagcacttacttaataaatatctatgatgaatgaatgaattaattattgaagtctcaatattattaacatttagagggcagacagaagatgaagaacaaaggaacttttacaattttcttttagaaatactagtgattgcaggccaggcatggtggctcacacctgtaatcccagcactttgggaggccaaggcaggcggatcacctgaggtcaggaattcgagaccagcctgaccaatatggcaaaactccgtctctactaaaaatacaaaacttagctgggcatggtggtgggcgcctgtaatcccaactactcaggaggctgaggcaagagaattgcttgaatccaggaggctgaggttgcagtgagccgagatcatgccattgcactccagcctgggtgacacagtgagactccgtctcaaaaaaaaaaaaaaaaaaaaactagtgattgctgaaaatcaaataaatggtgatctaaacaaaaacaagaggaatcgtcaaatatcttccctaaaaaaaaaaaaaaaaaaaaaaaaaaaaggccaggctcggtggctcacgcctgtaatcccagcactttgggaggcttaggtgggtggaccatgaggttaagagatcaagaccatcctggccaacacggtgaaacccccacctctattaaaaatgcaaaaaacttagctgggcgtggtggtgcgcacctgtagtcccagctactcgggaggctgaggcaggagaatcacttgaactcaggaggcggaggttgcagtgagccgagatggtgccactgcactccagcagggcaacagagggagactccatctcaaaaaaaaaaaaaaaaaaaaaaaggccaggcgtggtggctcacacctgtaatcccagcactttgggaggccaaggcaggcggatcacctgaggtcaggcgttcaagaccagcctggccaacatagtgaaaccctgtctcttctaaaaatacaaaaattagctgtgtgtggtggtgcctgcctgtaatcccagctactcaggaggctgaggcaggagaatcacttgaacccaggaggcagaggttgcagtgagccaagattgtgccactgtactccagcctgggagagagagcaagactttgtctcgaaacaaaacaaaacaaaacaaaacacacacacacacaaagcttcacagtaaagatagctctcacattacaggcttctccgaggaatgtaaagacttggtttaacatcaggagatctatcaaagcaatttttatgttaacaggaaaggaaaaaaaagtatataaccttctcaacagatgctgaaaatgcactgcgtaaaatccatcacacataggccccgtaatttttttctattaaagatgagaaggccagcaggtacctgctattaccaccactatgtaacattgcactgaaggtcatacctaacagaagccaaaagatgcgtaacaacctgatgcaaaaagacaggaattttaggccaggtgtggtggctccaatctataatcccagcactctgggaggccgaagtgggcagactgcttgatctcaggagttcgtgaccagcctgaggaacatgacaaaaccccgtctctacaaaaaatacaaaaattcgcccagcatgatggcacacgcctacagtcccacaagtgggaggatcacttaagcccgggaggcagaggctgcagtgagctgaaactgtaccactgcatggccccccagcctgggtgacacagccagaccctgtctcaaaaaaaaaaaggaatgttaaagaagagaataaaattcagaaaccacacagtgtatatctaagtatacagtatatgaaacaagtaatatgactattagtaagcaaaaagtattataggaatttagatatgcacataaatatttgtaggatacacaaaaaactggtaataatggtcacctctggggagagaaaatgaactggggctgggtgtaatgcttcacacctgtaaccccaacactttgtgaggctgaggcaggaggatcacttgaatccagtagttccagaccagcctaggcaacaaagcaagacccagtctctataaaaaaaataaaaaagaaagaaagaaagaaagaaagaaaatgaactgggaaacagcattggaagataactataagcaacctttaaaaaatttttttttggccgggcgtggtggctcacgcctgtaatctcaggtgtttcaccattttggccaggatggtcttgatctctcgacctcatgatccgcccgccttggcctcccaaagtgctgggattataggcgtgagccactgtgcccggccagtgatttatctttagtaaacaaattacatttactatcttctctctgaaggaagttggtatttagaagattttttttttttttttgagatggagtctcgcactgccacccaggctggagtgcaatcgcacaatcttggctcactgcaacctctgcctcccaagttcaagtgattctcctgcctcagcctcccaagaagctgggattacaggcgtacctgcctactttttgtgtgtgtttttagtagagacggggtttcactacgttggccagactggtctcgaactcctgacctcatgatccgcccgcctcagcctcccaaagtgctgggattacaggcatgagccaccgcgcccagcctagtagagaagatttaattggaggaccacgaaggtagaaatgttcacccatttgaatatgtgaacttttttattgttgttttttgagatagaatctccctctgtcacccaggctggagtgcagcggtgtgatctcggctcactgcaaccttggcctcccaggttcaagtgattcttctgcctcagcctcctgagtagctgggattacaggcgcgcaccaccacgccaggctaactttgtatttttagtggagacggggtttcaccatgttggccaggctggtctcgaactcctggcctcaagtaatccgcctcaagcaactcccctgacctcccaaagtgctgcgattataggcaagagccgccacgtctggcctgaatgtgtgaacttctaaattatatgtcacgttttatttattaggaagtgtgaagtatagaattccttatggctaagacctataaaggtatcattaaaaaatttaaagacataaaatacccctcagtttctctgcctttttgaaggaaagcatcagaaataaaaaacaaaagtgaaactgacttttacaaaagtttagtccattgagatagagcaaataaataggcacaatgaaagaaaagggaatagagtcaactaagtttgagtgcactgtaaatacttttttaaaaataatgtgtggccgggcatgttggctcacgcctgtaatcctagcactttgggaagacaaggcaggtggatctcaagagttcgagaccagcctggccaacatggcaaaactctgtctctactaaaaatacaaaaattagccagacgtggtggcacatgcctgtaatcccagccattcaggaggctgaagcaggagaatcgcttaaacccaggaggtggaggttgcagtgagctgagatcgcaccagcctgggtgacagagcaagactctgtctctaaaaaaaaaaaaaaaaaaagaaagaaagaaagaaagaaagaaaaatgtgaatcaggtctgattggaagcactacttctgctgccttcctgtttgtacttttcagttgctgcaagaatgatccaggcggctgctaggtgaggtgacacataattccagcattttgggaggctgaggtgggaggattccttgagaccagcatggataacatagtgagatcctgtctctatttaaaacaaaaaaaggatgatccaggtgggacgagatgactcatgcccgtaatccaagcactttgggaagctgaggtgggaggatcgcttgagcccaggagtttgagaccagcctgggcaacacagggaaacctcgtctctaaaaaaaaaattaaaaattagccaggtgtggtggtgcacacctgtagtcccaggtactcaggaggctgaggtaggaggatcacttgagcctaggaggtccaggctgcagtgagctgtgatcacaccactgcacttcagcctgggtaacagtgaaaccctgtctcaaaaaataaaaaaataaaaaataaaaaaaaagagacaggatcttgctcttgcccaggcttgagtgcagtggcatgatcatagctcagtgtaaccttgaagtcctaggctcaaatgattctcctgccccagcctccctagtagctggaactacaggtgtgtgccaccacatctggctacttttttaatttttgtagagatagggtctcaccagccgagactggtgtcgcactcctggcctccagtgatcttcccccattagcctactgaagcgctgggattacaggcatgatccaccacacctgccctcattttattattattattattaattaattaattaattttttgagacagagtctcgctctgtcgcccaggctggagtgcagtggcatgatctcggctcactgcaagctccgcctcccaggttcacaccattctcctgcctcagcctccccagtagctgtaactacaggtgcgcgccaccatgcctggctaattttttgtatttttagtagagacgggatttcaccgtgttagccaggatggtcttgatctcctgacctcctgatccgcctgcctcagcctctcaaagtgctgggattacaggcgtgagccactgcacctggcctttattattttttgtttttgagacggagtcttactctgtcacctaggttggagtgcagtagtgcgatctcagctcactgcaacctccacctcccaggttcaagcagttctcctgcctcagcctcctgagattgagaccatcctggaacatggtgaaaccccgtctctgctaaaaatacaaaaattagctgggagtggtggcgtgcacctgtagtcccagctactcagaggctgaggcagaagaatcgcctgaacctaggaggcagaggttgcagtgagccgagatggtgccactgcactccagcctggtgacagagcaagatgccatctcaaaaataaaataaaataaaataaaataaaatataaatcattaataggtctactcccagcaatctggataaatgtatattgggaactcagaaccaactgcttaaaactacatgtggcacagaatctttcacaatgagtttacaaacattttcttcctttaaaagataacccatattatcaggtctctttattctgatatccacatgttgcaagatagaaagtctttcttgttcatccgttaagggactatgtgcacttcaaactcaaagccctacaaatctcatcagaaagggtaaggccaaataaccatgaagaaaggcctaacacccatctgcctaatgaaaccaaataggatggttctgaaaccatgggactcttccatctaccacatcaagcattatgcaagaacccaagaagaaaaaaagctaactgctattaaaggattaatatcccactgggaacggatcaacaggaaaccagggttgaccaagtgaagtttcccatctgagtccaaagcttcaggcaacactgaggggccagagttaactgaactgttaaacacgaaaagctcctcagtgttaatgacttcctaccagcagaagtgaagggctaaggtttatcagcactccaccagccaagtgtgacagccccagatcaggaatagtttgtctccaatacctgatgagcagaaaatgttctattccttttcaaatgctatttctgtctcctttggctcatggttcctttgtacacataagacagcattagtcacatattaaagaaggcaattcaatcccttcattttttttttggctttttttttttaattatacttttaagttttcgggtacatgtgcacaatgtgcaggtttgttacatatgtatacatgtgccatgttgatgtgctgcacccattaactcgtcatttagcattaggtatatctcctaatgctatccctcccccctccccccaccccacgacagtccccggtgtgtaatgttccccttcctgtgtccatgtgttctcactgttcaattcccacctatgagtgagaacatgcagtgtttcgttttttgtccttgcaatactttgctgagaatgatgttttccagtttcatccatgtccctacaaaggacatgaactcatcattttttatggctgcccttcatttttctagagcaagattttgcccctcccagttcacacagaccaaagagcaaagtcctgcaagaaatcacagtagtagtaaccatgtgtgaagcatttaagatataccagagaaggaaccatactacatcatactcaacactgacaagctaggtattattaaccgcataaagaaatcaaaggctcacagagccgaagcaaactgtccaaggttactcaaccaataaatggcagagctgaggttttgagcactgaatccaagtcttttcaaatccttatagtctttccacttcactaaatgggcatgagacatacaagacacatatcattcatcttattgggtaatatatatgtcatttgtttgttgatctatgcacaaaattactctggaagaataaataagaaactggtagcatcagctgtctcagaggagaactaggtagctgggagacatggtgagaagattaatattttccatattcctttctgtatctttttaagtttaaatcgtatgactatattatccactcaaaaaaataacaataaaacatattagttttatatagcctttaactaaaatatacataacaggaatttttgaacataatatttttgaaactatgccaccaaacaataataagtttgttggtaatcttcatttcagggccaaaaaaatgagttagggagctctacacaggggtaaaggatgacagctgtttcacgaactgctagccttagatggggatgcttcaacgaggagtgtgccactctcactttcctgctggaggcatttgccaatagcatatttactaaacacaagctggcatctctcctctcaggtttaaaaaacacttgccaggccaaagttatcaaagaggatgaagaattcccagagacaacagaggaaataggtaaacaaggaaaacaaggaagtaaacaattctaaattgtcataggagaaaattcatgttaggaggttgagaggcagaatataacacagaagagaaacggaaaaaaacgaaacctgccgagtaaacaagcagctcctggccaggcgtgggggctcacacccataatcccaacactttggaggccaaggcaggaggatcgtttgagcccaggaatttgaaaccagcctggacaacacagggttatccaatctccacaacatatgaaaataaattagccgggtgtggcagtgtactgctgtggtcctagcaggaggctgaagggggaggatcacttgagcctgggagtccaagtctacagtgagctgtgatgatgccactgtgttccagcctgggtgacagagcagaacctgtctcaaaaagcaaaacaacaacaaacaaacaaaacacacacacacaaaaacaagaagctcctcatccaccaacaagagcaacatcatctaggttcccagagggaggtaacagaggtagctggtcacactctccacaagaacctgtagacagcttgccaactgccactcatgccgctaaagagtgagtgaaccacacaaccagaagaaacctgtaaagtctttctgggggaaaaaaaaatttaaagagcttggtaaacatagagagtgggaggggcctttggtaacattttttttttctcttcttccaactgatagcttagactttaggaaagaaaggaggaatgtgaatggctgtgaggaaattgaagttggctttccagatcatgctaaaacattcttacccttcctctactcccaaacctggcttattcctatttctccttcaggtcagcctaaatcctacttcatcctataaatttctactgctttccagccaagcactgaccaaacagtattataaagcatgttattgtctatctgctcccactaaactgtaagcttgggaagatgcaggggccaagggttctgtgccacaactgcatactcaacaccaagcatagtgacaccattctgataagtaaatgtgtcaatggtgatgggctcttggcctgctaaaagagtgtggttcagagagtaggaagaacacatttgaacacttgccaatctgattatgggaacttaaaatttaaaatacaggagagggccgagcatggtggttcacacttgtaatcccaacactatgggaggctgagatgagtagaatgcttgaccccaggagttcaagaccagcctgggcaacatagtgagacccccccatctctagaaaagatttaaaataaagtaaaacaaaacaaaacaaaataaaataaagtaagaggacagcaaaaaattcctaaataaaactgggaaagaacatcaggaaaataacatgagaagaaaagcaatgaaagaggtgactattaaatcacagaagaaactatctggaaattagatatcttaattccctgccaatatcttaacgtcagacatctataataggatatacaaaataaaataatttaaaataaatttatggccaggcgcggtggctcatgcctgtaatcccagcactttgggaggcggaggcaggtggaatcacttgagatcaggagttcgacatcatgacaacagcctggccaacatggcgaaaccccgtctctactaaaaatacaaaaattagctgggtgtggtggcgcacgcctgtagtcccagctacttgggaagctgaggcacgagaattgcttgagccagggatgggaggatgcagtgagccaagatcacatcactgcactccagcctgggtgacagagcaagattctgtctgaaaaaatagattaaagtaaatttatggattttgtaaaataagtaagacatggtctctacccataaaaatctgagtctggcagaactgtgaacacaatacaccaactaatgggcaaatggaattcaaatctttattatttttacttatttatttttgtcttttacaaacaaaagtaagtaattcagatctcaagaggggaagtggaatgacagcacatcccaaaatgatattccctggagaaatccacaaaccacagtagaaaatttctgaatgaggataaaagagagtaatggacatgatacagctactgggagaccccttcaaacttctcaataacagaaaatatagattgttttcttgactcagatcccaaaattgtcagggtgataatggtgtatagaaatagggaacttcagccaggcgcagtgcctcacgcctgtaatcccagtactttgggaggccgaggcgggcagatcacgaggtcaggagttcaagaccagcctggctaacatggtgaaaccccatctctactaaaagcataaaaaataagccaggcatggtggcacatgcctgtactcccagctactcaggaggctgaggcaggagaatcgcttcaacctgggaggcagaagttgcagtgagccgagatcatgccactgcactctagcctgggcgacagagcaagactctgtctcaaaaaaaaaaaagaaatagagaacttcattaaccttgacatttgctggatatcacatttaacttaaaaagggtgggtgggcacagaaagcctgataaattcttgtggacagtttcatcctaaaatgataagagaacgactacactggacattatccagactaaggagaaatactagatgaaaaattgaaagggtttcaagaagaaagtaaccacataatccttaacagtgtgatagccaacaactaagtgttgtcaacaggaggcagttaagaatgcaagttctagacagagcactagtcaccctacattaaagacccagttctgccacagcagaactctcactcaggcaagtcaaaaaccacctgtgccaggccaggcacggtggctcatgcctgtaatcccagcactttgggaggcctgggtgggtggatcacctgaggtcaggagtttgaaaccagctggccaaatggtgaaactttgtctctactaaaaatacaaaaacattaccagatgtggtggtgtgcacctgtagtcctagctactagggaggctgaggcaggagaatcgcttgaacacgggaggcagaggttgcagtgagctgagatagcaccactgcacttcagcttggccgacagagcaagactctgtctcaaaaaaaaaaaaaaaaaaaaaaggccaggcacagtggctcacaccggtaatcccagcactttgggaggccaaggcaggtggatcatgaggtcaagagttcaagaccaccctggccaacatggtgaaaccccgtctctactaaaaatacataaattagccaggcgtggtggcagacaaaacaaaacaaaaaacaaaacaagacaaaaaaaacctctgtgccatacattttctcatccaaaaaaggaaacctgcctatgctgtctcgcatgatcaaataactggctatccttgaaggcattgtgtaaaacttaactacactgcattaagtaacaccagaccttaacaatagctaatatttactggatatagggttctttttttttttttttgagacgaagcctcgctctgtcacccaggctggagtgcagtgactcaatcttggctcactgcaacctcggcctcctgggttcaagcaattctcctgcctcagcctcctgagtagctgggattacaggcatgcgccaccacacccggctaatttttgtatttttagcagagatggggtttcaccatattagccaggctattgtcgaactcctgatctcaagtgatccacttgcctcagcctcccaaagtgctgggattacaggtgtaagccaccatgcctggcccctactgggtacagagttctaatcacaagtcagagactaagatttagatagattatcaaattctctcaatagcccttaaagattgatactattattatccctatattacagttgagaaaacagatttcgaactgttaggtaacttgtccaaagtcccagaacaagaaaagtggtagagcctgaatcagaacacaggttttctgactctagagaatccacattataaccactgtattacagtgctttcaaaatgcagatttaactaaattaaaatatcataatataaacttcttctttttttttttttgagatggaatctcactcttgtcacccaggctagagtgcaatgggacgatctcggctcactgcaacctccacctcccaggttcaagctattctcctgcctcagcctcccaagtagctgggattacaggcgcccaccaccatgcccagctaatttttgcacttttaatagagatagggttttgccatgttggccaggttggtcttgaactcctgatttcgtgatctgctcacctcagcctcccaaagtgctgggattacaggcatgaaccaccacgcccagactaatatcataatatgaacttctaaagagaagacagatggtggtattgcttttttgttttaatttttgtttttgttttttcctttagagacaaggggaaatttttttttttttttttttgagacagagtcttgctctgtcacccaggctggagtgcaggggcgcgatcttggctcactgcaagctctgccaccagggttcacgccattctcctgcctcagcctcccgagtagctgggactacaggcgcccgccaccacgcccggctaattttttgtatttttaatagagacggggtttcaccgtgttagccagaatggtctcgatctcctgaccttgtgatccgcccgcctcagcctcccaaagtactgggattataggcatgagccaccacacccagccaaaaatttcaaaaaaagaaaaatagaaacagggtctccctctgtaaccaaggctggagtgcagtggggcaatcatagtccactgtaatttcaaactcctgggctcaagcaatcctcccatctcagcctcccaaagtgctgggattaacaggtgtgagccaccacacccagccagatgctggtgttttttaaagaaatccttaaaagtgagataatatgaattatgcaattaattataaattattccaatttcatttttttttctttgagacaaggtctcactctgtaactcaggctggattacagtggtgaggacatggctcactgcagtcttgacctcccaggtgcaagtgatcctcctgcctcagcctcctgagtagttgggactacaggggtggaccaccacacttggctaatttctgtattttttgtagagacgaggtttcaccatgttgcccaagctggtctcttaactcctcagttcaagcgatctgcctacctcagcctcccaaaatgctgggattacaggtgtaagccaccacatctggctaatttcaaatttaaaaagggaacaatctgaagagactagcacaatcgaaaagcattcttgagtacagatgttaaaaggccactcacaaacacgtacaaaaaacagaaggcatagttaaaaaaaagagtggtggctctaacctaaaagaaaagtaacagcccataatgaggcaaggcttgttaataaagctaaggataacaagaagggttttgtgagaactgtctagaccttggaaggctggggcggaaggattgcttgagaccacgggttcaaaaccagcctaagcaacatggcaagccctcgtctctactaaaattaaaaaattagccaggtgtggtaaagcatgcctatagtcccagctactcgggaggctgaggtgggaggattgcttaagcatgggaagttaaggctgcagtgagccatgactgcatccctgtactcttgcctgagtgaccgagtaagacccttgtctacccccacccccaccaaaaaaaaaactgtcttgataaactcctttttccgtttctctatcaagtacaatgttcagtttgaagtgggaaaaaataagccctgtaaatagagagaaatgaatttcaaaacagcagagaccctaacaatctgacaatcctgagaactccaaggcagcctgataaacccctgtggtagttttttttttttttttgagacagagtcttgcttcttcacccaggctggagtgcaatggcgctatctcggctcactgcaacctccacctcccggattcaagcgattctcctgccttagcctcccgagtagctgggattacaggcacccgccactacatccagctgatttttgtactttcagtagagacggggtttcaccatgttggccaggctagtctcgaactcctgacctcaggtgatccacctgccttggcctcccaaagtgctgggattacaggcgtgagccaccatgcccaaccagtggggtcaattttaaaggacataaaaaataaaaagattggctgggtgcagtggctcacgcctgtaatcccagcactttgggaggccgaggtggacggatcatttgaggtcaggagttccagaccagcctgtccaacatggtgaaaccccatctttactaaaaacacaaaattagctgggtgtagtggcgcatgcctgtaatcccaactattagggaggcagaggcaggagaatcgcttgaacccgggagaaggttgcagtgagccaagatcgcaccactgcactccaacctgggcaaaaagagtgaaactccatcttggaaaataaataaataataaaaataaaaagtttttttttcttttttgttgagcagggtctcactgtgttggccaggctgctcttgaactaggctcaagcgatcttccttctttggccacccaaagtgttgggattacaggcatgagtcaatgtgcctggccaaaaattaaaagattttaaaggaaaagcctggaaggagagagacaaacagaccaatgtttactgagtgcttatagtgtgctgggccatgaggcaagtactttacatccatgttttattcaacctttccaacaggcccatttgtagatattaagacttttaaaaaaatttttttcagacatgaaatctcactgttgcccaggctgaacttgaattcctgagatcaagggatcctcctgcctcaggctccagtgtagctgggactacaggcatgcaccaaccaccctgccgagggctgttaagacattttaaatatgaggaaatgaaggcccagagaagttaggacttcaccaagtcacattgcttcccatgatacaaccaagattgcaaaaccaagtctgactctaaaacccacgctctttttctttttgaaacggagtctcgctctgtcacccatactggagtgcagtgccacaatctcagctcactgaaacctctgcctcccaggtgggttcaagtgattctcctgcctctgcctcccaaatagctgggactacaggcatgtgccacaaagcccagctaatttttctatttttagtaaagagggggtttcactatgttggacaggctggtcaccccatgcatgctctttccattaatttactctgtatctgtctctggcctagtcccattgatggcaatgagcacattacagaggcgtagcatcccaaacaaggaggcttactagacctcatctgtaatatagacagtccccaatttatgatggtctgacttacaattttttgactttagccaggcatggtggctcatacttgtaatctcagcactttgagaggctgaggtgggcagatcacttgaggtcaggagttttgagaccagcctgaacaacatggtgaaaccccgtctccactaaaaatacaaaaattagctgggcatggtggtgcacgcctgtagtcccagttacttgggaggctgaggcagaagaattgctggaaactgcctgggaggtggaggttacagtgagctgagatttcaccattgcactccagcccgggtgacagagtgagactccatctcaaaaaaaaaaaagaaaaaagaaaaaagaaaaaaaaatttgttttgacttaacaatggtacaaaagtgataagcactgccgggcacggcggctcacgtctgtaattccagcactttgggaggccgaggtgggtggatcacctgaggtcgggagttcgagaccagcctgaccaacatagagaaaccccatctctactaaaaaaaaaaaaagtagaaaattaacggggcatggtggcgcatgcctgtattcccagctactcgggaggctgaggcagtagaatcacttgaacccaggaggcggaggttgcggtgagccaagatcacaccattgtactgtagcctgggcaacaagagggaaactccgtctcaaaaaaacaaaacaaaacaaaacaaaaaaacagtgataagcattcagtagaaactgtactttgaacacccatacaaccattttgtttttcactttcagtattcaataaattacatgagatactcaatgctttattataaaatcacctttatgttaaatgatcttgcttaattctaggctaatgtaagtgctctgagcatgtttgcggctcagatatgagctgaacatcataggataagctatgctcagtaggttaggtgtattaaatgcattttcaacttatgatattttcaacttacgatgggtctattgggacataaccccacagtaagtcaaaaagcacctaggctgtcttcagttctgagtgctgaactttaagagagtcaccggcaaactagatatggtcccataaaagatttagataagggcactgggtcatgctgaccatacagaaggagggcctttagctaagagaacaaatatatggtaaaaatagaacacaaatccaaaagatcaaaactggatggtgcaatgggctagaatggtactaaaaagcaacggcctttagagtcagacagccaagggtttgtattccagattctatcactcactgtttagaatccaggcaagttacttaacttctctgaaccttaatttcgacatttataaaacgggggtaatactacacaaaattgcaagaggggagaaaaggtaatatttgtaaaattcttgggacataagactcaacaaatggtagtgcacattaaatctaacaaaatgaaatttaaggatatgtgcaagtaaatcaattttagaagcaccagatgaaacttaacaggagtacataagaaaagaattaaagatcttagtagacttgaatctgtgaatcaacagcttgctaagactgccaaaaattattgtgaatttggagaccattacagaagcacagtgtccaaaacaaggagtcctatcagacttcattcatgatactgtctttagtcctgagtgctaaactttaagagggtcaccggcaaattagaatcaatccaggacagatgagaaaagttagtagctctgaaaacacagtaacttgcctcttcttcctggctctatattccctccactccatccaaccaaagctacctgacaactgcttctatctctatgccccagtaacacattcatgctcatatatccccccacaacatattcacgtccctcaattttgccccagttccaaagccccaaatggatctgacagagtgacttgttcacttctagtccaaaaatctaggatgaggcatgtgagacttgctgctaatctggccctgacctgcagattatacttgatgctaatctgcaccaaatctaactggcccctgcattcttcctgaggctgagacccaaccctgtaccctgggtaactgaattaatcctgagtctgagtcacatactcaagaaagtaggactcttcctgaatgtctccttgacccacagctccattactcccttaaagggatgaagctggtcagaagtatacaattagacaatgtcagtcatctcagccatttcaaacctgctagaccaatactttctttcttttttttttttttttttgattttttttaagacagaatcttgctctgtcacccaggctggagtattgcagtggcacaatcatgggtcactgcagcctcaaccttacaggctcaaatgatcctcccacctcagcctcccaagtagctgggactacaggagtatgccaccatgcccggctgaaaaaagaaaaaaaaatttttttttttgaaatagaatttcgctcttattgcccaggctggagtgcaatggtgcaatcttggctcaccacaacttctgcctcccgggttcaagcgattcttctgtctcagcctcccaagtagctgggattacaggcatgcaccaccacgcccggctaattttgtatttttagtagagacagggtttctccatgttggtcaggctggtctcaaactcccgacctcaggtgatccgcccgcctcagccttcccaagtgccagaattacaggcgtgagccaccacgcctggcctttaaaatttttttgtagaggcagggtctccccatgttgcccaggctggtctcaaactcctggactcaagtgattttcccacctcagcctcctaaagtgctggaattacatgtttgagccaccatgcccggcctagatcaatactttcaaatccaaaaaggccctcagataaactcaggaacaaacgtatatattctcacaaaatggtacaagttgatcagcttattgtacctaagagactatttgcaaacctacaaagaatgaagtcttaaatagctgcctgtaatctggatgtcctcactgcagtgaggcatcagctccccagcagaacccagacagtaaaatctgttaactcacatgtccagactctcagggcaactaacactggagtaacatgagcttccccctatggaatggtcttgtcaaaactggcaggttttcctggctgaatcagaacagcctgggtcttgtttcattcaatactcccttggaagccaagcatctctctagggaatgccatctgcagtggacatcaggtatctcaatgccctctttgcaaccatgcaaatatcctggttccatttctatatctcaagagactctgctctttcttcagatgagaaaaatcatgataaatgctagtctttgagaagtctgccttgctgttcctcttccagggaacagttcagttctagtccagaaccaaatgattcctggagctttcatccagttcagactgcttctatacctagttccagagccaatttataaattcaagacttcccttcctcaactgtacctgaatgtctaaattcacttctagatgtttccttgatcaacaacagcaccctagatattctctggatcactggttgtcagactttgagtatgcatttagagacgttaaaatacatattactggatcccacctcggagtttctgattcagcaggcctagggcaggacttgaaaatgtgcatttttgttttttatttacttttcattttattattattattattattatttttgagacagtcctcgctctgtcacccaggctggagtgcagtggtgtgatctcagttcactgcaacctccacttcccaggttcaagcaattcttgggcttcagcctcctgagtagctgggattacaggcgtgcaccaccatgcccagataatttatgtattttttgtagagatggggtttcgccatattggccaggctggtctcgaactactggcctcaagtaatccacccacctcggcttcccaaagtagtgggattacagttataagccactgcgcccggccaaaattttgcatttttaacaagctcccaagggatgctgatggtggtggtcagggaaacacactttaagaaccactgctctagccaggtgcagtagcctacacctataatcctagcactttgggaggctgaggcaggatgatcccttgagcccaggaaatggaggtggcagtgagctatgactgcaccacttcattccagcctcgatgacaaacaaagcgagacccccgtctcaaaaaaaaaaaaaaaaaaaaaaagagagagaggcactactctagatcaacaattttttttttctgtcgcccaggctggagtgcagtggcacaacctcggctcagtgcaacctccacctcccacgttcaagcaattctctgcctcagcctcccgagtagctgggattacaggcgcccaccaccacgcttggctaatttttgtatttttagtagagacggggtttcaccatgttggccaggctggtctcgaactcctgacctcgtgatcccccctgcctcggcctcccaaagtgttgggattacaggtgtgagccactgcaccggccttttttttaattattattttattattattattttgagacagggtctcgctctgtcacccaggctggagcgtagtggcacaatctcggctcactgcaacctccgcctcccaggttcaagcaagtctctgcctcagccttctgagtagctgggattacaggcatgtgccaccacacctggctagtttttgtatttttttgtagagacagagttttgccatattgcccaggctggtctcaaactcctgagctcaagtgatccacctgcttcagtctcccaaagtgctgggattcaggtgtgagccaccacacctggccgcattttctttattgtggtaaaatatacctaacaatatttatcatttttactattcctaaatatgcaattcagttgcattaaataaattcacattgctgtgtaactagcacctttctataacccaaaattgttttatcatacccagcaaaaactctgtacccattaaacaataattcccccttcccaactttccacagcctctggtattctactttctgtccctatgaatgtacctattgtaggtacctcaaacaagtggaatcacaacagttgtcctcctgtgtctggcttatttcatgaagccgaatgtttccaaggtccatcatggtatatagcatatatcaagactgccttccttttaaggccgagtaatattccattatatgtatatacaccattttgtttattcttctgttgatggacacttgggttgttccacctttggctattgagaatagtgctgctgatcagacgcagtggctaatgcctgtaatcccagcactttgggaggttgaagtgggcagatcacctgaggtcaggagttcgagaccagcctggccaacatggtgaaaccccgtctctactaaaaatacaaaaattagctgggtgtggtagcgcatgcctttagtcccagctacttgggagtctgaggcaagagaatctcttgaacctgggaggcggaggttgtagagggctgagatcacaccattgcactccagcctggtcgacagaatgggactctgtctcaaaaaaaaaaacacaaaaaaacaaaaaagagaatagtgctgctatgacatgggtgcacaagtatctctttgaggctctgtttcaattcttttatatacttaggagtgaaatttctgggtaatatggtagttctacctttaatctttagagaaactgccaaagtgttttccacagtggctgtaccattttatattcctaacagcaatgccaacacttgtttcccattttgttttgttttacttctaaccatcctggtaggtagggcttagctattattattatcacaagttttgatatgggcttttaccaatacttgtagcactgtaaagatagcatgacaacatgagaggttctgactattttccagcttcaaatggtttagcagttccattcaaaagacaagttttcacgattgcttctaattttcttgaaaaatcacctccaaggctagcatttacctagcttcaggttgactaagaaagaaaatgggctgggcgcggtggcacacacctgtaatcctagcactttgggaggccaaggtgggtggatcaccagaggtcaggagttcaagaccagcctggccaacatgccaaaacctcatctgtactaaaaatacaaaaattgaccaggcgcagtcgctcacacctgtaatcccagcactttggcaggccaaggcaggcggatcacgaggtcgagaaatcaagaccatcctggccaacatggtaaaacactgtctctactaaaaatacaaaaattagctgggcgtggttgcttgcacctgtagtgccagctactcaggagcctgaggcaggagaactgcttgaacccaggaggcggaggctgcagtgagccgagattgcgccactgcactccagcctggcaacagagtgagactccatctcaaaaaaaaaagaaaaaatagaaatacaaaaattagctgggcgtggtggcacacgcctgtaatcccagctactcggaaggctgaggcacgagaactgcttgaacctgggaggcggaggttgcagtgagccaagactgcaccactgcactccagcctgggtgacaagagtgagactctccctctccctctccccctccccctctccccacggtctcccgatccctctcttgccacggtctccctctgacgccgagccgaagctggactgtactgctgccatctctgctcactgcaacctccctgcctgattctcctgcctcagcctgccgagtgcctgcgactgcaggcgcgcgccgccacacctgactggtttttgtatttttttggtggagacggggtttcgctgtgttggccgggctggtctccagctcctaaccgcgagtgatctgccagcctcggcctcccaaggtgccgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccacccatcgtctgggatgtgaggatcccctctgcccggctgccaggtctgggaagtgaggagcacctcttcccggccgccatcccgtctaggaagtgaggagcgtctctgcccagccgcccatcgtctgagatgtggggagcgcctctgccccgccgccccgtctgggatgtgaggagcgcctctgcccggccgccccgtctaagtgaggagcccctccgcccggcagccgccccgtctaagaagtgaggatcccctctgcccggccaccaccccgtctgggaggtgtacccaacagctcattgagaacgggccatgacgacgatggcggttttgtcgagtagaaaagggggaaatgtggggaaaagatagagaaatcagactgttgctgtgtctgtgtagaaagaagtagacatgggagactccattttgttctgtgctgggaggaattcttctgccttgggatgctgttgatctgtgaccttgcccccagcccgatgctctctgaaacatgtgctgtgtccactcagcgttagatggattaagggcggtgcaagatgtgctttgttgaacagatgcttgagggcagcatgcttgttaagagtcatcaaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatggtcaacaaaaaaaaaaaaaaaaagaagaaagaaaatatttggggtggctgaagaaaagaaaaaaatgaatatttttttctttttaaaaactttctcactgggcacgatggctcatgcttgtaatcccggcactttgggaggccaaggtgggcagatcatttgaggtcaggagttcaagaccagcctggccaacatggtgaaaccccatctctactaaaaatacagaaattagctgggcatggtggcatgtgcctgtaatcccagctactcaggaggctgaggcaggagaattgcttgaatctgggaggcggaggttgcagtgagctgagatagtgccactgcactccagcctgggcaacagagcaagactccatctcaaaaaaaaaaaaaaaaatttatctgataacttaattccataataacgttgttttacccataaacaaaatggcacacactggcattcagtttccggaaatgtctaatggtttctctagagcatttagaaattaatctagaaaggttatttttgaaaacaaaagtatgtggaaaatcttgtatattttaatcttgctggctacaccacttctaagtccctaacctagccagaaataccattttttcttcatttttggggttttcaaggcatggaagagctagagcctccttagtgaggcaaatggtcattcccaaataaaactgtttaattgtcctcatatattacatttaagtcttcaggcctttctctcagtaactcttttccttcatgattccaagaaaaaaatcaggaaaatatagaaagtataaaagagcagtaaaaataacttcctggctgggtgcagaggctcacacctgtaatcctagcactctgggaggccaaaagaggaggattgcttgagcccaggagcacgagaccagcctgggcaacacagtgagacacccatctatattttgttgctgttgttgttaattactttaaagccaggcgcggtggctcacacctgtaatcccagcactttgggaggccaaggcaggtggatcacaaggtcaggagttcaagaccagcctgaccaacatggtgaaacgccgtctctactaaaaatacaaaaagtagccaggcatggtggctcgtgcctgtaatcccagctactcaggaggctgagacaggagaatcgcttgaactcaggagtctgaggttgcagtgagctgagatcacaccactgcactccagcctgggtgacagagtgagagtaaaaaaaaaaaattactttaaaaagccaggcatggcggcccatgcctgtaatctcagcactttggaggccgaggcaagtggatcacttgaggtcaggagttcaagaccagcctgaccaacatggtgaaaccttatctatattaaaaatacaaaattagcccggcacggtggcgcatgcctgtaatcccagctacttgggaggctgaggcaggagaatcgcttaaacccaggcgatggaggttgcagtaagctgagatcacaccactgtgctccagcctgggcaacaagaacaaaactccatctcaaaaaaaaaaaattacttaaaaaagaattccgttttttggaaaattttcttcctcaactttcttacatttgacccaagttgaaaaaaaatctagcttaaaaacagaaaaggaaaaaaaaaaatgggcaaaacgaaagtatcatggaaaaacaatttcaaaagctgttgtcccagatattgataggcaagtatatgaaatatactttcccattatactcactgtggtacttgagagattaaactgtatatatataagactgtggctccagctggagtgcagtggcatgaccatggttcattgcaaccttaaactcctgggctcaagtgatcttcccacatcagccaacaacagatatgtgccaccatgcccggctaatttattttttattttattttttattacttttatttgagaaagagtttcgcttttgttgtccaggctggagtgcaatgacacgatctcggctcaccacaatctctgcctcctggattcaagagattctcctgcctcagcctcccaagtagctgggattacaggcatgtgccaccatgccaggctaattttgtatgtttagtgagatggggtttctccatgttggtcaggctggtctcgaactcccaacctcaggtaatccacccacctcagcagcccaaagtgctggcattacaggtgtgagccaccgcacccagctaatttattattattattattacttgtgtagacatggggtcttgctgtgttgcccaggttggtctcaaactcctggcctcagatgatcctctcgccttggcttcccacagtactgggattacaggcatgacccactgcgcctggccaagatggattttcataaaggcaaagagcagaccttctattctgagagctacagccagaggcttatatgaactccccaacttcattaacctcattaaatcatataatttctgtcatacgtaaatgtacattaaacagtgacatcttggaacaataaataactgggaacaatgtagccacacctctacagggaaacttgtgagtggctgaaaccaggaatgttgaacccacaaatgtccagggagagctatctctggggtgtgtgtgtcatacacgaacatacatggttaaaggcagaggaagtgcactggagacagcagttaaccagaagagtgagtctcagcgcttctactgaaagcctctgaatatcatccctatatcttaaagacaatcatcctaggccgggcgcggtggctcacgcctgtaatcccaacgctttgggaggccgaggcgggtggatcacgaggtcaggagatcgagaccatcctggctaacacggtgaaaccccatctctactaaaaaatacaaaaaattagccgggtgtggtggcgggcgcccgtagtcccagctactcgggaggctgaggcaggagaatggcgtgaactgcactccagcctggatgacagagcgagactcgtttcaaaaaaaaaaaaaaaaaaaaaaaaagacaatcatcctaagcaaaacaatacctgcttcgtaggctatgtgaagaataaacaatttcaaaaaagtttcactcattctttagcaaacatattttagtttgttttctgtttttctttccatcttttattttaggttcagggggtacatgtgcaggtttattacataggtaaattgtgtgtcacagggtttggtgtacagattattttgttacccaggtaataagcatagtacacaatagacagctttttgatcctcgccctcctcccactctccacactcaagtaggcccaggtgtctattgttcccttctttgtgttcatgtgtacttaatgtttagattccacttataagtgataatgtatggcattttttttctcttttctttttgagatggagtctcactctgctgcccagtctagagtgcagtggtgtaatctcggctcactgcaacctctgcctcccgggttcaagcaattctcctgcctcagcctcccaagtagctgggattacaggcacctgccaccatgcccagctaactttggtatttttagtagagaaagggttttgcatcttagccaggttagtctcaaactcttgacctcaagggatccatctgcctcagcctcccaaagtgctgggattacaggcgtgagcccacacccctggctggtatttggttttctgttcttgcattagtttgcttagcataatggtctccaactctatccttgctgagaaagatatgatcttttttatggctcggtagtattccatggttggtgtatatgtaccacattttctttatgcagtcaactgctgatgggcactaaggttgattctatgtgtcagcaaacatattttgaaccctccaaaatatactaagaattcagaagttcgagtccctgtcctcattgcacgtaacaagtcctcctccttgacaggtactctatagtttaataactgccttcaaagaactagaaagcaattcctcaaggatagagagctccaaccttgctatacaaggacctggcacataccaacagataattcaaatatagtttgaatgaacaaactatatttctgcttatgatctaaaaaaaatcctcagttgacattaacacgataaagaattgataaaaaataacactgtgtggtgattatcaggggaacagagacacttcagggcaacactcagaaacatttggaggtatacatgtactgaaacatcacaatatgtataattattatgtacattatgtctttttttttttttaatagagataaggtctcactttgtcacccaggctggagtgcagcagcaaaatcatagctttgtaaactttgtaacctcaaattcctgggctcaatcgatcctcctgcctcagcctcccaaagtgttggaattacaggcttaagctaccatgcctggccaaaaacaataattttaaaaaagagaaacacttgaaggggaaaaataaaaatgacaccacattggccaggtgcggtggctcacgcctgtaatcccagcacttctggaggctgaggcgggtagatcaggaggtcagaagattgagaccatcctggctaacacagtgaaaccccgtctctactaaaaatacaaaaaaaattagccaggcgtggtagcgggcgcctgtagtcccagctactcgggaggctgaggcaggagaatggcgtgaacccgggaggcggagcttgcagtgagccagaatcgcgccactgactccagcctggccgacagagtgagactacgtctcaaaaaaaaaaaaaaaaatatgacaccacattatcatgccatggcaaagctcagtagtgttctctcatgtaaaatccctccatctggagtgcagtggctcatgcctgtattctaacactttgggagggcaaggtaggaggatcccttgaggcaaggaatttgagaacagcctgggcaacacaacaagaccctctctctattaaaaataaatacataaaaataaattttggctgggcacggtggctcacgactgtaatcccggcactttgggagcctgaggcgggcagatcacgaggtcaggagttcgagaccagcctgaccaacatggtgaaaccccgtctctactaaaaatacaaaaattagctggcgtggtggcacgtgcctgtaatcccagctactcaggagactaaggcaggagaactgcttgaacccgggaggcagaggttgcagtgagccgagattctaccactgcactccagcctgggcgacagaaaaagactccgtctcaaaaaatatataataataataataataataataataataataataataattttttaaaagctaaataaaatccctccacctctgaaaacccctgcaaagggtgtggaaatggctcattttacccctatgatggttatgctataaaacaattggttttagactagagcttttcagtatgagaagtcaattgctgaaatcagtatttggtgacacatattttcataaacactaaatgtgttgagcaaagacctatctttaactttaaagtgaaaacttcaaactgttcctaactacaaaatttttcagagataaaccatggtttctcaactctggcactactgacattttgaccagataattctctgctgtagggagctgtcctatgcattagaggatgtttagcagcattcctgacctctatccactagatgccagtaccacctcccacagtcatgacaactaaagaaatttctagatattgacaaatgttctggggggaggatcatactgatagggaaccagagataaacaatggaatgataattttcttcataaaggctgtttaaataagatatggaagataatacaaactatcattctttgcactcatttgcgaatcatttttaggtcatcagatgaccttttaatattttatctgaaaagcagcagcagaagcagaccaccaccaccagtgcacctaaaggtaatgtgtaacctagaaagaagaaatgaaccaatgaaccaatggatgatgcaaaaagtcttaacagtaaaaaatgagctaaggtagcctcagtactctgctatgtatattactcatgcatggtaactgttagaattcttaggctatcttgaaatcttttatttcaatgctacaaagtcagactcttcatttttcttcctattcttatctgaaaaagaaaagtttcctgtatcacagagatcaagaatacttaccactatttattgagcattttgtaaatacaagggattttacttaattaagcagatctccaaaaaacttaaggaaataagacaaaacagattcaggaacgttaaataaaacaccgagagccacaaaggaagctgagggattcctgagatctaccaaagggtcatcaccatcacatcccaaaaggcctaggttttacttataaatcttctagtttataaaaaggccagatttgcaataatattaaaaactgagatctcagcatttaatagcataatcttaaacgtgtaaagaacacatagtacttttcagaaagtgttatttttcattataaaagaaacgtaagtggcgggacacagtggctcatgcctgtaatcctagcactttgggaggccgaggtgggcagatgacctgaggtcaggagtttgagaccagcttggccaaaatggcaaaaccccatctctactaaaaatttaaaaattagctgggcatggtggcaggcacctgtagtcccagctacttgggaggctgagacagaattgcttgaagccaggaggcggaggttgcagtgagctgagatcgcaccactgcactccagcctgggcgacagagtctcactctgtctcaaaaaaaaaaaaagaaagaaacatatgggctgggcacagtggttcatgcctataatcttagcattttgggaggctgaagcggaaggatagcttgagctcaggaatttcagaccagcctgggcaacatagtgaggtcctatctctattaatgagaaaaaaaaattagctggatgtgatgacacgggcctgtggtcccagctactcaggaggctgaagtgggagcatcgcttgagcctgggaggtcaaggctgcagtcagccataactgtgccaccacattccagcctcggcaacagaaacatatgatcattgtagatcatctaaatagcccattttttttctttttttttttttttcagatgcaatctcactctgtcgcccaggctggagtgcagtggcgtgatctcggctcactgcaacctccacctctcatgttcaagtgattctcctgcctcaacctctggagtagctgcaattacaggcgtacaccaccatgcctggctaatttctttgtatttttagtagagacggggttttgccatgttggccaggctggtcttgaactcctgacctcaggtgatccgactgccttggcctcccaaagtgctgggattacaggcgtgagtcaccgcgcccagccttaaatagcccattttttaaaagattggttgtaataatgatgtatataatgaatatcatcatattatcataatgacgtgtatctgtaataatgattcacatcaaaacaaatgcaaaggtaaagattagctaggtgttcaagcaatgaacaagtaactaatggatgaacatccccaaacacttcagtcctaaagtcacagatgacttttttagaacctgcccagaaattactgtagaaataaattctggcttcagaataattcaataaacttacctgtgctacctacactgaaaaaagtgacaagtactgtgccggtatgttgtggatggatttggtatttcagaggaaactggtacatactacagaaacggcctttcccaaaggaaaaatgaaatgctgccaggcgcggtggctcacgcctgtaatcccagcactttgggaggccgaggtgggtggatcacaaggtcaggagatcaataccgtcctgactaacacggtgaaaccctgtctctattaaaaatacaaaaaattagccgggcgtggtggcaggcgcctgtagtcccagctactcaggagactgaggcaagagaatggcattaacccgggaggtggagcttgcagtgagccgagattgtgccactgcactccagcctgggcgacacagcgagactccgtctcaaaaaaaaaaaaaaagaaaacaaaaactgaaatgcttatctcagaagcataaattaaagagaaaaatcatctctaatctactgtttcggtcttaccattttatagtttggacctaagagatcagcaatccttaataaataaggtttcccatgagttctggagcttctctgcctcctgttcgcaccctccatgtccatgtttaacaacctaatgccagccaggtgcagtggctcatggctgtaatcccagcactttgggaggccgaggctggaggatcacttgagcctaggagtttaagaccagcctgggcaacagaacgagaccctgtctctacaacaaataaaaaataaaaaatctaactgggcatggtggtgtggtggtgcacgcttttagtcccagcttcttgggaggctgaggtaggaggattccttgggccagggaggtcaaggcttcagcaagccatgatcatgccactgcactccagtctgggtgacagagtgagaccttgtctcaaaaaaaaaaaaaaaaacaaaacaaaaaaaaaacaacctaatgctggatggacacagtggctcatgtctgtaatcctagcactttgggaggccgaggctggaagactgcttgaacacaagagttcgggaccagcctaggcaagaaagcaatacccccatctctttagaaaaaaaaaaaaatgtgccaggcatggtggtacatgcttgtagttccagccactatagaggctgaggaaggaggaccacttgggaccaggagtttcaggctgcagcgagctaggatcaagccactgcacttcagcctgggcaacagaacaagaccctgtctcttactaaaaaaattttaaaaagtgaaccaaacgcttaagaagctaactcggttaggttcctaaggggccttttcaaaatcagatataaaagggctgatgccaggccctccagcactgagaagtgtaggctaaactaccttttctaggaacatcttcccttattctagaagaataggaatagaaaacagtggttattttagtggtcaggaagagcaaccaagatctcgcatggaggtgtgcttagggggaaaatgttaaaataattgattaggaaaaagaaagtacgagaattgtctgatataccaaggcaggatggtagacagaagcagtgaaatggctgatattacactagaggttgtatctgaacaaataatcagggttaggttctatgacttctaatcttggcactgcaatggaccagccacactgccgtaaaatggggcttaatatttagaaaataaagtttaagtactccaaaattactatgtcttttccaagacaataaaggcataaaagtcagaaaatgaaactaaaatatactcacaatgagtcttaacttttacctctttaaaacagtttagctcctggccaggcatggtggctcacgcctgtaatcccagcactttgagaggccgaggcgggctgatcacctgaggtcaggagttcaagagcagcctggccaataagctgaaaccccatctctacaaaaaatacaaaaattagctgggcgtggtggcgggcacctgtaatcccagctacttgggaggctgaggctggaaaatcgcttgaacccaggaggcggaggttgcagtgagcggagatagtgacaagagtgaaactccatctcaaaaaaaaaaaaaaaaaaacagttcagctcctttctaaaggagggtcttttcaattcattcataagtactaggttgggttccttagagaaaacctccaggccacttaatattcacaaaactaaagtccaagacccttgtgctcagaattttttttttgagatggattctcgctttgtcaccaggctggagggcagtggcgcgatctcagctcacagcaacccctgcctcccggttcaagcaattctcctgcctcagcctcccgagtagctgggactacaggtgagcgccaccactcccagctaatttttgtatctttactagagacgggatttcatcatgttggccaggatggtcttgatctcttgaccttgtgatccacccgcctcggcctcccaaagtgctgggattacaggcatgagccacaccacacccaaccagaaatttttaatacagcaaaattctcacatccaaatgaggttttacctaattgttacttacagtatcataaactatcagcaataatgaaaataataagagttcttcacctttccttccttctttgtctctgtagaagacctcaatttaacatcataaatcatttggtccttgacgtatggtaacttccagggagacagatgacatttagcacaggacatgtaagactgtgggaaaagggaagttcttggccgcaagaaatgggacaaaacccttgcctttgggaaaaatgccaaagatctctgaagtccacgctaaagcagttaaatttttagctttaaaagattccattacaaaaatccaaaccagactgggcacagtggctcatgcctgtaatcccaacactttgggaggccgaggcaggaggattgcttgagcttaggagttcgtgaccagcctgggcaacatggtaaaacccccctctacaaaaaatataacaaattagtcatgtgtggtagcatgcctgtagtcccaggaacccgggaggcgaggtggaaggatcacttgatcctgggaggctgggaggtcgaggctgcaatgagttatgatcatgccactgcattccagcctgggtgacagagtaagatcctgtctccaaaaaaaaaagcaaaaaccacaccatacaattagaataggcttttaaaaactacactataaaaatgcaagataataattttctggaattcataagaacctgtactaggtgatggtccccagggtggatatgaatattttttccccttgtaattggcttaagctaacatggttctaaaatttttcgctattcaaaaacgatgaggacgggcacggtagctcatgcctgtaatcccagcactctgggagaccaaggcaggttgatcacctgaggtcaggagtttgagaccagcctggccaacatggcgaaaccccgtctctactaaaaatacaaaaattagccaggtatggtggcgggcacctgtaatcccagctactagggaggctgaggcaggagaattgcttgaacccgggaggcggcggttgcagtgagccgagatcatgccactgcactctagtctaggtgacagaacaagactgtctcaaaaagaaaaaaacaaaaaacaatgatgaatatcataataatggctaacttttctgactacttattatataagcattgggctaagtgctctacatgcatctccttattaatcctcacaacattgtaaggtctaaataacataaactttaagaattttcaaaaaaagaaaaaacataaaattaaaataaaaaaagaaacaaaaataataataattttcaggctgggcgtggtggctcacgcctgtactcccagcattttgggaggccaaggtgggtagactgcttgagccctggagttcaagaccagcctgggcaacatagtgacaccttatctctattatttaaaaaatgaaataaaataaattggtggtggctcacgcttgtaatcccagcactttgggaggcagaggcaggtggatcacgaggtcaggatatagagaccatcatggccaacatggtgaaaccccatctctactaaaatataaaaattggccaggcatggtggtgcatgccagcagtcccagctgcttgggaggctgaggtaggagaatcgcttgaacacaggaggtggaggttgtgccattgtgctccagcctggtgacagagcaagactccgtctcaaaaaactaaataaaaaataaaaataaaactattaacagaaacataagtactttcgaaaactactctattatcctatcaatcatcactgggatatccatgcaaaaccaaaataccctgaacagctataattatacagaattttaatctagtgagagttctagttaagagtcttggcagggtgagatggctcacacctgtaatcccagcactttgggctgctgaggcacgtggattacctaaggtcaagagttcaagaccagcatgggcaacatggtgaaatcccatctctactaaaaatacaaaaataagccaggcgtggtggcaggtgcctgtaatcccagctactcgggaggccaaggcatgagaatcgcttgaacccaggaggcaaaggttgcagtgagctgagatcgtgccactgcccacagcctgggcaacaaagcaagactccgtctcaaaacacaataacataatgacaatgaagattaatacttatatgtagaaattgtccttcacactgccaaactgccagcccattaagaaaggcttttacggccaggcatggtggctcatgcctgtaatccgagcacttggggaggccaaggcaggctgatcacttgagatcaggagttggagaccagactagccaacatggtgaaaccccatctctactaaaaagaaaatacaaaaattagtcgggtgtgatggtgcatgcctgtagtcccagctactcgagaggctgagacaggagaatcgcttgaacccagaaggcggaggttgcagtgggctgagactgcgctccagcctgggcgacagagcgagactctgtctcaaaaaaaaagaaaaaaagaaagaaagaaaaagaaaggctttcacaagccttcttgtgcaaaagaacaagaagatataaagaaaataaaattttattgtagttgtgaccacaccttgaaatggagagttgacaactctgttttaaggaacaaatttttttcctatagtaatttcatcataatttcttgcacagagtatacagtatgtttcctctggcaatacacagctgagtaaaggttttctgtatcttttcatctgtacttttcaaactatattttaagaagcattaacaaaaccaaacacatatatcaataccaaaacccacaaaattagctattttatacccacttaggcacctaagtaaattggctaatggcttcatgggaagtaatgtagtgtaaaagaggaaacactggcagtgaaggcagaaaacctagacctgggtggaaatcatggctacatcacttgttaactatgtgaccttgggcaatttccttctctcagtctgagttttcttatttgcaaagtgagggtagtaattccaatcttgggagggacgattaattgcatgtgaaatgcccaccacagagcctgactgaaagcaggagtttagaaaagatactgttacgattgttattcatataagctccttaaaagcaaaaacatcatatttgtcctcgtagcccaattgtaggctttataattattgaggagctgaaaaacaagaaacaccaaagttacaaatgaggatttgtatccgttcaacacatgcctagacagaaaatgagactaagtaatcatgactttcaaaaactatatcaatgcatacacagcatataaatcaaagtatatattgccatttgatggggaaaaaaatcaaaatatgtaatgtgcttatttttaagccactctgaaagaagatgatgctgcctgtatacaaatcaagagtacaactactcttcattcattctgcaagtatttccgtaagtgccagtcattatgtcagtcattatgctaggcaatgtgcatatgatggggagcaaaagcgaaaataatcccaaccctcatagagcttgcttgcagtcatgtaatcacacaaataagtgttaacttgtgataagtgatgtgaatgacaggtaaatggtgctctgagaacctattaggttagaatctaatctaactgaaatcaaggaaggccttccaaggaggtgaaacctgagagctgaaggatgaagaggaggttaacaaaggggggtgtttccagatggaggaaagcagctcctgcaaagaccctgtaagcaggaggaaacaaggaaagaaggcaggactataaggccagtgtgcatggagcagagacaagtgtgagaactagctagggcctaggctgctcaagggcctagatatatagcctacattcaaaagttgcaatttgatctcaagagcaatgacaaggcctgtaatcctaaggctttgggaggctgaggcaggaggacggcttgaacccaggaggttgaggctgtaatgagccgtgattacaccactggactccagcctgggtgacaaagtgagatcctgtctccacaaaaaaaaaaaaaaaaggcaaccagaagccactaaagagttttatgaatgcttctttgcggggcaggcaggctgaggggaagatgaaatcagattttcaacaggactctggcttctggattctggaatatggatggaccaggtgggaaacaaaagtcctgtcaggataggatagtagcttcgaatagggtgatggcagtgatggtggaaggaagccaatgaattcaagagatattcaggaaaatctaacactgtattgtacacaagggcagagggacagcagtgtccaagacttctgggtttctgattcatatgactgtacagaaggagataccactcaggaggtattctgcttcagaaatatttttaaggagccaggcgcggtggctcacgcctgtaatcccagcactttgggaggctgaggtgggtgaattgcctgaggtcaggagttcgagaccagcctagctaatgtagtgaaaccccatctctactaaaaatacaaaaacttagctgggtgtggtggcgggcgcctgtaatcccagctactagggtggctgaagcaagagaattgctcgaacccgggaggcagaggttgcaatgagccaagatcacgccattgcattccagcctgggcaacaagagcaaaactctgtctcaaaaaaaaaaaaaaaaaaagaaagaaagaaaagaaatatctttttttttttttttttttgagacagaggagacggagtctcgctctgtcggcgggatctcggctcactgcaagctccgcctcccgggttcacgccattctcctgcctcagcctcccgagtagctgggactacaggcgcccgccacgacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccgaaaagaaatatctttaaggctgttcacacaggccaaaaagggcctaactgcactacacttttgcatgaaaatgtgtaaaccgaatttgatcccctactttaaataaggctctaaaagattttttgctatttacagaaatcaaactgactctcaaaagtacaaggattttcctacactgaagaaatttcaaagattctgccacaagcttctaaatcaactccaaataaatgttaaattggtttgagcaatagggcagcattacggagtgaatgtgtcagttcccatgaggaccactttgataaggctaacacttatgtactgctgtttaattttaatattttaaataaatcttaagagtacccttggctgggcgcggtggttcacgcctgtaatcccagcactttgggaggccaaggcgggtggatcatgaggtcaggagatcgagaccatcctggctaacatggggaaaccccgtctctactaaaaatatgaaaaattagccaggcgtggtggcgggcgcctgtagtcccagctactcgggaggctgagacagaagaatggcatgaacccaggaggtggagcttgcagtgagccgagattgcgccactgcactccagcctgggcaacagagcaagactccatctcaaaaaaaaaaaaaaaaaaaaaaagagtactcttggctgggcacagcggcccaggcctgtaatcccagcattttgggaggccaaggcgggtggatcacgaggtcaagaaatcgagaccatcctccaacatggtgaaaccccgtctctagtaaaaatacaaaacttagctgggcatggtggcacgcacgcctgaagtcacagctacttgggaggctgaggcaggagaatcgcttgaatcagggaggcagagtttgcagtgagccgagatcacaacgctacacttcagcctggcaacagagcaagactcagttaaaaaacaaaagggtacttctggctgtgtgcagtggctcacacctgtgatcccaacactttgggaggccaaggcgggtggatcacctgaggccaggagtatgatgagactagcctggccaacacggtgaaaccccatctctactaaaaatacaaaaattagctgggcatggtgggtacctgtaatcccagatactcaggaggctgaggcaggagaatcgcttgaacccggcagatggaggttgcagtgagccgagatcacgccattgtactccagtctgggcaacaaaacccaaactccggccaggcgcagtaactcacgactgtaatcccagcacttttggaggacgaggcgggcagatcatgaggtcaggagttcaagaccagcctggccaacatggtgaaaccccgcgtctactaaaaatacaaaaattagctgggcatggtggcaggcgcctgtaatcccagctgctcgggaggctgaggcaggagaatcgtttgaaccctggaggcagaggttgcagtgagccaagatcaggccactgcactccagcctagatgacagggcgaggctctgtctcaaaaaaacaaacaaacaaacaaaaaatcaaaactccatctcaaaaaaaaagagagtactcttatgtgatattaaactaaaatatggtaacattaggcattaccataattagaactatactgcttttgtttcaatattttgaaatgcttgtaaaaaaataatattttgtagaaaaaagagataagattttaaaaacacacacacacacaatctcttgactttaataaacattttgccgtttccatcctagtccttgttaatgcccatcacattcaattcagggtaaaagataaggtttttactagttaaacacatctgtatatatgtgtatgcactatgtacaaagtaaagccaataccatgtcaatactatcaatactttaatatttacttttcctggttttagttttcaaatttgcaacggatgctatttgcatagaatactgatggctttaagtcttaaaaacagaaatctgactgacccaaggaaaaggatgaaagaaagagattttgtccctttaaaatcagccaacacatcctatcttagtactgaagtacttcccaattctggcagaatgggctccttggccacctgcttgcactagggtctgactagcattttattaacatccaactgcagttaccaggacattcattaccactgcttgtacaaagcagaattctttttaaatttttttcccatacagatttcatcaccaggtgtcaaaagacaaaaccgtggcctgaggccaaatagaaaaatgtcatctccacaaataaggagaaaagacaaggactttaaaaaatcaggtcaacaagcccattagccaataatagtttgtaaaactggactgtcttcacactagaggctgtgctagcaaatgtggtccttggaaacaagagctgtagagcttgaaatgggttgccagcatggtttgcctttttcttttttcatgtttatttttattttttttatttataacatggaatcagactatgactataatcgagcatagctatggcggggtatgggcagtgccaaggaagagacagcgaaaagcccgtagggttcccagtctaagctagcagaccttcccatcttcctcaggagtggtccctgtctccgcagctggaatgtgcgggagggaaagttacaagggcccccaaaatgagacagcaaaccacttccttctgaaaactaaaggtcataggcttttaaggaacaatagagctcaatgtaagcttcagaaagatggagacagtcagatgagacgagggtagggaagcgcgggtgaggagatgcgccccgtctgggatagctgaataggggggtcaaggccagggactttaggaacacgagaagggctggatcttccataacctgcccaagtgggcctgagaaacctaagaggctcctctgaaaatctagggcatctatgcatccaatactctcagccctctcctcgggaagggagataatccccacaggaagcaccccccaaactggggcttttcctgcccttcaaaagccacaaaccctcacggaaaacatttacaagggagtggaagggccgggggcaagcagcggttctgcaaatctcgggaagaaggcccctggatccaaggaactttgcccctggaatagggggtggggtgcggagggcaccgtctgaggctggtaagcctcggcgaaagaagcggcgggaacgggagtagggtcccgtgggtcccccgacgagggggtggcggcctggggcgcggtcgccggtgagggaggcccgcgagccgggcacgggagcggggggctgcggccccgtggctgcaaagagccggcactcgggaggcagaggccggcgtaggcctcgggggcccggacacacccaacgcggcggcctcgggcccgcttacctgctcctcctccggggtcagctccggcgccatgtcgggccggggcgcggtcgcgggctccatccccccgccaccgccgccgggcggacaaaactcgctcgcgagcgcgggagcccggcgcgctcggcctccgcttccgcgtccccgcgcctcagcagcccggggccggctcgcgcatagtgtggccggcagggcccggcgcctgcagcggccgcaaacgccgcttctgcttccttaagaaaaatctctccgaactgccgctctcttccgggaggaaatccttttttatattattcgctccgttcctcacactcccccttatctcctggggaagaaaaagtgcaggcgaagagctaacagccactcgggatttaaaaggaaataggaaatcaggaacttttagagccgggagcgaagggtcggcggaaatttcccgaaggccgccgaccccctcggcgccccgcttcctcggccgcgctcccgctcctccacagcgccacagagctcggggccgcccagccgggccgtcctcgcggacgctggccctgcgacctgcgcggctgcctcagcc

SEQ ID NO: 132 - DNA, 465237 bp, Homo sapiens
gttgtagtgtagcttggttttatttatgtccacaaatatttcaaaaaaattacaaaatactcaaatggagagaacacagaagtcacgatttctgggtgtctactgtttacactgtgttatctcatggcaaactactcatatatacatttagcttcaagatatatagaaacgtagcaaatccgagtgtgcacgctgcctctgccgcagtggagtgaagctcaacctcgaggacaccgaacaagatacggacacacacagaggagccaaaccaaaccccgaacaaagggaggaaaatccgaaggaaaccgagtggttgggcttcaaagacaccatgaaggtcagggcctcctaaacaaactgtagtttatctggtgagggtttcgggtcgagggttttttagatggaagaatctcagcgcttcgccttgggatatggggagaaaagcaaagctaacaagaatgccttcggacggctttcaagcacagacctcagaggactcgactcttctttggaaaaatggatgccaaaggaggagataaagaaggtttaactgaatggtagatgttgtgttctaccaaaaagaaagaaaaaccagaagccgagaaggtgggggcctggatgcaggagtctgggagcccagcaggaagaggcctcgctcagagccacgggaacaagcctgccatgagggcctgtccccaccccagaaggaaacgaatgccttcaagccaatgtggcctgaagtcccacgacaaaaggttcatgtcagctttgcctccctgtgaacaaactaaagttaaggcagaaatggaatgagagaaaaatgaaagaaaaaaaactagaaacattttcaacagacaaaacaagcctatcccaactgaaaccaaacacggtttttaagagaaactggaaatgtcgctatttgacgccagaacctgaatttgagccagtagctgctggtttctagatcaaactatcagcatctcttcctgctccctctgcggcctgggtcctggatggactttgtgtccgccgacccagtgtggtctctgtcctacaattcttgggatgggaccagcacaatggcagaagagacctccagtgtctgagagaaaaggatcggaagaggccacgtcctggcaggaagcagggccgacagagggcagacaccccagaacacccgccctcagcctgggagaaagtgcgttacggctgcagcctggaaacgagggcaggctctctccaggacggttccgctcagaagggcctggcctcctgagaagcagcccccacacagcatgctttctgaatgcactgtgggtgggactccagttcccacttccaggatgaagagtgggactcaaatggtttaccagtgcaatgtggggtcaccatgcagacctgcccctagggtaaaatacaggctgcccccaacacctgtcttaactccaggatctcccttgctcaaaagtggcctcaatctgtggcaagaaagatggggccgtcctcaccacaagatccaagtgacaatgcgcatgagaaggcagccttctaacacatccctttggcaggcatatgtcctgggtcacttgtgtgctgagttatttgtatggaatcattttcttagatgatgaaattttcggagtattaaaaaagacattcatccagaacaatcaagtgtgtgtacacagaaatctagaaggaaatctacaatggacacaggcccatgcgctttccatcccgtggaaacagaacagtgacactggagaacagaaagtgaacattcacctcctgcactccctgtgcaaaatggaagaggtctgatggagcagatgtctgtgctgctggcagagcacaggctaggagcagacacaagtgaaacgccaggcagaaaacagagtctgtaacatcgtccctgcaaaccctggatgctcgctgctgtgaccaggcctcggtccaagcctctgtccatgtggaacgcccctttgctccctttaattaaagggataattatatataactttttattaaaaaatcaactctgtattctgtcaatagttggtaggaattcacaattagtgacatggctggaaaaaatagatcacaatagtagtttatggaagaaaaaaaggctgttctaaaattatttatttacagacgtaaaaagccatgctgcagaactttctccaattatgaagatttcctacaatgtattaaaataaaagatttttttttttaaaaattatagctcttggattccaaattcctatgcccccgatctgcaagcctcgtgggctctggagcactcgtggcggagtgtgtcagtgtgtctgcacgcacagtgaagggtgtgaactggattctagcacctactgagaaatcaaggaaaagaaaactaaagccaaaccccaagattgcagggaagctttctggatgttcagtccagtccaggactcactaagtttctgggggactgtcatgcagggagatccaaaccagtctcaggaaatcctctcgacaaacgaacactactatgtggatacatttttagttgtgggtttttaaatatataaagaaatctttagaagatattctttttgcttttgcagctcctattttatgtaaaaagtcctgtttctccccccaagaactggggtttccacagccagcgttaacaaataaataacttataactgcttgtcaccttctttcttcagtcgactggaaagacaaaacaggaaagcgtatttagtctcaggcctaggcaggcagtcacgcaggctggaggcaaccccaaagacaacagccaggcaatccaaccccaagcccgcagcctcctgtgtagctgacctaccctcccaacacctcccttcctctgtttctcccatcaccatggttccacaatgtcccctccagggcccagcaggcagagggggaggagcctggccctgggcacacggggaggttgggagcctgggctcagataacccctccactccctcccagcaccccacctcacctgtaataatcttcctgacttggtaggtggccaccatgcatgtgggggtgtccatgcagccactgctgctccatggccagtctctgcagctcggccgactgggcatgcatggcctgcagctggtgggctgctgacatggggggtgggatggccccaggcaggtcacgggggtagggggtgcctgccgaacacaaaacaacctgcgctacagaaatagccagaggactggccaagaccagggcggcacaggcacagcaaacggcaaagagcacaggagaggtgccagttcggacacaggagccagcccctcccagactctgcagacagccagagggcagagcctctggggaggcaggaggtgcccttgggtgcctctgcctggacctgcctggcccctcctccaaggcctcagcccaagtgcttctccttcagagacctgccgtgagtcccctctgctactttcaccggctcttagcaaggctgatgcatttatgacccctaccccagacagcccccagagggcaggaggcttgttcccccacggaccccctgcatgcagggggagcgaacccacctgctcaatgcatgaatgaatgaatgagtaatgaatgaagacagcagaccagaccccaacccaaccctcacacggcctccccgcccctcctggaggggaagtcttaccgaaaactgggtggcgaagcatctcgtgctcgtgtgggggctgtccaagcagagggttggggagagtgccaggcgggtaggggaagcgagccaggtggggaccggcagtcagggggtcgaccagcgggtgaacggggcctgctgaacctaaggaaaggacaaaacgccagatggaggcggtgtgcagctcttcaatgtttgtcccccttggctggaatgaccgatgacttcctcctcacccaggatggctcctggtcaccagggctggatgcaccacctggctacaggtggccctgccccaaagtggctgcctccaccttcagcaagagctccagaggccgagagaagtgacgagcccaccgctgatgcaggcactccctcgtccgcttgtggagtgcccctaacaggcaatcccaggccagttttgtcgaggacccgggatcagcagggtccctctcgccggccacctgggcctgccctctgcctgtcaggtcacaggaacacacagccttgcgccagtgggtgttgggctggcaccccctgcccagggctgtctccctgctcttcactcgcagaacctaaaggaggccagcagagtgggtggcgcagaatggggacctggcacagcactgccctctcctctctgctggcacaaatcttgcgtctctcccttcagaacgttgccttgatctgacctcactgcaccacctcctgccctcacctcctatctcccagctccagccaacacaggcgctggcagggatttcagggttgccacctccagccatgctgccctggggtccctggaagattgggagcccccgctctgcctctgtggctgctcttgccccgatttcccacagcttgccctttcatctcctccatgtttctgctacctcctcagcggacctctcctgacggccttctcgaaaccgccatactgcccctgcgcccagctctcctgatcccctcttctggatttatttttttccagaacatatactttctgcctctcacaacgtggcacacgtctttcaactatctccccaaactggaaggtaaatgtggacaggggttctgccagcacctacaactgtgcctggcacattccaggggttcagtaaacacttgctgaatgaatgatgcatgaatgaacaaatgactacctgtcctcaacactgctcatactgaggcttgtaaggtctacaccaggtgccaacagagcttcagatatgaggacggcaatggtgagtgctctcccatgtcaggactgggtacaggggcaggggaggcgcctggtgcctccaagcaaggtggctccccgccctccctctgggccctgctctatcagtcatcctgccccacactggagggtggccagtgaggaagccctgcacgtaggctgtcccacaggacctgtactccaagtcccatggagcaggtgaacctgcctcctcgtaagcacagtagccaccccctgcgccatctcaccaggctgcagagggagtgaggatgccagctgggcctgcctctgcctcagagcagcctctccacagctggtcaatgagtggccttaaggagctcctacttccagggtggacaggactgagcagccctggccaggtgggtcagctcggaaaactcagccaaagccagcaggaggcctgcccagcctcgctcctcaagggaagaggactgtgcttttcattctccctcagccacccttgagtagcccagtgccttatctgtacgttccttggctccaaaggccacatgacactgctctgctgcccttaccctgccctgtgggcctaggccacttccctccatcccaggcacagggccaagaacccaggcttcacccgtgtgctgcagctgtctgaggccttgcagttctggagagctgcggggccgaggagagactgcgatacagcaaaaccatgacggtagtggatgctgagctcttctaagatctgccagggatgagggatctgttcagaaaagaacagtttccgctcctggatggtgactgtcactcatcaggctctgcacccctccccgtgcctctgtcccacctgccacgctggggcacgcaccttggtggagggggtcctgctggtggaggtggaggtgggagtgaatgtgagagtgctggtgatggtgcggagtcacgttgaacatctgcagtcgggccaggggatcgctggtcagcgatgccatgcgctctgcgtggatacgctcggctgccagtctgtcagggtagctcatctcgggccgcagctgggggcccgccagggccagtctctccctctccaaggggttcaggcccgggtggaaagaagcaaaagggtggggcccggcggtcggggggatggtgagggcgctgtgccgggcaaagtgctccatggggttggcggctgggtgcagggggtccagctctgggggcttcacctcgaagcccggcttcatcctctcccgcagctcccgctctcggatctcccgctctcggatctcccgctcccggagctcccgctcgcggatggtggggtcgacgttgtagaggccaggcatgtggtaggccagcagggggtccgtggggttaaggggcatgtagaaggggtggttgcggttggtgggcgacatgacgtggggccgggcgtactcgctcagagtccgaagggcaggtgtgtcgggcccgatgtaggggggcacagcagcaatggtggttggtggtggctcgaaggatggccgcatgtggccaggaccactgagctgtgggtcactgaggcgaccttcatgcgctgagctggacgccttctgcagaaggaaaagaaagcgtgaggggtcccccgagcgcctggggtctccgcttggtccacactgcggaggtgggcctggtcctgctcctggcctgctctgacaggccaacctggtccctccacggagacccggccctgccttggcctgacaccaggatgcagtccaggccccacagggtcgggctcacctgtgcccgcagctcccctcaggcccagatgggaatgtgtccctgtgagactaagctcatgcatgggttgtctacgtgtgagggttgtgtctgggagtgacagctggggggcatgggtgagtgagcccagcaggccaggaacctcactggcagtccctcatgccacttcctgggttggctgccctttcctccccgcgacagcagagagctggccaccaccacagcacccagcccacgagggggccacaaaggcagggcagctggagaggcccctcgcagcctgcttatcgcctgagtgctcaggtcttctctcaaggcgcccccttgtgcttctccccgactccttcaaattacttagaagttatgaacccaaaggctgcaggagaaggacaggccctttcctcgaaggccctccggtaggaggacgcacagtcactgctgggagtcagcctagacctgccatgcgcagttaccccggcagcttcggatgtgcagcacccgtcagaggtgtggagacagggtgtaaatagcacccaaccctctagctgccaggaggccgagtcaggcagccaagggcagagctcggtggcccagcgtggctcccaggcgcaggatggaccagcgccccccgtcacacctcgccaaccctggactcacagccgcccgctctgcctcgcgctcccgctctcgctcccgctcccgctccttctccttctccttctcccgctctcgctcctctcgggctttctgctcagcctcgcgcttggccttctcaatggcctcctccctcttcttggccagcttggacccggccagaggcatgaagtacaggtctgtccgggcacacgagttgtagccccggtccaggtgtttgtagaacctgagaaaagccacagatcttgctgggagctcctgccgagacccaccccggccctccctcccaccagaacttgcccccaccagcccacctgtgcctgacccgtcctggagccctaggaagcgtacctagctgactggctggcgtgactgggggtgtccaccacagtgggctccggggacgggctccttggtgggggaggggggctctcaggctcctcagcgtcgtccagagcctcctccttgatctggacggtggggagtgggcaggacgacccccccgctatgctgcctcctgaagccgccgcaccagagcagggtggctgggccgaggtgccaggtcccgccggtggggtagaggtggaggggcaggtcggaggggtgatgggaggagggcctccagggacaaaggggtgctgagcaaacgggggttggggggccacctggtggaggcctgtaggggggtgggaggcagggggcgggggcaggttctggctctgggtcagcccggggggctgggcgggcgaggagggcaatggctggctctgaggcatgagttgcaggggtggggggtgagccgacggggggtgatgtgtggacagggagctcaggggcttcagggctggagggggaggcaggttggcattcatggagaagggtgagggccccgagaggtggggagggtgcttgtgggcctgtggcgccggcagctgggggatgggagtggtaggcgggggcttgatgtggggcatggccaagggcgctggtggcaggggctgctcccgtggaggctgttgggactgcagcgctgactgagaggctggcagctgcagggaggtgtgagggtacgctgctgctggggaggtccccagaggggcctggccttgggaggcctggggagggaggccaaagggctgtggggggcctgggtgctgcagcaggggcccagcctgcaggctgtgagggccgggtgggccctgaccgtgcagtgggggctgggcatgagagggtgcagaaggctggcccgccgacccagtcagaggctgcagcgggggatgtggcgagggatgcggcgggggatgcggtgagggcggccgctgggggtgcaaggccggtgcctgttggatgtgggtgtggggaacaggcgctgtgggagcctgtggctggttaggggcctgggaggccgtgggggagccctgtgggggaactgcagtggcagagggcgtgggccctggcgtgggcagctgaggggtccctggaggagctgaggagggagctggggtgaccccagtgggagcctgcaaggctgggggctgggcctgcagcatctgctgctgggctgacgagtccgagtcactctcattgtcctgggggctggggatgctcggggacgtgctgcgattgtcctggtcgatgtctttggggtcactgctaccctcatcgttgacgctgcgactgtctgaactctctccctcaccttcagatggcgagttgggcctgctgatctcctggagtcagagaagggaaggatggaagtcccaggagggcagagccctgtctgctctgcaccaccagtgccggacacacagtaatgtttgtgcagatgaagcagcaagcttggctccgggaccacaggtcgtgccctgacccagccagtgtcaaaggccactccagccccaccctaggagacagggcacggccaccaactagggagaaccccggctgggggcttctgaagaagcattagctttactcagcaaggctcagcagcaaacctcacctgcgtttttgtcttcttggagctggtcctgtcagcctcctccgtatcagaggccaccttctcccgctggcgtttgttactcttaagaggggaagaggcttcctccttcaccttctgcaggggaaaagcccacaaggagcaatcaggccaagggagaccatcccatcagcctcagcaaggaaatgacggtttgcagacactttgctccctcattctgagttccatctccaggagcaaaaagctctagaagggtcaactggggccaagaaggaacacgtatctgggggtgggaatgagagccagccctctgcacctgtgggtttgcatcctcagattcaagcaaccatggactgaaaatgtaggcaggactgtgatggttacatctatactgaacgtgcacacaatgttttcttgtcattatctcctgaactagacagtggaaccactgtttaaactgcatttacattgcactgggcagtagaagtaacctagggatgatttagagtctacaggaggatgtgactggtcacatgcaaaccatgtgtcgatgtatatgagatttgagcacctgtggattttggtatcctgggcggtggaggctctggagccaatctctaatggataccaagggaggactgtacttggctctggagggagccgttctaaccactccccacactttctgagaacttgggaagcttgaggcagaggtggcccccaagagttggtgctcgagcccccttctctaggcccccagccttcggtctgcagcccctaggccaggacaatgctggtgtccagacaggctccatgaatgagctgcatcctcgtgtctgagggagctgatcacgaataccagcaaaccagttttaatgtgagggagggacagagtaggccctactatccccccagcacctgaccttggccgacttcttcactgtctctgctttactgtcattgctggaggtactggcagcgctgggggagttccggccgctggagcggatgtcttcattgatgggtgaggtgcgaccatcagggctggctggctgcttcttccgaccactgcgtagtgtcgacatctgcccacccaaaccgaagactggtgacaccagattcccagtccccatgtggacccacctgagcccaacccacaggcagaagcctgaaggcacaccctatcagcctctcagcaaatcccagaccttggcaaacaacaggccgccctgcctgtccctggctgcatgaaggtcggtgtggagctcagggaagaggtggggaaatcagtgggctcacgccagagggcggttctcaaacctaaagcactcatcccaagggactgtcctgaacaacgtgtgctggaaatgaaccacactttctgagcggcagaaagtcgcctggggccatctttaaagcaccctacaccctttctgtttattcctcataaccgtccattctcccaaccaaaccaaatgaaatcaaacacttgtggatttaatctgacaggacaggaagtgacccaaagagatgaagctgtcaagtaaagcagctcagctccccaagccgccaagcgcttcagcatgtttctgcaaagccatgagggctcagaagagatcaggagacaatggttctggctggttgacctgctcccttctgagtgagcgggggccgggctgccagcagcctcaacggcatacaaggggcagaggaaagtggatggtcccacccacctgccagaaggggccataagggaggctgaagggaaagaccctgtcagtaccctcagccccaaacctggaaaaagcctctcccaaagtccctggcacatttccaacctaggaaacaaagtctctttatgggaggagctatgcagtgagcagaaaaatgtatcggaagtttccaaaacgggatcaaacatttaaaaaaaatcacaaacacactaacacaaaagagcctgcaagtttaaaatagcagagatttgatacaatggaagtgacaccacaagcagcagccttggagagcaagaggggccttggagagcctgcactgagccagaagctaagagcttgctacaaaacccagagcaggatgccaccctggggcccctcgaaggagagaacagagaactcttcccagcccacaggcaagctaccgcctcgggcaaagcagctcccctccaggactttgtctggtaaacaagactttcgcttcctccccctgggaggctcaagcccccacacatcccaggaaactgaagaagttgccaggagccccatggccccaggggactcaccgagccccgactccgccgtgtcctcatgctatgcttcccactgagcccatcatcctcttccttgacgggtttgaacataaacggtggcgggtccacgggcttctcaatgggcgggagctcaccgtatttcttgaagtggatgcgacagtcggtgcaaagcaggatgttctcccggcctccgtggtgccaatctttggaggctgtgtgagggaagtggtgggggccaaccttggaaaccatccctctccctggggatgtctgggcagaggggcccttctgtgggctctacccaaacctgatgccaccagcaccatgcagccctgggccccaacaccccagggctagtgctgccctgctcccccaaggccaggagagggtttcaggggcatctgctgcccacttcaacttggggtgcccaggaaaagctggcagcaagctcctgggaactacagtgtcaaccccccaatcccactcaatctgtcctgcctaccagtcagtattccataccgactgccaagcagaggagtaaagtaaactaaacatttctaactttctcgaatcccgaagcacaatgcaaatgtcaaatcaagtactgtccctggcaggtttccagctggatgcatgaaatgttcagaacatggaagtgcttgtgcccccgccccgccccaggagcgtgacgaggccacttactggtggtgaagcagtggcggcaggcgtaccccttcagctcctgctcactgtcctcactgtcgaagtcatcttcactggctgaacttaggtccactgggcgtggcaggcacatagtgggggtgggggagacaccatcatgctcagccaaggctgggccggtggggtgggggggaggggggaacacctgtgacctctggcctactgcaggttctggccaccagtcagagcggctgggtgcacaggctgaggtaggacagtgtctgcaaaggaccacttcgagctcctcagtgtcagtcaccaggacagagggcctgtgtgtgaggcgccatacccaagggcctgccctgccactgatgcccgtaacgggtgagtctgaactgggacaagcgcgtccatgctgcctccctccctaatacgcccaggcaatcctgagaaattccaacttcaccgagcgcccccaacccgtcctgctaggtgatttctagtcgcctgcatgcgcaacaccggcgcccctcaggttcagcgtcccgggccaggacagagctataaggcacttttgctacaccccagttttttaggggtgagaaggtgtgggctccagcatcattagattgtacatcatactgggaccaaaaagaggatcttggtgaagcaggaggaaaaagaagaaagtgttaatctgatcttcttacaaccaaaagtgcaatgagaattcaagcaggacatcaagtacatcatctgtcaaatggaaaaccttcccaggacaaggccaaaaacatcccaggccaagacgtgtattttttgtaaaaacctaagatgatgttgagtttatgagaaatatttaaatgtacaaataatgttttaaagtctccctcctgaatccttgtcctgctccccgcccccaccatcggtctatgtttaggtcaggcttcacacatgcactggagcacgggtgcacaccccctcatgcttcccggagccatcagctcctacgggcccagagtgggacaggctgcccgtgaacagtctcccctccgcccactgtgatgccaagacccctactcacagaattcactggacgggggtctggagggtgtgttgacgggtgtggacgcggtgcgagtcttaatcctcctgaacacggcctgcctgcggtgcctacgatgggctcgggagctggctgcttcgggggtcttcttccaatagtaatagaaggtgatcagctccccctgcagaagagaagggctgactgtgggggagggcctggggcttttccgtgccccacgcaccctctctgccacagtggaaagctgggtgtttaacagctgtgccagagatgagaataaagaccagtcgctcctggagttgggagaggaactgggcttgcccaagaaacagccactgagctgcccgtggactgcatgaatggggcccgcctcctcagcccagcacagcttgacttccagacaccaagaacaagtacttgttgggtgtctgctatgtcagaccccaccgctgttgtacacatgggaggtacacatcatccacaatggacgaaaaggagagaagattcctgcccacgaggagcttacattctagctgtgtgtgcacgtgagtctgtgcatgtgtgtgaacacaacgatgctttctttacagtaatgccagtgaaatcacacaggtgtgagaaggaaatgcccggccagttagactcccccagaaacaaccaaccaaccaaagcaaactgcccaggtggtgaggaaccagggccaaacagaaggtggggaagaacagagaccgcatgctcaggaaactgctccacagcctccacctggctccatctgaaggcccacatctgacatgccggcacgacgtccagaggcaaggactgggcttggcaaagaaagactacaagaggacagacacacagtggtgctgatgcaaaggtgaaatatcacacaccacaaggtcaggcttcttttcatggcccagcagaaacaaaagcaagatacctttttggaaatatagcaaatgtaagctttttaaagaaagggcactttgggcacccccagccctcagggcgctgcaggctgccatctcaccctacacacaaaagacgatttcttaaacatcccaagataaagtctctttacctagaactgaaaaaaaaaaacaaaaaaaaaaaacaaaaaaaaaaaacccaaaaaacaaacacagccaagtgagagagcacagatcacttggtttccctctaattaaatcaacactgtagaaagtctattagcttggcgactagatgctgggagttgtcttggaggtacctgcaccctcactttgtctcatcaaacactgtcttgtgaatggaggaggcaaaaagagagaggggaaagtgagagagggggatggaaagactagtgttggaaggactaaaatagacaaaccaaacaaagacatgtagctgccacatgacaaactcacccatcagaccagatttcatccaaaacacccccagaggaaatggcctcagaacacagtgacaagagaggtgggcagattttaggtggtggggtggcttccgcaaggcaggggatgccgtgccttgagtacttgactgcccacagctgcatcttatgcctgggcatttttgtaagaagtgggaccacggctgcggtccctaaaggagggctggaatgccttgaaggagggctgactggcctataaagcccatcacatgtatctcctggagcactggacgtgtctcaacctccccaagcacttaacacttaacaaattactcctgatcaccaatacctagcagatgaagcataaccccaggccagcagggccagggagccatctcgggacaagcacactcatgtccctacacgtatgtgcatgtgcccacccctcggttccatgagatggtaactgaatgataaggagaaatgcagatactgccattggaatttctgactggctcctctcccccatgctagtctaggaatgcgagctacaactgtcccagcgggcatgagcatcctggcccctaaggtcatgatctgtgaacctcctagctcttttcacttcctgctttccagacttggaaatgcatttatctatactgatccttgggtgttggctagacggaaaagattcgtaaatcccactagggggttacaagatcactgctgacataaacgctgacttgtgtctggttttcctctgagaaaatatggaagagaaatcaaggcagggagcagtcacactccaaatgctctgtccaaggtcatgcttcatgagctcaaaagggcaactggtgctgtgataagtcacagctcaaattccagagcttgaaagaagaatgagaaaaaactcacagtggttccttctacttcctcagtccaagtcattttaggggctactgaatgataaaagcttgggatgtggccaggtgcggtggctcacgcctgtaatcctagcactttgggaggctgaggcaggcggatcacctgaggtcaggagattgagaccatcctggctaacatggtgaaaccctgtctctactaaaaaaaatacaaaaaattagctgggcctggtggcagatgcctgtatttccagctactcgggagtctgagacaggagaatggcgtgaacccgggaagcggagcttgcagtgagccgagatcgtgccactgcactccagcctgggcgacagagtgagactctgtctcaaagaaaaagaaaaaaaaaaaaaaaagcttgggatgtaagaagaaatgcaaagctatacgagacaaaagggaccaaaaacgggagagaaaaatcgagtgagaaggtggtacctgagcctctgccatgccttcaagtcttacctgaaggctgttaaaaagcagcaacctgacttttctaaatagcatttgtctataatgcaatattgctacacacagttataatcaattatttctatttatcaaatatatatgttttgaaatggctttaaaagatagtaacctgcagatcccaggttaagggaagaagccaggcgcagcagtttacgcctgtaataccagtactttgggaggctgaggcaggaggatcacttgaggccaggagttcaagaccagcctgggcaacatagtgagatttagtcccccacctcaaaaaaaaaaaaaattatctgggcatggtggtgtgcaccggcagtcccagctacttgggagatcaaggcaggaggattgcttgaggccaggagcttaagacaagcctgggccctacaggcccaatctctacaaaaaagtttaaaaaattagcccagtgtgctggtgtgtgcctgtaataataccagctattcaggaagctgagacaagaggatcacttgagcccaggaggctgaggctgcagtgagctacaaatgtgccaccgcactccagcctgggggacagggcgagaggccatctctttaaaaaaaataaaagaacacttaaaaacaagaagccagagttcagtgaggtaagaaactgccccatgccagacagaaaaaaggcttaactttcaaacctttgctcctggcttcactgatctctgccaacaagtgaaaaaaatcaagacccaaaagaaagaaatctaacattgaaatcaacatcaactttttgttgacacttaaagaagaagtagtccagaacagatttcaccatctgagtgccaaggatgaaaatgaccaggcaactggtttctcttcaaatcgaataaatctttcgccttttactaaaaaaaaaaaaaaaaaaaaaaaaaaaaagaagaaaagaaaatgaccaggcaggaaggactgtcctccacagcagtgaagtcacaggtggtaagaacggtaaacttacaattcaggaaggtgacagggtgaccagaactgtcatccactgctggtggaaatacagaatgctcaaaccacgatatctaccaaacaacccagcaattcttctcttatttacccaaaagaaaaaaaaaattctcacacacagactttcacggatacattcatagaaactattctatatatatatatttttttgagacggagtcttgctctgtctcccaggctggagtgcagtggcacgatctcggctcactgcaagctccgcctcccgggttcacgccattctcctgcctcggcctcccgagtagctgggactacaggagcccgccaccagcccggctaattttttttgtatttttagtagagacggggtttcactgtgtttgccaggatggtctcgatctcctgacctcgttatttgcctgcctcggcctcccaaagtgctgggattacaggtgtgagccaccgtgcccagccagaaactattcttaacagtccaaactggaaacaacctaaatgcccacaagcaggagaatggataaacaaataatggtatccccacattcactggactacaacttggcaattaaaaggcacagaccaccgacacatgcagcaacaccatgctgcatgaaagcaggcagacagggacggtgggtgctgcgtgagtccttcccagagatcacaaaaaccaaactagcggttgccgagagcctggagggtgggggacaagaaactaaaagaactcaggtaagcactccagggtgatgaaaatgctctgtaagttgaatgtggtgtcactgacacaaatgtatacagtggtcaaaactcatgaaactgtgtacttaaagtgggtgcatttttacggtattcataccatatatggcaggttacgtcaataaagctgaagaaaaacaacaacaaatccaggccgggttttattagctgcctctcaaccactgttatgcctatcaagggattcaacactggaatgaagcgagtctaggatcggaaatggcatattggtgactgcatgggtggcaaggtcttgagcacaaacaaaagaacatgtcggggaaagctctggttctacaaatagggagtgaagcagctagaggcctcgccaggaatgaagtcaattgaactttaatcaaacatgcatagtgtgtgctgcagagacccgctgcacataaattcagggaacaaaagctgttgcagaaatcaatagcttactgaaacattaacacaggcaatcattaatcaaaaggcagctccacaaaggcagccttgcaaattagctcctgattttgcctgcaagcaaacacagaggtataaaatgttgtcgacatgaatggcctataatgatcattttgctcctgatgctctcacctcatctcacaacaaggtctcacagtcaacatatcttatgtctcggtgctataattgcacacagcatgaggaactcaactggtttagtgcctgggcagaaatgggaaaggaagagggcgaagtcatctccaactgacagtgttcccggctgcagctcttgccaagagaagtgctcaaatccattgggctatatttagcagattctctctcctttcctttttcttttggcggtgggggggctaaatttttcccacaggtcatatgcaaaaagcctttggcaatgacaggagcttggctcctggacttaggagtctcttcccagcagaggtgtctttccaggctatacactaagatggagttaggaaaataagcaccattaggttcctttaatttcccacaaaaagaaaaacaaggggaagggagtgccacacatggaagagagagggaagaagtagtaagctgcttggcaccaggcaatctgggtgaagggccttaggagagaaggaaaaagctaaggatgcagagtcagctgactctgggcctagcggagggacagctcagcggcagccgctcctgccatccaggggcctgctgggctcaggccactttctcctcctcagccaccactttatttctgccccctccagggttaggctgcaagtctatcaagttcacacagacacaacgtaagacatcagcacaggtctttaagagctccctccgccgcctgggcaatctgggctggagcaacaggggccggggctgcctacctcctagaggctgcctgtacccatttcaggtattaatactggttctgctgttctggccaggcccagttctgctttatcttgggtaagtgataggcaacccgacccaggggccaagtgggtgcccctgtgtatgtgcatgtgtgcacagatgtgagcagggtctcctcccaggctttccaacaggccaacttacctgtgcgcatttggtaaactaaacactatccaccaacacaactgctatttaatttcccacaggcagtggaatgctacgggaagagaacctgtaacctgtcctgtgataagccacatgtcttctctctctttaggggcatgggggagtgaaagagtagaagagattgttgaagaagaaggcactggaagcattttgactataaaaggctcactcgtagcaagcatgcctgtttcaaacagtatggggcccagcttctcttctgcccgagcccagcatgaactgctcagacaggatcctctgagaagctgacatggaggcaggagaaggttaaatcaatggtttctgctgtcccatattagaagcataagggtacacccaagattgagtcccactttttttggtaattatatcattattaccacatcacccaagaagtctggacactcccctgaggaaggggagggagtgcaatagaagatgaggtctggagactcccacacacggtatccagggtgtctgcagcctgccacctaccatcaggtcgtgtgtgtgtgtgtgtgtgtgtgtgtgtgtgtgtgttttaaattaagccaaagaaggactcagtcctttgtaaataaccgtatgcgcaccccctttcgattcagttcacagagaacagtgagaatcttccactgtcacaacacagttttacgaccaacagcaaagaatgatgaggactgctggccttacggctatgttaaggaaggccctggaacaccagtttcctgcctccttgcccatgcagacagaggggagatacaggcaggcaggcatctaaaccagatccctgcaacgtcacatatgcccaggctctggccttgtgccactagtgagggtcagctgcagctcctttctttttcacaaacgaagtttccaatgggcaccctttctgggccatgcatcgcccactaaaaaggagggggcagtcggagagaagggggatgaggaggcaggcctggaagcttctcatggataacaggattataaacacaatttctttccgaagctatttcacaggtcttcgaagcccacctaccactgtcagctgagcagactgtagttacgtgatgggacaggagccaacaggggcagggctgctgagtgcacatccttgtacgcacctgaccccatcgcagagtcttagaagtaagcatttagaagaaatcattttaattctttaagacacaagattatctgttcctatggctaaacaaatattttaacatgaatacagaaggagcagctaaataatctctacacaatgccttaactctcggtgctaatgtgcaattagagtcagaatgttgttcccctgcttaaacttttgtttgaaaaaatgccccacagtgagcatctggctccttctttggtggtccacgtaaaggggatgaagaaatccaccccttccttactgaagtggagagatctaaaacttttttttaaggtatgttttttcagggagaaatcccagcaagcaacaaataataaaaaacaaggcctcaaattatgtagggcagagagggagaaagaagcatggtgtagagctgcttcctaaacccgggcccagagagtgacccaggccatgaggaaagagctgtggccctgagagccggtcccaggaagtctgcatgcgacgctgtcccctgaagagctgccctaactggagtgctccaacgctgctgccgagtgcagtcaggaacatttcctggcatggaatcctatgcgagtcattctttcctttccctccccaacgattcaagggctggatctgacaactgttcagaacatctgaggtgagaagccgggcactgggcagaaccagcagcgatattcaggagcagccaccttctacagatctttttccaggaggcaaccggttgtcttccagtaacaactctggtaattaaagcactgttctcctgggctccttcttttgttaaccaaccgaatcctctaatccctaaaggagcctggcactgtcagcgggctctgctgctaatcgttaaatatcacctctgtggtctctgagtgcagcagggagaatgatgatctgcttgaaggcacacgcagagaagtggaattctgaaatctcagcctcctacgttcaagaggccgaagggctctgatctaaaccgccacccacgaggaagcccacagtgaggaggcagctgcctccaggcaaggcagtccctcggtgccacctccagatcctcttctggggaaaggcaaagggaaaggagggaagtacgtgaaggtcttgtggctttaacttgtaaataggtggggccagtctaagacactcatgaagatgttccttacccaggcacctttttataacattttaaaaaatcagttaaaaaaaattttttttttaccactacatttaccactccatttgtacagtgcaaaggaactgcaatagctcaagatttctgccaacactgaacactgtaatgagatttcctaagctctgtgttgttctggtggatgaactcagccatttgctaatcccaccctggccccacacctccactcagacgtctggacctgaggtcctgccacagctcttccctgggccggccctcccatgctgcacacagaccaggtgagtcttcccaaagccccgctagtaccttgccacttcttctccaaacggtcaaaggttcctcagggcctaaggaacaaaggcccagctgcttgactacttcttctgagactttctctgtgttaccggaagacttttctaccatattcctttctaccatattcccccgcctcacggcctttggcttatgtcaaacacaatggccagttttctgttcctcagcactctcctgcctgctgggtgagcccctgagccccataccacccccacctcctcctctgtccaggccctgtagtcctcctcatcactcaggactcaattcatcacatttgctgccttcttctccatgaagccttcccttcacttcactcccccaccactggatggcatcatacaggtttcactcctacatcttttcattcccgcctctgtgctggcacagacaggcttccctgtgctgtaaccatacatgggcccacccaacttgccaaagtacgtgctatctcatctgtgagtaccccacaggtctaagacaacatcttgaataagtattcagtaaacatctgatgaaatgattatttctggagaattaaaattcacctgaaattaaaaggataaaacttttgagaaatggataccgaattgccactttcttattttgccatgtaaggtcattagaagtaactgcctcctgatctcatcattattttgtaaaagaaatgacattttatctccaaaaaagtaaacagaaaaagttctttgattacatttactgttaggaaaaatggctacatttatttcttatgggccagtgaaaacgcaatccacatgccgatgtttggaagtggctgctctgaaggtgagtatcatggaatggtggcttaggaagccactgaaaatgcttcctcactcagcagccactgaaaatgcttcctcgctcagcagccactgaaaatgcttcctcgctcagcagccactgaaaatgcttcctcgctcagcagccactgaaaatgcttcctcactcagcagccactgaaaatgcttcctcactcagcagccactgaaaatgtttcctcactcagcagccactgaaaatgcttcctcactcagcagccactgaaaatgcttcctcactcagcagccactgaaaatgtttcctcactcagcagccactgaaaatgcttcctcactcagcagccactgaaaatgcatcctcactcagcagctttatttacaaacaagcaaacaacattttactatgaaatctacaataactaagctaagccatatctttttatatcttaatatatatttatcttttacatatactttatcttcatctttatttatattttatcttcacagactcccaaatagataaaccttcattttccctgctttacaaatgaggcaactgaagcacagtgagatgaagccatgtggccaagctcagtttcaatgaagtctaacgcccttaaccttagactctgctgtgctgctgctctaaaacgtttgaccatcatggtttaaagcactaagaggaaatagccatctagatttttttaagtgaggggggcaaatttgggctatctttgatctctggaatctctggagttcaacgcaatagcatcttaatcttcatacctggaccttcgcagttatggctgaggagcacaaaatatccctgtgcctcctggtaataacaggatgccagccttcccagctcagggtagagcccccatcccagcacccatggactacagaactgcacctgcttgaagcaacttcaggggcacacaaatcagaagcacatttggtagccatgagtgaagatttagaattatgcacatgtctatagaaacgctttctgcttcctataccaagaacaacctctatgacgacatgagacagacgctgggagcctacaaccatgaaccctccccacctcactacctacttaccatacctcacaccacccaccagcttctgatacaggagaagccctctggcctacttttggctctaggcaacatatgtcccagaaatgtgccaataagtggccttcacctgcctcttgatccaaaagcagtgatgcctgagtctagataaggtagagtccctaaagagatacgggctctgcccaaaaaaagatgtttgcatacacctactatacaaagcatctttccaaactgcttccagctagaagtatctatttaaatcagtggttctgaactgcggctcaaaaccgtacaggtgttggagggatcccagggtgggtctgctgaacctctatgaccttgttgctacccactgcaagcagatctattaaaaaaaattatattcattgatcaagcaatagataactattggtttccttgtttgtttgtaaataaagctgctgagtgaggaagcactgacagtggcctaacttcaacttaattaaaaaataatagtaattaaaataatttaaaaataaataaataacagatttggaaaccactcatttgaaggcaaagattgaggccactgcaaaacagtctaaagctcaggctgaactgaaagactcccacgacatgaggggaatcaccccggcctctggcctggaagccctgggcagttccaacacaatttcacttacatggaacccacacacacaagggcccccttggaggcttgtatttctaaacctcttggaggtttatttcttgttttactgaactgtttgtttaaatataggatgtaaatattttaagtgtaataatgctaataccagaaaaatcttgttttctcggtagagcctcccaaaccctaagaattcatttgttgacatcacttttctttcccacaagctgaacacttcattatttcctgaattcattttattagagttcagaaacagggcaagtgggatttcactgccgttggttctatcgccacctcacctttcttgatgttttctaccagcaaagggggaggagacgaaagaaaaaacgaaagccataaaactgttaaaactaccattctctatctcgtaaacatttttctatttattggcctttcattatatgtgcaatcttattatccctgcacagcatcaaagtgacatccgtcagggtcaccttataaaatatacatcggcaatgtaacgtttaatgacgggagcgggacgaacgatgaaggatgagagagcgaggcctgccgcaggacgtttgaaagggatcatcagttatatctgtgcatttcccgaggtgataattgaatgacaggggctggagggaaatccatttttgagctcagaaaagatagttaggagaaaaatgtttttgtattggaagcatgtaatgactgccaggaaatgggaacagctactctaacaacacttctcttatattttatggtttttatggatgcacagcaaattatcatgtataatccatttctgcaagttgaattttaaaattgctcaatacaaagaaaggaaaagaaagggtacttaattttctcactgcattacctttaataaaaggagcggaaacaaaaattacacttcaaagcacaaaaacacaagtacagtaccgtaccctcttcaagatgtgaaatgtctcatctctttcacctgaattttggacttcacctaaggcaaacatcttagaaaaattcaggcaagcctgcaaaccaggccctggcttctctgtgctcttgtgtaaacgtgcaaccagagccctctagcaaagaagctccaggaaggaaggggagagactgcagctgtctttatgcaactgtattggctgaactgtgtcctccctcaaattcctacgttgaagctctaacccccagggcctctcaatgtgactttatttggagacaggctcttccaagaggtgattatgttaaaatgaggtcaagtgagccctaatccagtacgactggtgtccttataagaagagatgaggacacagacacccacagaaggaagaccacgggaagacacagggagaagatggcatctacagccaaggtgagaggcctcaggagaaccaaccctactgaactctggtcttggacttccaacttccagaactgtaagaaaataagttctgttgctgaagcaacccagtctacggtattctgtcatggcaaccacagcagactaatacataagcctaaggacagggcttcatggtgagcctcgaggaaaggagaggaaccagcagagaagtgaggcctgctgaatgaacctctaagccctgggctgtgagacggggctcatggagctgactgtcagcagtgaagatgcagtctgctgggggagaagaacaggtgccaaagggtagagtaatgtgggaaacagcaaaataattttctactttaagtggggccaaacctcgcagcttatcctagcagctctaaagggcaaatgccacacagttccctcacgacggctgcattctgacccaggagaaccagcccaactccagaacagctctcagatgctgtggatctaaagacagctggctcgcgtgaagggacacgggggaaggaagagaaccacaagatgggaaggaaaactgctgccagcagaacacaaaggaagaaccctccagagtctctgtgggcctgtttctgaccacttaattctggtcagtttccacaggcaagagcccagctccatggggctgggcccgccccgcacagcctcccatgaagctgcgaccggggaaaggagggtcatgcagcccatacttcacagacagacaaatgtgtgaggctctctgaccaccacagctctgtggttccaggggtttccaagccactgttctgggttcctcacatcaacagacacactgcagttgagaaaacacacacaacgggaaccaccaggggttcgggtgtaatttatgaaaacagccatggatctccgaatctgtgactgtgactgtgatatgggctccacggattctctcctggtccatatctaggtctcctcaaaggttctttacagagggcggctggctctcccttaagaggcccaggaagtgtgggactggcagcgccaccccatgcaggctgctatgcatgtggggcccacagggggcacgcgggggtcactgtctagagactctaggaaaccgctccctactccaaagggaatttgcaaagatgatggggctaactccccagaggagagccaggagctcccttttccatttaacacacaagttgaatgccagatggacctagatctctgcaacacgctgtgtagtggggaagcctgcggggctgggtgggatcacttcacctaatgcagcacgtatgccacaaactcaccacagcacaccttagcctgcatcaaatcctggccgctcctgttctggagacaaatcaccactgttgtcatgatgggtgacctcagtcaccccactccaacgcccacctcacggctgacatggcatgtggcaggaggaggtatgtcactgtgctcccagaacataccataaccccatccctcccacccatgcatgtttatgctgggattggtctgtgatgcaaaggtgcccttggccctctctcgggaagtaattttttccttcatgcccacatggcaaaaggcctgcctctcttggcatgagaatctctaacagcctcagagcaagccatgctgatgatgagctctgcgtcctcactgctcaagcctaggtcccagacacaactcccaaaagtcaacaggctttttttttttttttttaaacgaaacaaaacagagccttgctctgttgcccaggctggagtgcagtggcatggtctcagctcactgcaacctccacctcctgggtttaagtgattcttctccctcaacctcctgagcagctggaactataggcacgtgccaccgcacctggctaatttttgtatttttagtagggatggcgtttcaccatgttgaccaggctagtctcaaactcctgatctcgtgatccacctgccttggcctcctaaagtgctgggattacaggcgtgagccaccaagcctggcccatcaagagcttttttaaaagcttgattttccagctgcagaaagcttcagaaacttttcaacacaagtcaaaatcctcagcaatgaaggagaacagaaaggtagagatttctctttaaggtgacttcagacttgagcccatagcccaggagcccctctgctgatgaaggaaccaaagtcagggcagagaggggcgttccagagctggaccttggagtcctggtcctgaaagtgctcagcgctgctgtaacgtctgccagggcttgggagcctccatctcctaccacgttcggcttcttgagtccttccctgggtaaaagggaccaatggtttttcccacatgtcctgcctctgaccccaggatctccttgggtgcagacacctggaacgccttctcctggttgctgctggcccacccctccagctctatgtgctgtcatccacaccacctcatacacactttactgacccataggaagcgagtttccgatgcgcctgtttccatgattaccaactctctcactcagctgtgacctttttgtggctcatacatcactgagtcctgcaggatatcaagttatgtctataacatgattcccctcctccctttcctccgactggactctaaactgcaagtgaacaggggatgtggccactctaaaccttgtaacctgcgcaatcattagcagagtgcctgacacaagatgggtgctcgggaaacgctaacttgaactgagatctatcacagacacacagacatagaagaattatactgcaccagaaatacataaaacagaggagtcactaacagtcataaaagtgaaataactcagtttcagtgataagaaatttggaaatctttcagtgaaccatttcaaaattgagctaaacacacataggtggaaaattagttacgagaatcaaaattattcaaggtaattattatttcccttaatttatctgtacattaaagtaaaaaacaaaacaaaatgaaaacaaaacacaaagagtcccttgatccatttaattagttaaggttactctcaaaaatgaaaatgatttccccagccccggggacgcgccagtgtgaaatgagaacaagagtcttacagggagtgttcctgcacatacacgtatgcactaatgtgcgcttggaatttaccagaacacacgtgttttttgttttacaaatctatgatgaaaccacacaggccttggcttgacactgttccaggggctaagtcttaacctgaattaaccaagctgcactgtggtccaatgacactttggcactaaaagaataacttccatttttctgaggctgagcgttttctcatttcacgctgtgagaatcctctggacctgccttaagagcactcaggaaagtggttacagtcaaaatcttcctctaaggattagtaataacacaggaccaaagctcaaaagcaggagaaagtgagcaccaaattccttcagtgtgctggagcacatagagacttcctgcaggcagatagcaagaggctctgggattatgcctgcaagctagccatgctgctaggctcttaacaaaacagaacaaggacagcctgctgagctgtggcctgaagcaccagtaatgacagctctctgccaacggcagtggtcaacacttccaccagcttggctccagtgatctcaggtccacctttgtgcccacaagtatcccaatttcttcaggaccaggtggcactctcagctgcctccacatgaattaacgaaactcaattcgcagcttaggctttggctcagccacgtgcgcatgcgtgcgtgtgcatgagagagcgcgcatgctggggaagaatggagaaaaacaatgaacaaacattgactgtctagcctttttcaactggagttcttaaaatgaagtgactattaatattttctcaattctcctatgaacggaacataacaggtacctttctagatgcacaggcaagacgttactacgttacacacaatggatgcccggcttctgaggcttacctctctcagaactccgagtgagaacagctgccactggctgcacgaccttgagcaaattccctaacctctcttggcctctgtttcttcattttaaaaatggagaaaaaccaccacaggaaggttaaggaacctcctcgagactctccttatctagaaacctgggctgcctcgccacgagctccctcctttatagggttgtggtgaggatggaagtgccaaaaaggagccggcacacatgctcagtaagtgacaggattttttcttgaaaatccttttccatctgggaaaaggaccagaaactcagaactaagttcaccttaaaggactattttaattgactaagttaaaaaaaaaaaaaaagtctttcaaagaatggtttctgcaaccaacttccttcctctatcatgtttcccctagaacgacagtgccttatgtagtcaaagaataagagaatgttagagatggtgaatggtaatggtgtctgggcctagttcacaatctgaaagataagcgctggtcaaggagaagagtattctgtctgaagatctcagctgcaaccagcagaaccataaatgcccaacagcccactgaggccacctaagaagcctgtctccacccaggtccagcttctctcttacacaatcggcaacagaatgacgccacacaagatcattaaacatttcagcaggaataaaaacgaaaccaagagaatgcacctgccaatctatatcaggcaactatggggtttgtgagccgtccttgcactttaatgcagaattagctttgatgcacagattggaaaggtccagcttaagggacttagaacatcccattatttaattttatgacaccatcactccactcttaaatgtgtcgaagaacatacacttatgttacaatttatgcccaagggccaggtgcggtggctcatacctgtaatcccagcactttgggaggctgaggtgggtggatcacgaggtcaggagtttgagaccagcctgaccaacacggtgaaactttatctctactaaaaatacaaaaattagccgggtgtggtggcacgcacctgtactcccagctacttaggaggctgaggcaggagaatcgcttgagcccgggaggtgaaggttgcagtgagctgagattgcgccactgcactccagcctgggtgacaaagtgagactctgtctcaaaaaataaataaaataaaataaaataaaataaaataaaaatgtatgccaaactacaatgaattctattgccgaattttaaaaatattcacttatgataatgtggggctcactagagtgtcacaaactccagaatgaaaattagtggcttagattacaaactctcgtagtagaaaggtctaaagactctttagaattaagcttgaaagaatctgtgtttctgatgctgagaagagcatagggaacaggttgtacaatcaaccgcctcaccccaaagcctccttgggtccactgcttcctcaggtcggggtcttactgtttattccacatcgtggctgtccctctacccctctaggctgtgtgactgggaacatgtaagctgggatgcacggaggtccagtctctccctgagtcatgcgcatcctgttcctgctgccctagttttttcttgtgggatacaatgtcagttctgtaatctgtcccctctgtaggggtaaagagatgtgctgacgtgctcagaaaaggaacatgcttctctggatgccatgaggtactaaaacacctgtatcttaaaggggcattaataagaagagcagggatcctctcctgggaactcaagcaatcatttaaacagtgctctcatacagcagcaaataaagaggtaaatgagatctgcttaaggtaacagcaaaggtgagcggttgtatgctaactccagataggagtgatgaatatctgaactgatgaatatcacttaaaaagtcttgtcacatatgatctggatcagaaggctgtgacatcacaaccagatgctttgaaggcattttctctgctccctctagttacagacaattaacagttctgtacactcttactcatctgttccagaaggctactaataaagaggttgggctacttgtttttcactcccagctaaactttctgtctcctgctgtgggcaggaatggcagtggcatgtgaccagcgttcctgagtggcagagggcaacagctggccatcaacatgccagtcatgggcacagctctcagccgatgcaacaaccacattgacttcaaggacaatctaaaattgaactcaaggcagcacctaacaagtctctcgtgcttgcaccttccttctgggcccatctaaaagcagctctgcagggcgatttctgccagccacaggtcctgtgtcctccatcttccttccttggaattcctagcaagactgagtcaagcatggccttgggtctatgctgttctttatgggaagcaccgaggaaaatacatctcttgaattattctaattgtatcttagaatttaacatgttcactgtctaaaatcaaaatgagtttcacatataaatgggcaattgaattaataatatcaacacccatcacagtgtaacaaataacttgattattaacttctactgacagccccatgcttccttcctcaagagtttcagactgcccgtttgtgctttgtgcagctagagggttccgaactctcaagaggcctcagggaaagttgactctgtgccttaagcagaaatcacaactgatccaagggagaccctggatgcaactgcaaaaaactgaatggtagcaggggcaggctaccacggagttttaaatcctgccttacattaacacaaaggaaatacaggaattacccagatgccaaaaggaccctgaagagtatcagataatgatgtacttccagctcctggtgaccaaacaaaacaatgtaacaaaacacaaccaactgtggcctcagaacgcctgaccagctacccggagagcttttatttcttgaagggaagccttctaccaaacaaacaaacaaacaaacaagaaaacaccactttggcggatggatcactaggtcaggagatcgagactatcctggctaacatggtgaaaccccatctctactaaaaatacaaaaaaaaaaaaattagctggacgtggtggcgggcgcctgtagtcccagccactcgggagactgaggcaggagaatggcgtgaacccgggaggtggagcttgcagtgagtggagatcgcaccactgcactccaccctgggtgacacagcaagactccgtcttaaaaaaaaaaaaaaaaaaaaaaaaaatatatatatatatatatatatatatatattttttttttttttttttttttttttcttggttcacagcagtcaaaagaaccacaaaggagcagtagtttctaagcttccatgtaggtgaagacaaaaatttttataaatttcatgaatacttatatcccaactgttcaaaatatcaagatatttaagaaaacttgtaggactacagttaactattctctcctccaaatttttctttagaatcagagagaccaaaaataaaaaaattaaaaaattaccattgctcctatataaatcataagaataaaatagagccaagagaacttcttaggaacccctctcatcccaagccaagagattcttcccacattgggcattatcaataatgagaacattcctgagatcctatgagcttgtgtggccctgtctcataaagacagtaaagccacacaaataagggtttccactccctgggcctgagctctgaaacccagccaagacagaatcccaaacagccagagagcttcctttctgaaggcagtgaactgaacatacattatttaagatgaatatctagaactcttacaaatgaaaaagaaaaggacaatccattgaaaaataagcaaaagacttacacaggcccttcatgaaaaagaaacacaaacagccaataaactcattataggatgcccaatatgattagtaaccagggaaatacaaactcctcaaatgcccaaattctttgtgttggattttcaagtaaagtttacctcaaagagttaacacagaagacaaaggttttgaaatctactatatattctctcaggggaaaagctgcaactttgggtgcagaagtagtgtgaggaaaggaaagaggataaaaatatgacttgaaaggacttcacaaatagaaaaaagacggataaagggaacgtactcaaatggattcaacactatctcattcaaaatcccagctggttagtttgtggaacaagacaagctgattttaaaaattttaaagaagaataaagtgccactaatcaagacactcttgaaaaacaagaaaaaggtaggggacctgctaagtcaactatcaacaattatcctaaagctagacagtgaagcactggaatagacagagagaccaacagaacaaaacagcttagaaacagattcacactcttatggaaatttcactttgacatagctggcaacacaaatcagtggagaaaaggctggacttctccagagatgacactgggacacctggtgatgtattacagaaacaagtaaatctggtctctttctttatgctacacaatcaccaaacccacggactaagaacttaaatacgaaaagcaaaattataaaacttttagaaaacagtaagtataggagactgcctaaatgaccaagagagatttctaacaaataaaagctcaaagtataaaggctgatacatttaaggagagaggataaaatcgttaaaattaacaacatattaatctttaaccaatcataaaaagtgtgaaaagataagccacaagccagaaggtatttgcaacacacattatttaagatgagtatctagaactcttacaaatctagaaaaagacaatcaaattgaaaagtaagcaaaagatttatataggcccttcataaagaggaaacacaaatagccaataaactcattaaaggatgctcaatatgactggaaaccagggaaatacaaattaaaatcactcagacatttcaagtttataatgttggtaagcattttaaggtctgattctatcaagtgttggctaggatgtgaagttactggaattcttacatacagctggaaaaacaacaatctgcttttcttggtaaaatagcagatacgcatacctgtaactcaaaaattgtcttaactataccctaaagaattcgtgtgcatgtgtgccagttgatgtgtgcaagaaagtttacagcagaactgtatgcaacagcaaaacactggaaccaactgaaatgtccatcaacagcagaaaagagaaggaaaagacgctctattcatacaaggctgtgaagtaccacaggatgcagagctgcctctcgggataaaggggaatgaaaacagcaaggtgcaggacatttttcctccatgactccattcataggaagttcaaagacatgcaaaactaatatactgtgtagcaatacacatatatgaggcaagccataaggaaaaggaggggggttatagcagaatacccagtctagtggttatctttgcgtggaaaggacaggggattgcaccggagaggaaacagtctgtgcaatctttttttttttttgagacggagtctcactctgtcgcccaggctggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccttgttagccaggatggtctcgatctcctgacctcatgatccgcccgccttggcctcccaaagtgctgggattacaggcgtgagccaccgcgcccggcccagtctgtgcaatcttaagctgcgtggtggcgacagttcaccgtgtggctgtttttataccatacacaaatgctatattcttttgtaactcttcaatatttaactaaaaaaaatttaaaccagaagattgtcaaatatattccaattctgcatttaaagaaaggtttctcttctctacagataatttggaaatgatatgcaagtgcttccttgctcattagacagctaggtaaggggtttaatgacttctcttccacctgacctcacttttcccactgccacctgcccgcccactctaaaggtgctgtccgagctccacagcacacccactgcagggatactcccacttgggagcacacttctgtgtccctgctcttcaaacccaaatgacctcccttctctttcttaggatcactgttttcctgagtattgtattatctttaggaaagtacagtgcttatgaaatgacacttcttagaaagacatgtgtcagctgggaagggtgacatgaaatcttcaaaattatcaaaatcagtctaaaataagcagagctgtgcttctagataaggccgaaaatgactactccataggtgtcaacagtctccaaatataatctacagcacaagtagcctcaggggtatgaagaatatgtctgtgaactcatgtcaacccactctcatgtctgtgtaaaacctgaaaaactaaatacatacacgggaggtactaaaaccttcatccccagcatccactggcgtgtgacgtcaacgccttgttctttattcacggccatttcagaaacctctgtgccaccccgtccatttacttctagatttctgctgctgtgcggctcagtggatgcccctactttagggaatcccagcaggcgcaccctagcacgaaaagccaaggtcactgtgcctcttgtttacaacaacacaaaaaaggtcttaggcaagacccccctaccgccacacatgctaacaaaaaaccatgaggaaggggtggaattctctttggtaacccatgctttgcagtcaatttgaggttcatgttgggaggagaagtcggggagccaccacggaaggtcgcatggagggaacctcaccacttccctctataaatgaagccccaactgtagtatgcgaataaaacaatccgtcagctaagtgcacgttgttttgtatacattaatagttttccatttgtgaggagaaatcagggcagcaatgacgaccctgtctcttaaacgcatccacttctgcaaacagttcatcacctccaaccaccaatggccaaagagtatctcccctaggatcctgttcaatctctctgtggacctgtcaagacacaaagccaaactagactgaatttctctggcaggagtgaaaatacatcacgggttaagaacaagagtagttagacagtgaggatgttaacataaggaggtgggcatgtaccagaaaaaggaaaaccaataccagacacctaaaatccaagacctagaaacagtcatcctgtgacctgaagcagagccatgtgccacaaccaaccacgccacatctgaacccagaggcatcctgtgacacatctgacaagaacgacggcatacagaagagcagagaccccactccagacagctacactcatgtacagagaggcctttggcacatcttctggccagtcgtcaccccaccccaggtagggaagctgcttatttggagagtggaaaaaacaaacctggcatgcatggttcagcgccctggtagttttgggagctagctgctctttttgatcctcttctccagggtaggctcttcccctgcccactaatctatgtcccatagtccgaactgtatcaataactataggtaatattttgaacccatctctctttcttcagaacttggggaaggaagaaggggcactaatttatcagcctcattcagagacccaaacaaatagtgaagacagagccccagaaacctaagtccaaaattctcccaactaattcctttctatctagtaaatattttaaaactatttttaaaaaatcatatttatccagttaaaaactatgtacattttgaatccattcttccataaaacaaacatacatctcaaaaccagctatacaagagggaactcctgatcttcacttctccctcctaaacttacctccccatcttaacaagcagcacttcccctacccagtggctctgtgccagcggggggtcctccctgacgctgtcctctctgatttgccacttctgattcaacaccaaatctcaccaatcctgccttccaaaatattatctcaaaaaaacaaaacaaaacaaaaaaaactttacttctctctgcctcaactgccaccaccctcatccaatctcggggtcaccttccatgatcacactgactcctacctggcgctcagtttccactccccttgacctactacaacccaaattccacactgtgtcttaaaaataacaaaataaacaggaaaactgatgttacttccctgtttgagattccttatcaacttgtcacattctcagcacaaaactctagcaaggtgttcaacagcatggactttaaagccagactgcctgagagtaaatcccagctatggtatttccaagttgtacatacttgggtaagttacacagcctcctatctatgtggtcaatgaaccgatgtatgtaaagcactgagaacagtgcctggcacctgagaggccctcaggacatcctattactgccatggagcacacaaggtccccatgacctgacctctccccatcactgttacttcacccctctccattctcctttttgctccacacactccagctacacttactttttcagcttcccctgagttccaagcctatccttctccagggcctctgtacaggctgatcccttggcctggggggctcttctgattctatccttccctcctcatctctggggtcataactgaaatatcttcagatattcctttcttaagttaggtccccctgttatgatttctcataatactcagcagatttccattattgcacttatgagaatttataattatatatctaattattcacctaatctgtcttcttcatagaattaaaattctagaggccgggcatggtggctcacgcctgtaattccagcactttggaaggccgagacaggtggatcgcctgaggtcaggagtcctacaccagcctggccaaccctgtctctactaaataatataaaaattggctgggcatggtagcaggtgcctgtgataccagctactcgggaggatgaggcatgagaatcgtttgaacttgggaggcagaggctgcagtgagccaagatcgcgctattgcactccagcctggacagcagagtgagactctgcctcagaaaaaataaataaataaaattctagaaaccagggaacatgtcttttgtttattgctgcatttctcacaactcacacaatgttcagcattctacagatcttcagtaaatatctgtaagatgaatgagtataaagaaatctaataacaacttgacttaccttgtaaagaaataacctaaaaagccatgtacatgctcaagaggtttcaggttaatgactcattcttgagaccaaaaaatgtcacagagggcatttgtaagaaatagaaataaacaaaatacacaattgaaaaaataaaaaaaggtgaatctaacaaaatccttttttaaaaaaatccttttatgcttatatttttacctaacctggaaaatgaatatctctatctatatatctctctgtctatccatctatctatctagataaaaacaaacttagccaaaactttttcctctcccctgggtctcattcttcattcctagctttctaaaaattcagcaaagacaaaacatttgccttttcctatcaaccataaacacccactttgaacacagccagtatctacccccacccctccatctaggagctttaattatggccctgaagtacgcataactcacactagcagtagagtccatctatgagggacgtggaggccctcaagagatatggtcagcatctgttacgccagcacaccagagcaaacatctgctgcaaggttgtgctgaaaacatttctatcaagtgggccatcctgtctggaagattaccagccctggagggatgtttgcgagcaaagtttcagctcttcgtgaagcagccctctgaccaaagcaagcgatacagagtgctgcagagaacacgatgtgcattctctgggggcattttcaagggtttccatttcatagaaaatgaaaggattctaaaccatgtagagacggtggaaaatatagttggatactacccaatgaagatgtgcaccaaaataccatgatgaagtttatcctgaaagtaggagaaggagaatgtggtgggcttactcatgagaaggaatagcaaggtgctcagattggacttctgcagggattcgtccccaagttcccaaagactcaacctaccaagaaggaggctactttgccagaaactgtcctacactttatagtacttgatcttacctttccagatgtttctgtgaattttttagtctagtgcaccatcagttcaccaactgctctaggaagatccaaatacaacagttcttatttccgcctccatcaagggtaataaatgccaagtaagatgcagtatcctatttagcgtggcctgtgtgactgggggcccaaagccaggaaccatagcatccacatcatctgggcctttctgattggaccgtagcatgacaaagagcagtggcttaggggaccctcctttctcttgctgactcaatctaaactgctctgggtgagcactccccctttccaagtcctgtttaattctactcataaaatggggttggttttctaacagctcaaggtgttttaagaataatacacagtgttcataaagcataatgggcatctcccaacaaatggacccaagcgcaggcaaggtccatttctggttatttctgttatcaatattatttgaaaagcataggtaagataaaatagcaaccctcaactctgatgcatccagaactgggcaactacataatacagagacaatttacatgaatgaaagtttaatggcatcaaatcaactatggattactagtatccaggtaaaagtaaaaactatatagagttgaaaatgttgctaagaaaatatattaacatataaaaataccttttaaaacttccttcattttttgtttataatttgaagggcaattagaagcttcagatgataggagctcaaggcccacgattttgccatgaaggctggccacctccaatctccacctggggacttaaaacactgcaaaatcctatacaccataacccaagaaaaatccctgatttctccactaagggctcctgagaccagaaagacaagatgaaggatggtgacctatactttgggaaaaccaaattagctgccatttcttgacattctataatcccaactttcaatttctaatgcaggtggctctaactgcacaggtaggacagagctgaaatccaatgtaaacagacacaattcatcttgcacacaacactatacagagctttccccattattaaaaagcttcaccaaaatcttgattggaagtatgctaaacatactgcccacaattccaaattaaacaattttgagaaatatttcttgcttttcagattctcaaaatatttgaagttcgacaactacatacaggcaagatcattctgaccatcaactactcaattaattctcactactgtcctgggaagcagataatattatcaccattttatagatgagaaaactaaagcacagagagatgaaataatttgtccaaggacagcgggagtggaaaaggaattcacacacatttccgttttccagtaatttaacttaagaaaggagctactgcagagaacaaacttatcagtcatggaatcccacatcactcagtgctggagagggggaatgagcaacaaaaaagtgacaaatcataaggtctgagtcccaactctcagccagagtcacccaattgcttcagaagactgttaccccaaggaaataagaaaaaaatacgttaacttgctctgtaaaccataaaatccactactagtatatatatatattatatctccatgaagcacttaccacagttacacttggtttttgtttgcatttcttagcaggtgattaatactttaaggggagagaaactgtattactcatttttatatcctcagcatctatctaaaatgtctttcccatagaaactcaaacgtctgttgagtggttgagtgagtaaataaatgtaaataaaataaaaaagaaaacatattttaagggccaaacagcccaaaggcattccatgagggaagtttgttactaaactttcagataaggtgtctagtatttcctgtaataagatattgtatattccccttctcctgcccacagaataaatcaagtacaaagaaactaaaaataataataccaaagaatgagcaatttccgggtcgggtgcagtggctcatgcttgtaatctgagcactttgggaagccgaggcgggtggatcacaaggtcaggagttcaagaccggcctcgccaatatggtgaaaccccatctctactaaaaatataaaaaattagccgggcgtggtggcacacgcctgtagtcccagctactcgggaggctgaggcaggagaatagcttgaacccgggaggcagaggttgcagtgagctgagatcacgccactacactccagcctgagcaacagagtgaggctctgtctcaaaaaaaaaaaaaaaagaatgaacaatttcctctttggtcttgtctgcataaaaaaggaacctctcctgctcagctatgcaggcacctggagacatttgaagctggaggtaggaaaaaaaaaaggtgaaggtgagcttgacctagaagggcaactgtgaacaaggtgctttgaggaagcaatgtcaaacctgtgtggacctttttgtaaacaggttaatttcctaaattcttttgtgggaatataagacatccgtgtttctaaaacgggagaggagaggaaacaaaaaccaaaaccaaaaccaccaccatgcactgaaggcctgcagtgggggcacaggaggaagtatgagaggttccatgcctgagttgtgatgtttgcagagaattagccagtgagagtgcccaaggaacacgggagcacaaatctgagaaggaacactcgaacgaggaccaattctattattattattctgctctgtaaggcataggtgacaccacccctctctctgtgcttaaaggacagccattccattaactacccaccttgaatggattccagagaaagactttgttccccaagaaatattagcaaaagccttcaagccagggctaagagccttagtgacaagtgagaaggcacagaacaactgagcagagatcatctcttgaaaacctatgctaattatcctgtttctaccatcaggaaagtgggaggggggaagggctgctgtgctatcacttggggtccattctggggtcaaatttgaatcccagcttctagagctgaattcaatgtggagtttgttgtccatgccaaaattcaaaggctgatcaagttgaagaacgtgacatggacataatgtgaagtacatgaaaactcacatacaaagtacctgccctcctggaaccagtccccagttatcacagagccgagaggaaaccagtcccctattatcaaatcctcttactcttgactagagtgatggaatttgggaagaatgcagcagacttctaaagactgctcagctacaagcaggatcttcatctccttttcagctgtggataacaacggaagcagtcagccgtctaataaatcaagtttaattttaacagcatgaagtattgcccgctttgtaattatacttccaaaggtaaaacccaactcgaattaacttaaaaaaattgttattgaggtaaaattcacataacataaaattaatcattttaaagtttacaattcagaggcagttaatacatctacaatgcgtgcagccctcagatctaattccaaaacgctttcatcatcccccaaaggagacccctccccctcattaagcagtcaaagtgaactttttccacaatggcattctttgtgatatatcatgctttctccacagtatcagtttattcactttcaacagcatctttgcattttaaaggtaagggaaaactcaaaggaccatgagaactaacactcacaaatgtgctttccagtctaccacgtgactgtatacacatctggtgagacagttatctcaggcaaaatgtactgtgtgtcttccctgggaggagaaacaggagctgattctaatggaatgtttactatgtgacagatactgagtcagaaacagcacagcagctaagactgggtgctctgcaaccacactgcccaagttccagttccaattcagtgtgaactctgtgttctttgggcaagtcatcataatctctctgcctcctttctcttcacacgtattgtgatggcaacaccaccacttgcctcatggagatgctatgaaggttaagtaagttcaagtgcttagaacagtgcctagtgcataataagagctcaatcactgctgccttattcgactttcactacgactctgagggaggttctatttgtgcccccatttcattactgaggaacttaaattttacagcatctaagagacttaccccaaacccccagagaataagtgggatagctgggatttgaactcaattctgagttctgttggcttagcaaccattctgtaaaatgtaccaaggaacaaaacctttctgatcccagttaccaaactcatgttgagcaaaatcacactcacacaggaaaaaaaaaaaaaaacacatgaaactgtcaccaaaatggcaataacccaactgtgctacagttttatttcctgctggcttctcagttctctaagccttgaggatccacgcgccttagaccattattacctcctcccccatatgcagtaagttcctgactcttctgatctttcctgttcttactgggcaccatcccccaagaccttctgctatttgtactttctgatttcaggctctttattctctgatacacactgttgccagaataatcttcaaaaagattgactgcaactttcaactttaattcaatcatacaaatatttcttgagcatctaggtgcaaggcaccatgatgaagataatgtgagtaagacagtccttgccttcaggagctcaatccaaaaagggaggtgtaagatagaatttcataagacaatgcagagccagagaaaggccctaagagaggcatgatgttctacaggggtattcaaaggacagagttatatcctcctcagattagagaaagattaatgaaggaaattaagtttaaaaatgtagagcatttccacatggagtaacagaagggcaggcattctgggcagaacactgcaggaagaaatggcagacaggaagcctgagtgtttggcaagggccagaggtgcagaaagaaaagcagtagggaaggggcttggagaagctgatttggaccacagtataaaaggtcttgactctcaggcaagggggttagtactgagtgtggctgatgaaatctccatagctttgctctcctgtgtgctttgctcagggttggttctcaccatctccccatcactcaaggcctagttcaagtctcagcttcttcctgacgtgtgtcttgaccgccccagtgtaaaataagatcctcttctattaacaacgaccatctctacaatttatttggcaattaatcacgtagtgcttctaacatctgttatcagtcttaaatgatttttcctttttcttattatttatcatgcgtatttatgttttgactccccagtgaagtattcactgaactctagtgtgggggaggagtcttccccaactctggaagatcaccagaaaatacgcagcctaaaaacagattttgtcaggtgactctgatgaccagttgggtatgcaatccactacacccatggaatctggcacagggccttgctatacatcgaaaaatttgctatttttacaggtatctgtgattttcacttcatatctcaacaacaaacaggtgcatcaatgtgcgcggccactaggagtacatgagagtacctgcttttcaacaacctcacttctacttagaactgataaacttttttgtaaatataacgggtgtgaagtaatatgtgtattttaatttgcatttccctgttagtgaggctgcaaaactttgcagacttttcagattttctcagctaaaactacctgttctcatctttcacccatttttctattgaactgcttgtgtctattatagatttctacaagttcttcatgcattctagatactaatccagttatgttataaatatcttctctcagtctgtcacttttttctcactttatggtttcctataaaacacagactttttaagtcttaatatagataaatatattatcatttactttttgagttgtactttttgtactatttcttataaacccttccctactcagggaacattaaaatgttctattttcttacagttttaaagtcttgtttttcctggctttaacttatctgaaagttacaatcttattttattttgttcccatatgccagctaagcccattggtcccaaaccatttactgaataattggttagttccccacggatatcacatagttctgcccccattacactgacgtctctattttgcatcaataccaccaggtcttaattactctaactttacaagtcttatctcatttgtataaagcctatcttccttgtttcttactcaattttcttgctattcttggacctttattctaccacacaaatcagtctgctggttccacaaaaaaatcctgttaaagttttgattgaaatgatatagcaatgagagagtaaggggatctttataatgcagagtactttttccattaacatcggcgcatcatctctccatttatctacgtcttttttttaggtcttttaatattttattatgtctttttttaaaaaaaaaaataaagaatttgcatatcatttgttgtacttactgctaggaatcttataaactataagtttctgtagccactgtgaacagcatttttttttttaagagacagagtctcactatgtcattcaggtgggactccaactcctgggcctaagtgatcttcctgcctcagtctcctgagtagctgcaactacaaggtcatcccactgcacccggctcagtatttttaatatattacattttctactttgttggtggtggtccataggaatactaccaattttttaaaaatctttaaactgtaaaatttttctatattttcatttgctccactaattaagtgtctacatttttaatataaatatatcacctacaaatcagttttgtctcttcctttccattcctgtgtcatatgtgtgtgtgtgtgtgtgtgtgtgtgtgtgtgtacatatatattatagtttgacaaagtcatgctctgttacccagactggagtgcagaggtatgatcatagctcactataacttgaacccctgggctcaagcaatcctcccacctcagcctcccaagtagtgggactacaggcgcatgccaccatggccggctaatatttttattttttgtagaaatgaggtctttctatgttacccaggttggtcttgaaattttggcctcaagtgatcctccctctttggcctcccaaagcactgagattataggagtgagtcacctcacctggccatatatttatatacttttctataaacacacatatatagggtctttgtccaattgtgtcatatagaaatctgagtgaagagtctaatattagtgatgacagtaggcaaccttattttgctctttattttcagtgaaggactgacagtttcaccattaaatatgatgcataggggctacatgagtagctcacgcctaaagtcccagaactttgggaggctgaggcaagaggatcacttgagtccaggagttaaagaccaccctgggtaacatggtgaaacaccatctcaaaaaaaaaaaaaaaaaaaaaaacccaaaaattatccaggcgtgatggcgtgcacctgtagtcccaactactcagaagactgaagcgggagcatcactggagcccaggaggttgaggctgcagtgagccatgactgcaccactgcactccagcctgggtgacacagtgagactctgtctcaaaaaaaaaaaaaaaaaaaccatatatatatatatatatatatatatatatatatgtcacttaatagtttttgggagttattcttttttgcattaagcacatgtcctgtcattcctagtcttctataagtcatcgttacaaagaacactgcatttcacccactgaattttatgcaactatgaaaacaaatgcacttgtttctcagtgagttatattacgtagcaaactgcattttcaaagacggccaagacagtatctcccacctcacataatctttaatgtgaccttgtaactccccatcaaaagatggggtcttccagagcccaaggtgggagaatcgcttgaacccgggaggtggagtttgcagtgagccgagatcctgccactgcacgccagcctgcgcaacagagtgagaacctgtcactaaataaataaataaacaaataaatatcgggtctataactgggtgcagtggctcatgcctataatcccagcactttgggaggttgagacaagaggatcacttgaacccagaaattcgaggccagcctgggcaacagagagagccctcatttctacaaaaaataaaaatattagccaggcatggcatcatgcacctgcagtcccagctactcgggaggctgaggtgggaggactgcttaagcctgggaggtcgaggctgcagtgagccgtgatgtaccactgcactccagcctaaacgacatctaaaccctatccaaaaagaaaaaaaaaaagcctactttcccttcccttgaatgtgaattggacttagtgactgctttgtaaacaatacaacacagtgtaagtgatgctgtgtaaatttattttattttattttatttttttgagacagagtcttgctctgtcgccaggctggagtgcagtggcatgatctcggctcactgcaacctccacctcaaccttcaggttcaagtgattcttctgcctcagcctcccgagtagctggggctacaggcgtgcgccaccacacagcaaatttttgtacttttagtagagacgaggtttcaccatgttggccaggatggtctcaatctcttgacctcgtgatccacctgcctcgacctcccaaagtgctgggattacaggagtgagccgctgcgcccggccaacgctgtgtaacttctaaggctaggtcagaaatggccacagaacgcagccaaccatcatgctgtgggaagcccaagccaaatgcagtggccaagtataggtacgccaggtttccatcccagtcgagctcagcctcagagtcaccatcacagccaggtggcagaaatgtgagtaaagaagatcacagctgtttatgtcacacacagccatttgtgtcttcccagctgaggccccagaaatcacggcacaaagataagacacccttactgccccattcaaaattcctgaaccatggaatccataaacagaacaaaaaggttggatgggttgatatggtatgtcatgcaacggtggacagctggaacacaagactagagtctctcatggtaactatctttgcattcccgggataactcctacttgctcaccatgtagtactttttatacattgctgggttcagttcggtaatattccacttaagacgtttatgttttgcttggtgaagggagagattggcctacaaaaaatgtttccttcttagatcgtatttatatggttttgagatcaaggttaaacttagccttttaaaaaaagttgtgaagcttgccttcttttcctagcctctgagaaatagcttaaagatttgttaattaaatatcaggtatattcacctgtaaaactgcctggggggcgctggtgctgggaaaggggtattcaaaccaatgatccagtttctttcgcttttttttgagatggagtctcgctctgtttcccaggctggagtgcagtggcgcgatctcagctcactgcaacctctgcctcccgggttcaagtgattcttctgcctcagcctccctggtagctgggactacaggcgcgcaccaccacacccagctaatttttgtatttttagtagagacggggtttcaccatgttggcctggctggttgcaaattcctgaccccgtgatctgcccatctcggcctcccaaagtgctgggattacaggcatgagccaccgcgcccggccaatgatccagtctctttaataattattagcatatttggaatctctattcttgagtcaattttaagaattttgttgtctcttttgaaatttcctatcataaaacttttcacagtagcccttacatgtgtgggtttgtgtatttaaaattctctcctgcactggctctttgtttctaatactgtttacttgtccttcttttttacaagatcagccttgctgtattatattcatattttctttttttttttttttcctgcttctcgggttcaagtgattctcctgtctcagcctcctgaatagctgggattataggcgcccaccaccacacccagctaatttttgtatttttagtagaggcagggtttcaccatgctggccaggctagtctcaaactcctgacctcaagtgatcctctggccttggcctcccaaagtgctgggattacgagcgtgagccacagcccccagcctatattgctattttcacataatcagcttttgatttaatgtggatcatctcattttttcctcccatttcattaatatctgctattacctttatgtttccttgttaaaaattgctttcttttgtggttattctttttctatttttcttaataaaatcttagctttttttttttttttttttttttgagatgggagtctcactctgtcaccaggctggagtgcagtggtgccatctcggctcactgcaacctccatctcgcgggtttaagtgattctcctgccttagccacctgagtagctgggattacaggcacgcgtcaccacgtccagctaattttcgtatttttagtagagacggggtttcaccatgttggccaggatggtctccatctcttgacttcgtgatccgcccgcctcggcctcccagtgtgctgggattataggcctgagccgctgcacccagcttttttttaaaaaaaatagaggccgggtgcggtggctcacgcttgtaatcccagcactttcagaggctgaggtgggtgaatcacaaggtcaggagattgagaccacggtgaaaccccgtctctattaaaaatataaaaaattagccaggcgtggtggcgggcgcctgtagtcccaggtactcggagaggctgaggcaggagaatggcatgaacccaggaggcggagcttgcagtgagccgagatcgcaccactacactcctgcctcggcgacatagtgagactctgtctcaaaaaaaaaacaaacaaacaaaaaaaagagatggagtctcactatgttcagactggtctcaaactcctggcctcaaatgatcctcttgcctcagcctcccaaagtgctgagactacaggttcgtgagcctggccaaaatcttagcttttaaatttcaaatcaccctacgtttttaaaagcagagtgtcccacagattctaatctgagattactctcccacagtaattgttgactaaactacttcctgattaacagtgagacagagaagaagagtccttgggcaatcaaaaaccatagtaaaatcacagcagggtcgacaacccatacagctccttacaagggtgggctaggtggcagcagactggtgccaaccgtgtcagggcgaggtggaaggctgctctgggtgaggtgatatggaggacccagagcacagtcctgaaagcttggctcctcaccccaccctccttgagaatgacaattagccctagacagtcaccaaaatattgccaaagctggagagatgaagcccctggtccctgtgccacttctctgactctggataaaccaactgactatatgtcggttttctgagtttgctttttggggcgtgggggagggtgagggagtggcagaggtgttgtttgaagtatcataaagttttcgaagaaaaaggagactgcaggctaagttaaaacactgaaagaatagtaagtgatggtcaagagtgagaagggagcatggctctgctggtagcggtatgccaatataatctctcaggaggatgcaaggcactggctaccaaaggccttaaaaatgcacacactacttgaaataaatatttctaggaatgaatcttaaggaaataactgcccccagataagacaaagtcactcattaagaaatttttttgcagcagtaaccacccccgaaaaataccccagaaactgaaaataaatgatcaaaactagaagttggttaataacatgatatcttttaaaaatgcaaccatcaaaaatgactccatagatacatgcgttaagcaaaagatcaatacagataagttttaaatagtcataaaataaaaataaaattaaaaattaggttatagaactgaatgaggccatttctgtttaaaatatttattgatatatgcctagaaacagtcggaagaatatgggccaaaacgttaattagtggccatctcttagtgatggaattactgatttttctttttattttcgagacggagtctcactctgttgccaggctggagtgcagtggtgcgatctcggctcactgcaacctccaacttcctggttcaagcgattctcctgcctcattttcctgagtagctgggactacatgcacacgccaccacgcccagctaatttttgtatttttagtagagagagtttcaccatgttggccaggatggtcttgatctcctgacctcatgatctacccgcctcagcctcccaaagtgctgggattacaggtgtgagccaccgcagccggcctgattttaattttctactgtaaatttttctgtgttttcaagggggaaaaaaattactaaaaacagaccccttccctttccccctaacaactacaaagccaaacttaaatgtactatgatttttaactgcagcagtaggattctgagtgagtcaatccaccagattaatatttttttaaatcgagacagggtctcactctgtttcccaggctggagcgcagtggtgtgatcccggatcactacggcctcaacctcctgggttcaaatgactacaggtgtgtggcactacacctggctaatttttttatttttatttttttgtagagacagggtctcacgatgttgcccagactggtctcgaactcctgggctcaaccgatcctccctccttggcctccagaagtgctaagattataggcatgatgctgtccccagtcagattaatattttcaagagaagaaagcagtaatgcaacttttttactttttaaggtgcatttttaggaataaaggggcaacaggtccgcaacttactctcaaatggttcatgtggggggaaaaccacacacgcacacacacaaaaggagggttaaataatgtgataagatgttaatatttggagaatctgggtaaagaatatatgggaatgctttatactcttcttgcaaattctttaagtttgaaattattttaaaccaaatggttttttaaaaaattatgcatagaataacccaaactttctgaaagtcaagggttacacacaaaataaatttgtgtgtatctgtatgtgtttttgggagagggagaatagttcagaataattagaacacgttgagaatttagaattctcttccatttagtccagtgaggatcttaaaaaacctaagaagtactacgtacatatataattttagaccgcattttcagcccaggcaagagtcagagctcatacaactttgtggagggtgaaaagaaccctgccacaaatgtgctacagagcccgcatcatctccacaacaaaacacccgacacccgaggttcaaaaatctacttcatcaaagatcaagaataactctggttagaactgttaaatcagtggaaagttaatgaacatggaggatgaagtccagaaagtgctgtctgcagtgtttggggcaggcattcgcattaggaaaccctctgtggtacaggctctctcagtggccaactatttggtgatctgcacatttttagcatagaaccttgaaatgatacagctgtgctggtcattacggaattctctttttgtgtgacagaattgtgacaggctcccaggacctaaacccagaaggaagcaggaccatattgctgcctagagaaggggatggagcagattccaggacaccgatgaaacagaagcttccatcacagtgctttctgctaccttatgagacagttcgcatctcaacagctctaggatacaaaggaagcacatacatttatactttataaggtggccaaggaatcctactgtgaacaaagaatgtctaagataataaaattccactttttttttctataaaaagcaaatcttgtcccagatgcaagcacttgcaacagaagctctgtgggggaagcctacctctcaaggccctagttcttggctcatccccaccccatgacctggacaagacctgtgagggtgccatttttagtatcaccgtgcctcagtttctccacctgtgcatgtggaatgatactggcagcccccgtagacttatggggatgactgctgagctgatgtctataaaatgttcttaatggcaagggcgaaagagctataaatacaaggtcaaagcagcatttaaaacctttttaaagctgcagccacttctttcttttgaaacagagaaccacagggaggatcaaaggcgtgctgctgttaactgcggctctcaaggccttgccctccacctggcagaaaccctagagaggtctaccatgatttttaccttgactaacaaaatctcaagacaagttgtacaatggtttcctggaacattctgagtaaagaaatgggaaaccaatacagcttacctagcttgttaccttctatgaacgctggcattaaaagtaaaaggcagccttgggaggaagaaatgcaaacacagagggagaacatagcttccccttgtctctctctgccacaaaagcctggccaaagtgactctactaggttgaagcagcctgcataataaaacgcttaaccttggctaagttaacctcctcagccattaaaaaaagggagggtgggggaagggctagcaaaatcaagcttacgggaaataaacctaatcaaagccgagtagtaacaaagggcaccagaaacatttctactgtatcacatcccacaggctggccaagagcccggaattttcattacaactttcaaagagagcaagaggaggagggaaaaagatttcacaaaagcattatcaaggccccaacccaggatgccctgctgtacaaccaaaatttgtaagaggtcagcctttcagggagtcaaaaacccagcatgtggaaactggcaggccttttatatagtgggaggggttcttaaaacgactactgtttcgcactgaagtctctgagcttcacagatcattaaaggtttctgaaccacagagaaaggagggcagagttaaggaaataaatcaaaagttcctctgggacgcacaaatgcctacttggaacaggctttcagcatgaatatcctccacattaaacaacagggaggacttttcaaaataaaagcagaaaagagattcattttgttacaagcaatgcactttttccttttggtgtaaaggttatgtgtgctataaaaaatgactcctgccgtgagtgctgcggggaggtggaggctgggcttggggcaggaggtggtggtggtcaaagaaaacaagtagaagtgaatacaacgcctgagaatgctgtgtttgggggtcccccaaacaagtctaaatgtcccgcaatgatttgggggtaggatgtgaggtaggagaatggtatcagaaaggaatttcttctacatttattccttgccatccttgcccaagaactgaaatcatttccccacagccagaaagaactgtcttctttgtgggtgtgcaacacacacagttgcagatctggggaaaagagactgtgccgttttgaaggcagagcctcacacttcttaaggaaatatcagttgtctcaaaaccagcagagggagtacaacgtttgagaagaggaatggccaacccgattgctgaggattcatgtttagccccgacaatggttgtaaagctgagctatctaccataacttctgcccttgctctcctgtcacccagcaatagtaaacagaaagaaaagctatactacctactcagatggaattagcttgttctaacaaccgcatgaggcagcagagagaaaaggagaactgtccacacttctgtcgggacacagttcctgtgagcagcactgttttggggagaggaatagaagcagggggaaggctcaatgaaaagcagaaagtccaatttggactgacagcaaatcccaaagcaatgattttaccttaaaatccagggctcctaggccagtctgtgaacagctcatttccagaatttttgtttatgagagggcaaaatggagaactctgtctttcaagcttttctttcaacagatgatttgaaacaaaagcagcacactcatgaaggcgtatgtctgctaaatggttgctatcttaatctttagccacagtttatcaaaacatgtaggaatgggttgagaaattaactggtgctaagattatcagcatggacaagttcctggggagggcctggcgacatgatcaaagctaatggtccctctcccaggagcaaagagcctactatttcatgcatgatgatgttgggctctggcactggaaatctttgctcaggtccattctaagtgtcgaaatggtgtaattaatggttagcctgggtatgcactattcaatcaggcaattttttttttttttttttttttttttttactaaatccgaacattaatgctttctcattgtgggaaatgagagctgggataaagacatgctcaactcaacagaacaaacacaacctatatgtgactttatgttagtctaggaactgtgcactgatgcacacccaggaggcactaagttaacacacatgcatgcatacctgcctgcctgctgggtaaggagggctgggcaggggaggggggccgccctggctgggggacacggctggggccattgttgccactttctcctctttgtagacatcaatttttacaaagggccgaatgataaaggtccacaagacctcacccagaacggctgttgcaggaagcagaggcctgagcagcctatagccagaagcccaggcagggggtgtgccaactacacaggcccacatgaagagcctccatgaggaagacgttatggcaagaatcctctaagtctccaagggacgagatcagaacaatgtatggaaggtgaagtgatacagatttcagcttaataaaaggaaggcggcccgaaaaatggaactgttcaaaaccacaatggcttcatttaatgggttcgatgtccccagtctgcaggaatgctgtagaagattcaggtagtgagaaatacctcaacagacaagaaagctacttcaaggacttccttcggcaaggcctttcaaacaagttttaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactatttttctccccatgctcaataagttcagtaagtgcttgatgattgactagcatcaggaataaactaggagcattttacattcacactatctagttaaacattccaaatgacagatttccagaaaaatgttgcaacaaatgtaagtatttatagacatgcctggtaaggtatgtagcatttggagaaataataactagaacagagtactgtacaaaagaaaatggtacacttttgtatgagtctaagatatattggacaaatgggtattcctattggtaaacatggacatcttaataaaaatacaaaattactacataaagaagcattacatccttcaactcatctggtggccataaaatggagagaggcacatggacttttctcctgagtcacctgatagatttacaagatcaaaagaaataagggcttcaagtctttttttttttttttttaaagagatggggtcttgctagcttgctcgggctgaactaaagatatcctcctgcctcagcctcccaggtagttggaactatagtaggagtatctaccctgccctgctagaacttcaagttttgatgggcaaatccaccccagaggacaggacaaatgccagtattctggttaatagccccagatgagccagcttcccacccatctcccgtaaggtggcagacacataagggaagccaccttggacctttcaggtcaacccatctaccaggtgatactacagagtgagctttggatacatgacatggaaacaaatggccagctgagtcccacctaaattcctgatctacaaaattattaaaactataatatttatagttttaagccagtaaattacatatactaaaaggttttggtttttagaaatttatttaaaagttttagggtttttctttttaggctcacattatccaaaacgtgtagtttgcccccagttcactggctctgtgctttactttgcgaaactagccatctatacagattcatcgggcctatttcctttagaacttaatcctattgttccacaaattacagattctcgccaaatgaaaacacctccctcgacaacttaaggccacaaacctctgacataattcaatgtgtgtcattagcacatttccaaaacagagcacttgtgggaagaagaaccaagttctgatcttagaagccctgtgcctaagtcaataaccaccaaatcccaaaggtgctggacagatgctgctccggccccgaaaataatcaaacacacaaaagttactattaatatttcttgccaaacaacaatcaaaaaaatccaactcctgcacatgggaacaaagcgacaatggcagcagctgcaaatacataagcgaagcatcactgaagaaagtctccagcttaatattgctcccgacaccctctgtggtggttcactcatacagcaaagacacgggataaaaaattccacagactgttttcaagataataaaatggcatatgatgatgactcactaacagactaaaaggaaaaaatatccgtcaacagtcataggaagcttacaaagctgcagagatctggcaccactaaagctcctccacctcccctggctctcacctccagtacacacatgtatgtgggacatacaaagtgtgtgtgttcatgtgcacaccctttagggattaatttgaagccaagttgcaattggctaatggcttactctactgcttaagacagtattttattcttgactggctcaataaacctgctgagaaaaataaacaatggatttcaatcttataaataatctagaacacagaaccgctgcgcaaacaggagagttgatttactgcgcacaataaacagaacaggaaggaccagtgtggcagagtgaaccccaagtcctagacccattgtcctgggacagtagagttcacaggggttttctgtctattacacaaagtctaaggcctgggatatccaggtttcaaactggtcttaaaaagagcatttcaaagcagatcaggtggagaagctttggtggtgccagatctccgaagctttgtaagcttcctatgactgttgatggatttttttttcctttggtctgttagattttgctcacactgaagagcaaaagatgaggaaaatgttcgtttaaaaacaatgaagagttttcacgtcttaggaccattaattatctacccatgattacaatgtatttcgaacctattatttatacatgcgtgaacacacacacacatacttcattttaagcaaataaaaagtaagggctgttacaggactctaagggtgccataaagaggtattaaaatgaggtccctgcccagaaggctttatattctatataaatacatatatgcattcatgcacacatgtgtgcagagtaaaaatgcatggaaaagaggaatcagagtcaagtccaagaataaaataaaataaattttaattttgttttttgttgttgttgttgtttttgagactactctgttgcccaggctggagcatagcagcgtgatcttggctcactgcagcctcgacctcctgggctcaagtgatcctcccacctcagcctcccgagtagctgtaactacaggtgcgtgtcaccatacccagctaattttttgtattttttgtagagatggggtttcaccatgttgcctaggctagacttgaactcctgggctcaagtgatcctcccacctcaacctcccaaagtgctgggattacagacatgagccactgtacctgcccaatcttaatttgaagagggtggaacaaaacccaactctgctgagatgaaatgggccctttgtgtaacagcaaccagcctggggaggagcagaggcagccccagcaagaccgttagaaatgagggaactttagcagggcaccatggctcatgcctgtgatcccagcactttgggaggccaaggtgggtgtatcatctgaggtcgggagttcaagaccagcctggccaacacagtgaaacctcatctctactaaaaatacaaaattagccaggcatggtggcgcatgcctataatcccagccattcgggaggaagagggaggagaattgcttgaacccgggagacggaggctgtggtgagctgagattgtgccattgcactccagcctgggcaacaagagtgaaactccatctcaaaaaaaaaaaaaaaaaagaaatgaggggactcagatacctttcagagaagacccctggcccacctggccccttcactaggggccatgaaggtaagcacccttattcacctcagacatcccatcctagacagcacaggcctggggttaccaaaagctcccccaaaatcccaactttgtcaactgggatagtttagatatttcaatagtcggccgggcgtggtggctcacacctgtaatcccagcactttgggaggcagaggcgggcgaatcatgaggtcaagagatcaagagcatgctggccaacatggtgaaaccccatctctactaaaactctactaaaaatacaaaactcagctgggcatggtggcgcatgcctgtagtcctagctacttgggaggctgaggcaggagaatcacttgaacccgggaggtggaggttgcggtgagctgagatcgcgccactgcactccagcctgggcaacagagggagattccgtctctaaataaataaataacatttcaatagtcaaatcctggggattatgataccacaattgagaggattcagaagaaggatttaagacacttgagcagaacaaagaattatatttccaaagtgggggggtcggtggggggaagaaacatgggccattaatactgaaacttaattaaaaaattcaacatctcggaaaacttagcttaatggaattctggtatcccaaaggaaggttgctcctgtttgcttttcctatttacctaacacaattaatggttttcaaattatacatgacaggaaaaaaaaaatcttactgggagtagggggatgcctttcccatgctgagcagctgggactgagactgaggttaatgctttgctttacttttcaaaacaatactattaatttttactctattttcctaagtattactcaagggtatagtttcaaataagattaaaaatgaactagttattcaaggattataatttcagatacattttgaaacttagttttaatgtcggtttcctaacagactagatagatatatttttaaaatatcagcaaactagttttcaaagtcagaatagatcttacaaggctaaaaaagaatctatgatataaaatataagctccaagtggataaatccattgactgttaaccacagcaaccacaacttgtaagtctttctaaagaccaattcaaaccttccatttgttttactagctaataaaatggtgcagactatttaggcttcaaagtcataaatgtctccatctaaaagtcatccaggtaaccaagacacagccaaatcataagaaatataggttagcaaataccaacagcaaataaatccctgcaagcaacattttgttcaataacactttaaaagccccaagcatacttcatttgagtgcagtttctataagtaatacatttcaaataattaaagcattctcatgccatccccactagttttcatatgtaggataacgccaaggtcaggctgtttacactgagaacggcaactgtccaaggcccttggtttaaaaagtcacccaattttttaatacctccttttctttccaacaccagcaccaaaagtctcttacgtacttcacttacacaagggaatatcagccagtctctcatagattaccctcacgaaaactggaccactgcccaggcaaatatccctatagttcagactatcacaattaatagattcgagcctcggctccattttaatgggaacaaactctcagcacaggaatagctataggatcacagtacttactgccaaaatgcagtgcctgtttctactggcaatcactttggcctcaaatggaaaattccaactgtttatatctatgtgagcacaaattattaagaaaaacagtatggcacataaatgtctttcctcttacccatcttgccagcccctcaaataacttatatttctttttcatacataaggaatgccaataaaagaaagcaatgcccgaaaacactgtggtattaaacctttatgactatgtaaacttcagttaacaagagaaggccatccttccacataaaaaggcttattaaaaactgaaatagaatctggcaaggtctaactagactgcatgccacaaggtaaagagaacaagagcttttgtatcaagtaagacaggagttacaatcatgtttctagaaaaacatgggagtgggaattgagaagaaaactatattgagaagtcctggctcacggtcaggcgcggtggctcacacctgtaatcccagcactttgggaggccaaggcgggcggatcacaaggtcaggagatcgagaccatcctggttaacatggtgaaaaccccgtctctactaaaaacacaaaaaattagccaggcgtggtggcgggcgcctgtagtcccagctactcgggaggctgaggcaggagaatggcgtgaacctgggaggcggagcttgcagtgagccgagactgcataactgcactccagcctgggcgacagagcgagactccatctccaaaaaaaaaaaaaaaagaaaagaaaagaaaagaaaagaaatcctattattgacaatggaaataagccctgatacttttctgtttgaaatattttgcaataattagaaaaacaaaatcaagccctaatagtgaaactttacaattttaacagaataaagacagtatcattttaagaatgatatactatgcaggctcagaattctgcaagtctgcattactgtaaatagcggtgcttcctaaactttacagtactttggaatcctctggggggtccgttaaaatgcagattctggctcaagagacaaggacagggcctgagaatcttccattttaaccagtgatgagagtgctggcctgaggagcacactgtgagcagtgaggatagacaacgtttgtagaagagggacaaggtttaaaaacagagatcttctaatgtactggtatgtggccgtgacacatttgcacattctcagtagcatcaaccgactaaggaagtccatactttgttatgcaacattagattaagcattaatgaggctaggaaaattgtttatttaaggttataacctgaaattaaataaaacttcaggctggaagctcatattgaatactagaatcatttttaacctcttaatattaacagaaacctgattactcagtcttaaagccctttctcaatagcatttattctctgctgcaggaatatggtctatgcaaatgacattttgcctgaagaaaaaagtacagttaatggccagtagttacgtacgtatttaatagaattcattcccagaaatgtggctaagaaaggtggttgattttcatgttatttattaaattaaaaatttaaatctctaatacctttcatcccattacttaaagttaaaaacgtcaaaactggctgccctttcactgggcccttggtgccaaacagtgacacatttccaatagagaaaatgaagatagaaggcaggcttcccttcccattaactttgaactttcaagtccctatctgtcttcctacaagactaaattataagaagagcctcctctttggtcccatcctatacatacttcggtagcacagccctcacttctcttcttaaaagccttaaatgggtcccatccccacactcacccatacacattctttggagggaattcaaggtcccccaaaatctaccctgcagctataatttgggcccaagttctactgcatccgcttatgcaacctcctttccaaccatgctcatgtacttgctgggcacgttttacaatttcctgtctccgtgcctttgttcatagtatttcctatggctggaaagttgcttttcctctaccctcccaacctgggcctgtcaaaaatgaatccttccttcaaagcccagttcaaacaccgcccctccaattagctttccaggagcctctgtgctcactttgtggggcctgaacctccacccaccagggccctcagcacattctaccaagtatggcaggtatgtaaatgtcgtgctggctccctgcagggcagggatggcaccttgcttctctttatagataccctacccattgcagtgctcagtgggcacccagaactttaaaaaattgaactatacacaaaatttagttctgataatgggaagtgaatgaaaatgagtttccagtgtagtaagtgtcaatgcaccaccaactgggattacaaatgacacaagcttaatcttcactgggctaggtgctcaaaaataaaaagaaagagacgagaaagacagccaaagcatgtcccctttcaccttccatctccctccaggggctaacactttgggaacacctcttggctaccaagctggggtagatcacattgtcttctcaccaatcttagttgcaccagagacaagcaacggcaggtcactgaggaagcgctcctggactacgacccagtgccagctgaatttgtctaagtaataggagacacagctataaacaaaggccaggattcaagggacaatcatccaggtgccagacacaaaaagtctttggttcaaataactgatatgtcctcagagaagagatatgtcaccactgcttgaataattatctcatgattttgaagaaaactgcaatgtatagacaaatcaaacaaaaaattatttttggatcatccacgattttgtgttattcctaacatggattcacctttaggtaattaagattctctattaggcctcctactttttcaggcattaccttaacatcaaagctcatgtaccatccatctacccaacaataagtggcagggctcaaagcagaatcaagaggcctagttctccactgtcctcccaaaagttcagacaccgggcgctctgtgacttatacaaatatactaacacttaagactctgatgtggtttatgacaaacagtggcttgacagagaagaggtatacagccaaggtgaatctaaaatgctccacccgtattcctgactacatttcacctactaattatatactttataagcatattgaggggaggtaaatggttatagagaaacagagaatgggaaaaagtataataaactacaggatatttgcacaaccatgacactaaaagatttgacttgtagttattctcttgggtaccctgaggttaacacgtaatacccattcaactaagcctctataaacagttgggttttccgcaatcacagccactattcccacttcagtgggcagcagtgttcagagaaaagccagatttagctcttgtgcaataaacaccagaaaccaaaagagctaggaaagctgtttacgtctatgcccaccaggaacccttctctgctataaccgcatgaatgaactggtaagaatgaggtctcaacaaagcttcaagacggacgttgttaactagttgctgccctccaagtttttggcaagacagattaatgaaaaacaggtaacttatttttatacaggctcagtatatttacaagcagaaaggaattctgtacttttcaaagcatttagctaccaccttatgtagtatttaaggtagacaggaagaacaatcatttccaagtatttctatgcactctttacaaacattatctcatttaaattctcaaaataatcaaaagggtaggaattatcaccccattttacaaacgcagaaattaaaggacagaggggatgaataatctgcctaaggttccagagcaagtaagtagcagagaaggcaagaatcatcacttcgttctcaggcactgcagcaagtaacgacgtacaggcattttataacgaccacagcacctacacaattctcatgcagagaaacaccattttacagaaaataacttcccagtgttgtcaagatttgacctgagctttccaatgaacagctcaaggcagactgcacaattaaaaagagatcatcaagtactatagttaccagtaaggccaagaatagaacacaggtctgctgacccttgcaccaatgcccaatcaggcatgttcttttggatgctgacacccttctcaagttccaagtcacttgcgaataacaaagaaatgagttaataattctggtagacagaagaaaatgtaagccaggcatggtagcgtgcacctgtaatcccagctattcaggggaggatcacttgagcccaggagtttgagaccagccagggcaacagagttagatcttgtctcattaaaaaagagagagagagaaagagagagagaatgtgaaaagtatctatattagagggatttgctatcaaaaggggcatgactataagaattctacccagcaagttctgaatcaacaacactggtacatgcaaatctcatcttctgcagcaaaaagtaaaaaatgacctctgccctcccctccctgtgggctgtgaatgattagcttggctatgttgataactagagaaaataagaaaacacaagatgagtgcctctcccagctcattataatacttacagatttaccctactaccaaactcctccagtgcaatgcaaaagacagcaaggacactatgaatatttagcaaatgtcaggcataataaatcctccattgctgcaaacaactctctcattagttccaatgatggtgactgatgaagactttggaaataggaaaactgctgggtgctagagaagggagaagagctacagcgtgggaaactgtgaaggcggaggagtgatggggaaaggtctcagcaaagaggctagtggaaaagacaaccagagaactagctcaaaaggttggtgtactgagaatgcctctgaaggagaaaaaaggctatttatttacggagtcacacatcatcaataagaagggaaaatcaagagcaaaaagaaaaacatagtagaagaacttaactaggttaaaggttactcacatctgcttccactacggagataaaacactaagtaaaattaccgagcatttccaaatgccagatggtagaatttagatttaatgcttaatcttccaattatgaatttattttttaaaactgaaagataaaataattgtcaagatagttctgtatcaaattcttcatggtttgcaacttttagcagagcagagacagagaacttgagaggctacaatctgagcgatcaggagaaatctactcactgatctcttttttactcagccaaaccaaacttcctacactcgggcaaaggcattttaatttttaatcatatcaaacttcaagtcactgaaatccccagaaaacttaaaatatgtatctcaatattccatattaaataactctaccctgttctgggaagggtaagaaataagttgattatatagattggcatcataatacatcttagtttaatgttcataaacaggtttctctctctctgttttttaccattctcaatatgatccatcctagcatatgagatgcgtaatacttaaatttaattgtcattgactgatgcaaatcatccatttatatatacaagactatacttgaaatcacaaaacccttcttccccatgagttatcactgtccttgaggtactatacagtaagtgtccagaaaaacagctcatttttaaaaagacagaattaaacaagaggaaatcagtaaacaacatccaattaaaaaattaagccaaaaaacccaaattatccgcatacttttatagtagatattcttgcatccatctcccacctccactccctaaaaaagcagctcaatgtctaggcagattaaacatggatcactcctcccaaagtcctgaagagtgtttctggttaatgagtcctcccttcgccttcagacagtggagtggctgctccaactccatcccatctgccctatcccgtggcctagccagagggaagactctctccccatctgcctctacaccaccagggaaggagatgaggagggaggcaaccacagggaaatgagaatgaatcccttccccgcattctcttcatataatttcactctgtattttcctcagcaaatccttctacctcacgtttatcgggcacatttgtcagctctgacccccagctttgtgaaatactaagtagttttttgtaaagctccatttaagcaatttataagatccccttgtacatctgtccagtggaaagtgcaaactctcagggatagaatattaaagagttaaaactcctcttcaaaacagagcaacattgaaaaatggaaaaaatcccccagaactcaaagtataataagccacaaacctctggtttggttgatgatttctgccaattaccaaattcaaactagtgataaaatgctatttcctattccagccactatgtttaaaatttgatgttaactctccaacaatccttcccccacaactaaccctctgttcccaaagacctttctgttctcagagttacaacagaagtctatgttctccaggcggataagcataatctgtcactttactatctaaaaattatgaactcaaattaaaagtcaagggagtaaaacggagagaattctggaggccagcccgagtctgagcacagcgcagggttaaaggaaaccatttcataagatcaaatgtggagaggcagcaggagcaaagaggaaaaaatcaagttacataaagtccaattgtactcactgtttccttattgggaagcagctcctttctaattctgaagaagttcttcccgtactgcctgagtcccttaacgaagcgtttctgtgataaaaagaaacaaatgggatgtaaaaaccaaaaacaaaacaggatgtcagcaaagcaaagatatctacaatcagcagaataacaaccacaaaaaaagtctcggctagggaatactgccgaggctcggagagtatgtcagcagctcagctgggacccactggccagggcaggccccagctaccttcatcagaaccccaatcccacccaccacgcagggcagcgcgtttaagagaaggacgtcctgcgtctgaggctaagaagcaatctgtccccctcttccaccaggcacacattctggtgcacgaaggtataaatatgctccatgttttaataaaacacaactgctttcccacctgagaaccaagcttcccagaagtgtcgagcagaaaggggaaacagaaccaaacccggtgactcttctccagaagggaaccctagggggttaaaaggccgctttccttaatccaaagaatttgccaggaggcaccggaaggcaccagtatcacagaagcccaccgggaacacgaaagccagcgggcctgccccaccgtccgtcattaaaagccactccgagacaccagagaataaccagcaccccttccgccctcccgacgccactcgccgcccccatccattttcgcagcagactcgtccctaaccccagcccggagactttcactttgtcccatgcctcccgagcacccctccccgccccggtgggggcagctcctggctccgagcccccacctcggggctcccagcctggtcccgggcggccgaccccagcagccacaggtaagcgcccggggtccggggcggcaagaggccgtcgcctgtcactgggctccggctccacaaagcgcagggcggaggcggccgcgggtggctcggcgtgtgaccgcggcggggccgcgcggcgcggggcccggggggcgcggggctggggccgccgctgacgggggaggaggcaggagcgcggcgcgcagagcccggcgcggccgcgggcggctgcaaaaggcggcctggattgccgccgccctcctgtccgccagccggggccccgcgccccggccccggccccgcccccggcccgacccccaccccgaggccggagcctccagggcacccggcgctggaatctgtgtcctccttccggacaggagaacatcaaggcggtaaagcacagaaacttcctccctaccgcagcaagcgtggggagagggcgcccacagggctggggcccttcccaggctgctgggtctccagcccacgttccggatggacgaagtcggctgcgccccggccgcacgccctccgccccaaccccgcctcagctgcgaaacggggggctggccccgacgccccccgcggtcccttccggcccgcgattgtgggcggcctctccctggcggcccaggcattagcctgcacttccccggccgccgcttcacaactaaatcaccgcggaagcttcccagccaataaatcacctgcccaccgggcagagggtccctcccactccctgtgtttgagacccgccaggcggattcagtgaagggccagacttagccttttaagaccagtctgcaacctcctactccagtagtggaggctttgcgtttttgaatttcacccttgctgagatatgactcatcattgtcaattttcaatataattcatacagttcgaagggaaaatctctcaaggcacaagaaagcagcaagctctcctctagtgtgaggagtgacctttgttacttgacaaaagtatcgtttatatgatcaacaggcatcctacgctgtgtgcacacagcatatcaccgggagagacggcacggaaagatggccctgccctcaaggagctgcagtctgcccaggaaggcagacaggtaaacaaaccagtcctagggcctgcaagaaaagcagcagaggaacaaagggtggtgggtgaagctaggaagaggaagcaacttactctgcttgctgatgtcttagaggaagtgacaaggaagagtgtgagcctgccaggtgggctccagcagggcttccagcagaagtcagccaggaaaaggcacagggaacattctgggaactgcaaggaggacagggtgtgcagaatggagtgccagcagataagacgaaagaggcaggcaaggatccggttgcagagagcccttcaggccgcacggaagagttcctaattgtaggctggcagaaaggctgaagctggagctttccatgaaaagactggatgaggactgtgccagtggcagtgtggcctaagtgtagattagggacagaccagttaaagaggctgctgacacagttcaggtatgagatgaggacctcaactactggcacactccacctcagtaatcagaattcctgccgcttaatccattcttcaagtattcaggtatttactgagcacctagctgagaggggtctaggaagataataaaggttgccatggacctttactgaactgtgattcatttttgcacgtaagataagtatgtgtgaagtcattacagaacattctgagatgtcatctggccaagcataaagaagtgaggtgcagctcatcagtgcagcaagggacccaagaaggctagactgcagtggtctgtagtagttcagaatgccttcgccaaggcagtgacatcagcgagatcacaaggggtgggcaactattgcaggggtgggaggtggcttggtgaccgggccctccgtgaaggtcagaggtggagaatgggaggtgggttacaggggacagtctacacagacttggggcgggcaatctggagtgagccaggctgtggaacgccaggaccatgcaatcggaacgtgggcttgataccaagtgacatctaacaggtccagtaaaagaggcctacacaataaaggcagcatgtgagaaaggctgactctggaacatcagggtaaggtggcagagttggacaaacaaattcagatcctgtttcttccatttattgtgatgcaatcctttgaacatcatccattcaaccaatagttactaagtacctactatatgccaggagcctcatatatattaattcgaaatctttacaacctaagaagaagtacaattattatccccattttacagacaaggaagctgaggcacagataggtaactagatcaactcctcagagacaaagccagaattcaaacttaagccccctcaaatcctcagagccacactctgtaaaatgcaggcaggcgtctacagtggtaactattttctgttaccattttctatgagtctgtactttcctcttctcgggtccaatgtcaaatcataaagtcctcagtattcttcctaagaagtgtctttcagccgggcgcggtggctcatgcctgtaatcctagcactttgggaggctgaggcgggcagaccacaaggccaggagatcgagaccatcctggctaacacagtgaaaccccgtctctactaaaaatacaaaaaattagctgggcatggtggtgggcgcctgtagtcccagctactggggaggctgaggcaggagaatggcgtcaacccgggaggcgcagcttgcagtgagccgaaattgcgccactgcactccagcctgggcgacagagactctgtctcaaaaaaaaaaaaaaaaaaagtgtctttcaacgccctcctttcctgctcatgctagtggcagtcccaggccagacctttatctctctttcctaataactaggctattaaccatctcccccatccagccatttaaaagcctctgccaaggaatttttcccaactatagatttcatcctgagtcccactttatctggcccttagcccctacctaagaacagcatggtggtctctgcaggacagtgtttacactccttagccctgaattcaaggccctccaggatcctggccctgcccacctttccagccagatgtccagtaatgccaactggcccacactgggggacctctgtctcaactccagaatctgggtaaggcatctccacgttcacctcaaaatctctcctactcccaaatgaaaccagatgtccagttactctctcattagtttatttatttgtataaggcctgcttacccaaaaagtccataaactcttaaaataattacatcttacacctagtgcctccatataacactaggcagttgatgctcaccacattttttgtctcctttaaaaattatttatttattaacgatgaggtctcactatattgcccaggctggtctcaaactcctggcctcaagcaatcctcccgctttgacctcccaaagtgttgagattacaggtgtgagtcaccgcacccggacaagtgaaaccaaccatgagatgctgagggcctgggctagggtggtcacagtggaaatggactgttgaaagccagaaggtccattttgaactctcctaacagagctgacctcttgctccatgatgccaaactctcctagttttgctcataccacttggcctaattctctactcaacctctaaatgctggagtctccccaaagctttgtcctagggctttctgctatatatatcctctccccatatgatctccactgttcccttggctctaaatatctttcgagattgtcactggtatttctaagactaaatctatggtccaagtccactgggaacactcaacttgaacgtttcacaggtatctcaaactaattacttccagaaataggaatttgacatctggtggtgaacacagacctaccacagctgtcaatgtatgtcaatataatgctatcaagagcaaaagcacccttggccccactttaaaaaaaaaaaaaaaaaaaaaaggaagtaaaagcttcatgtggcctgtactgttacttctctatggaaagccacaaggcctcaaaaccagcaaaacatctgcttctcagagaccagcctttagcttgtggtttaccagaaatgtagagtagccctgaaaatcgaaacaaagacgaccactcacagtagtcaatgattggaaggggtcacacgtgaaagagacttctgttgcggctgtctcctttccctctataaattcatcgctcttcaaatgaagaccccgaagtttttaagactttaacaattaacactattgacttataaatcaacaggccctataagcctctaaatgcaagttcatggagacagtctgtttcttaagagtcttctagttgttgagctgaaattcggcatttccagtgctgaaattcaaggtctcatgaattatttctgtgtccattagtttttctatcactcccagtgtatagatattagaatagcaggatgccaagggtaaaggaggaaggaaatatagaaggcaagtcactgacttggccactgctgccagcgctgggcagctctgctgtttatgctccccagctcatagcctgcccactctcagacgcacgaactgagcgtcttgagatgttggcacttgtttctctggtgtgttcatgcccaaccaacccaactaggtgctgctccttggaaacataaaacaagtccttttctgtttgtgtacccccatagccaggtgagatccaaatataaataaatatttatggcaaggagattgttgctttgtgttacaacttacgtttatgattttgtgctctaatttttagataaactgctatagttttccactattgagctgaatttcgtatcaccatcaaaagttacctacctacaagtccctagtagagaaaatttaacttctggctttaaaaaagtaagttacctgaacccagcattactagccttgggttttaatagaacctggaaagctctgttttgcattttcgctacagtggaaagaacgcaaggttcagacttggaagccatgtgatctagtctgctcctatgttccaaaaaggaaattctgacatggctgtttagacctagccactttagaaacagctatattggaataaaaataacaataacataaaaataaaaataaccacgtcaaaatgcattaaattaatgtgttcaaaagttcctcatgctattgcttgagcccaccccctgtcatagtcccccaagccttgtgcctcagcctcactggtctgcctagatactggtcctcacctctccacctttgggatggcacgtggacctggtgcaagtagcatcaccattaacctactgatgagtacaaacggcattgatttttacatgcgtcatggtatgagaaaggcagggaaacaccaccctagaacaataaaaatggtgaacactgagcgctataacgtgccagccactgtcttaaaggctctaatgcactagctcatttaatcatcacaacaaccttatgaggcagaggctactgctattcccatcttttaggtgggaaaagtaaccatgtatcactaaatccttgaaccaggctgggagggtcaagggggaccagtgtaaaaaattgggaagcctcagagctgtggtgggcctaggaatggagccgagggtgcagacaagggatgtgatgatgtggctgctgcctgtgtttgcatcccaagatattgtttcccaaaaattctatgtgtggatagagaatactgggctgagagtaaaccctgaaagggtaaggtgtgcaaattcccctcatctacacatgaaactcccagcacatctcattctggcgtcatcccaggtgctggacctgacccctatctgcagtagcaagagagcagaagacaggggctaagctacaaaaatggctaaaagatacctctgcattaacccctggctgagagctttcaaaattaactccctctggtgaattttaactagtgtatcacagtcagaaactcaccatgacttctgaaaagggacatctactcagtcctcttacataactgtttggaaaacactgtaggtattaaaatgattcccactgtgaaaatggctccttctgttttaccctgatttctgcacaaaattttatgttaataatttattggttcacaggggacagaaaagcaggcagatctgctagtaagcaaactacagctcccccgaggagacacacaggcagtgggtaagaggaacagacccatggctccactgaagacacagagcagcagacgaaaaagacatgtcctaaatgttaaatggtaaggaggggtagggtgaaaaaagggaacatggatgccaggcagaagaaataaaagcctttccaaacatttgtattacatgatgctggctctcactgataaaccactggatgagaactgtacttcatccatatcatcctgttggttgcagatcccgtcaccccatatctaaaacatatttccttctggagctttactgttgatactgctttgagatgtatcatttggttttggttttacatatttaacattttaatgaaagggtgacttgagtaaggcactactttttcaataaatagcaacagaaccaatttgcctgggaggagacctgccagcaagccatgaggggcatttccaaaatttccagtataggctgctcccaatttctgcctccactttaaaaacactttgcacttactagtgttattccaggagagccagttaatagtttaatgaaactagttagagtttaaaggcagcaaatgggataatttaaaataatcatcccatttttattgatggttctcaaatctctctccagatctgacattttgccctagctcagacttgtacctacactttctattcagactaacgtcctccatagttttaggacatcaccatcccaacttgggcactgacagcccacaggccacatcctcctcaagtagcaactcatgaacccagagaactgactgaaatagttcagtgtttcttgagctccccaaggccttcaggcttctgtgcagagtggaagtggtagtggtagtggcacaagtatgctaattgccacagtacactctccaaggtaagtgtaaccgggcccattctacagataaactaaaggttaggtaaattaaatctcctggcccatccacatctaatcatcatcagggccaggattcaagtccagttctaacaacaaaagccatgccaatggtaacagagtgcgtgtgagctgctaagtacttctgtgtattaactcatgccattaaagtccgtagatgccatagggtgacccagagccacactgggtaggcccctccaggcattcctttgtcttccaaataccaactgaggtgcaggcttattacccttacgttactactggcacaagtaaaacttcttcctgcatataccttaagacgggggtctccagtccccagggtacaaaccactaccagcctgttaggaactgggccacaaagcaggaagtgagcggcaggcaagtgagcaaagcttcatctgtatttacagatgctccccctggcttgcattaccgcctgagctctacctcctgtcacatcagcagcggcattagattttcataggaccacgaatcctattgtgaactgcgcatgtgagggatctgggttgcgtgcttcttttgagaatctaatgtctgatgatctgtcactgttttccatcaccctcaggtgggactgtccagttgcaggaaaacaagctcagggctcctactgattctacattatagggagttgtataattaattcattacatattacaatgtaataataatagaaataaagtgcacaataaatgtaatgcgcttgaatcatcctgaaaccatccttcccctcagcccatggaaaagctgtcttccacaaagctggtccctggttccaaaaaggttggggacctctgctgtataccactgtagtcttataaacactgtttacttaattaacctaaacatttaaaatgtttcctttcttcaataataaattaaccttagcttactgtaacttttttcactttataaagtttaaaattaacctcatgggcctagcacctcaaatctcccccgcttctctctccccaagccagcttgccctctcttagctccctgtggccctatttctgtcagctgcagcagagttctagaagaagtgcctggcgtgctctctgtccattcccactccttccatcagtcaccatgccctctagattcattcttcacttcatggagtttcctgttcggcatgctcctcggtttttgcaagggctctgccaactacagggccacgtcatgccagtgactgcactggtctcctccctggcctcagtgtgtctccacacccctccccccaacattccagttctgggcattctgtatattaatgtgttctcttatttgaagacctgtgacaattcctagtacgtccaaactatcggtctgctagttagttaacagcctccacaattgggttcccaatcacctacaccaccatgtagtgaagttagttactgcagtaccccatcctgattcctttccctgggtttttaccaatgcctttctctcttacccaatctagaatgtcccctcttcacttctgcttattcaaacacatcaactcaactaacattcattgagccctcattctagtgaacacactgtgcaaagagcacagcacgaggcactgagtgaacaaggagcacagcacgaggcactgagtgaacaaggagcacagcacgaggcactgtgcgaagcatgttccagtttcaactctatccctacacagagtccgctctgctctctctcccttctctgaaaaacaacaattcctgtttatgactagaattaataagcacttctgccattaaaaggtctatagatcttccaccaaattgtggattcctttccagcaagaggtgagtatttcatgtcttgtgtaatcttcagagtgcctggcaaactgtaaccaagcaatatgataactgttgggtggctgcatgggtattgtttttggtcctagagttctccctgaaacataatacatgtttggtaggatggaaacaaaatttctaatcaatgttagatttgtttctttttttccaagaagaatggagaagtaaatcatattttaaaatgggattgattacttggactctcagtgcagaaaacactgttttatatctattcatctcagaggaataaagggtgtgatacttcttaaggtacttcttaagatactttaaaggaaagtttacatatatatacacatatacatatacatatacccaaacttaaactcttgaaataaaagcacatgtcggagattatatgctgtatgctggatatccatgaggaaaattttcccacaaacaacctggcatggttcagtaactaaataactacatcccccgtactggtaactagccctatctcaggactactgtgttcctgggtgcaagatgggtgtctaggcctccaccatcttcaaagcctcaatttctatgtccctggttctcttaacaatggaacagtcgtaaagcagggtagcctcttggtcctacaaagagacaagaggaggactcaactatttccaaaaagacatcttgtcttgcatgctatgttttgtcaactgtcttaaatacctttaatatctaataacaccacttccacttggttctccctctctggacatgtgtctttgaaataaatcctagtttcagcacacacaaaaaagacctgtttcccaggctagtcccagaagattctatggtaattacaacaggatcccaaatccaagccctctgagtaacagtccattcatttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccattcatttctaaaagaagtcctctctagggtcaaatatggcagctgtttagctgacacagaggagtaataccaaagagttctcttttctgtttcctttcttttcctctttttcctaatcttccaaaggccaaagagaatgagaaggagcacttgggaaggtagatctaatataatcctgcctggctgttctaccctcctcagttcatgagtatcatgataatggacagctcctggtttaaatcattgttttattccatcaccccaccactagcaacccccagttaagattagctatagaaacataacacaaagggtgactgaagcgccaggtctttcagtgtgtgaggccagcaagagtccaacagcccctcaatgtcccagctgactcttctgatgatatgctcagaaatgtctacagaagctgagcagctgccagctcaacacaccctgccacacctgcgctatcggtggaatcagagaatgagaaagctagaaagaagctttagagaactacgctggttgaaaccctcatattactgatgaggaccataaatcatttaactgaaattaaaccaacaaatcaaaccacacatacccacaaaatctttacatttgtgacaaactatattttctagaggtggccactccaatacagattccatcccacatgctctaacaatgtgataatgacactccttcattgacaggtgggtctctctgttctctcctcctgagcctgggtagacctttgtaactgtcttgaccaacagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttacattgggctaatttttattatcaggggtaacgtgttacatagcgataggcaactaatacaagattcattactaaaaccactaaaaactttaacctgttagtcactattaatttaagcaaacaaataagcaatcttccaatgatgcttccccaatttgcatgcctctctataaccttactctgccttcattttaaggcctagctcttatcaccatatgtgatatgattagataacacgatataggctacgttactgaatatatgaggaaagggcctttgttttgttcactattatatccccagcacctagaacagcacttgacaacatatagcaggtgcttgacaaccactggttcagtacaagaatgtatctggagatgattgggcttagtgttcctccaaggctatttgacctctcatcacctgttctccagtttgactcaacgtctcttaatatatattcactgcactgttaagtttctaactctctaactactactgacaaaaccattagatgttcttcgttcaaacccactagaggaactacaccatcccctccgtgatgccagctcagcatccagagtagagccagtgatttcctttgtcaacacacctgcatgccaaaaacccttcccaggaggtctcaaatatcaaataaaagttactccatttttcattcaaagaccatgtgcccaatgggaaaatgacctcatgttgtggtttaaacagcaactgcacccactagcacagcccattgagctatcctatatatacatctctgtcagtgcccctctgggtctagataattacactgagtacactgaagtcctttcattattgcaggcccaacaaaaagtactgccactgggtgaatatcagaaagcatgcatcaatgcactttcaagtcaaatgagaactggctagttaagcagcagcattaacagatgtagagattgtgccagccaaatgcctcttgccaattatggccacacagctacgcccaaattaaaaataacccaacacggccaggtgcactggctcatgcctgtaatcccagcactttgggaggctgaggcaggcagatcacgaggtcaggagtttgagaccagcctggtcaacatggtgaaaccccaactctactaaaaatacaaaaattagccaggcgtggtggcgtgtgcctgtgatctcagctccttgggaggctgaggcaggagaattgcttgaacccgggagacagaggttgcaatgagctgagattgtgccactgcactccaacctgggcgacagagcgagactcaatctcaaataaataaataaaaaataaataaaataacccaacactcataacagaatccaaatgggcatgggaggctccttctctccctacaatatcaccctacagtcgctacataaatgcccctgtaaagtggctcctaagttatgtcattaaaatgttcacctttccttggcaaagtagatctcaacacaggaggaaagagaaataagctaaaaaaagaaatgtggattgtctagaagttacaagggaacaaaaaagtagaaatcctccgtgagaggattttgcaaaaactgtaattaaaggaatctagaccagtggttgcccgatagaaatataagccaaaaatgtaagttttactcttctagtaaccatactttaaaaagaaacaggtaaaattaatttaaatgttttatttaactaaaaagatcaaaaatattatcatttcaacatgtaatcaatataaaagttagtaatgaaatattttacattctttttcttcctgctcagtctttgaaatcagtgtgtattttacactgaccgtgcatctacacttgggccagcacattgcagatgctcaacagccacaagagaccagtggttaccacattggaaagcacaggtctagaataatcctaacttctttttttgtaaaatactgaaacatccaaagcactccaagttttctattagggaggcaaaataactatactgttagaatcatgggcaacgatatcataaattcctaaaataaaaccacatagggccgttatttcaaattacataaaacttgtcttctagaagaattcgaccaaatgccaaagttcttaagatctgccccacttcccaaacaagggaaactgaagacctcgaccagcaccagggccttccgtcagctcctgatacaggaggggctcctggattttgtttccccttcttgacaatacaacatgggactgggttcctcatttgactcggttcatttaaagaatgatctcaaagaagaaaggaaaatcaatgacccctttaggaaatgtagtccagggtgggggtggaggaagcatttcaatgacaaaagccaaacctcagtcataatgcagatccctgtctaacaggtgatcattgttttttttttctattacaggcactctggtctcccgcctaccccatgcaggatggctatccccatgcagaatggctgtgactttcaagagagtcccccaagggagggtcccaagatcaggggctggtaatgggccccaccacaaggctacgctgctggcttttgtttggaacaatagcgctcccatgatacctcactcttgctgacaatattggtaatacgggagcatgaacacagctgtgtgtaaattacacacacaaacagattagatctgtatatttataaggaatacaaacatactaatagctcatttacatacacagctggatacaatgggctgcatgcagaggggagtttgagttccaaagtatttctctaaaattttacaaaaagaaatgctcagattactgctaacccaggctgagacttctgctccccccacccccatgcagtatgtcccccgaaatagagtccttttcatcctcgtttgtgatatttgagatgctatgaaggagaaacctcaacaagtgctgttagatttcacttttattattatttattattatttttagagacagggtcttgctctgccacctaggctacagtggtatgatcacagttcactgtaacgtggagcttccgggctcaaatgatcctcctggctcggcctcccaagtaggtcagactacaggtatgtgtcagttaccatgcccagctaattttaaaaatatttttttgtagagacggggttctcactatgttgcccaggcttggtcttgaactcttgatttcaagcaatcctgctgcctcagcctcccaaagagttgggattatggcatgagccactgtgcccagccagatctcactcctgtaggaaaaaaatcaatataggataattttcagttaaaaagatgtatatacatacgaagagggagacctactaaaacatctgttacaacagcatatagtaaggcagaatctttgcattttcaaaatgttttcataaactttatttgttagagcaatttcaggttcacagcaaaacggaacagaaggtatagggatttcccatatagatgggtctctggatttttcagctaattttgaaaaatagggaaaagagcaatcagcattttgtgctcactacagtaaaccaggaacacaggcatcaggagagctgggctctgattcaaaggcctgattctagcaaggcctcacagtttacttccggctagccatgaacactctctgcgcctgaggttttcgtggaaagacagcatcacaagtactcaaatgtagcgtttaaaagtactaacttttaaaatgttgaatgttccagtaaaacagttaaagaaaaaaaaaggtaataatccaactaagtaaaaatattaacttatacatatctggatagatgataagctcattacaggccctaattttattatttaaaatgtttacaacaaaactctctaattgatattctccctctctctctctttttgccttgatatggtttctataaactcttggtttaaaaaagaaaaaaggtccatttctgaggcttgggtttactgtacttacagttccaccagtaaatcgtctcccagtctgggctggagaagcgctggccacggtttgattgctccagccccaggttgccaggcaacccacacaagggggaagtctgagaaccgctgacagatagccaagtggctgaaacaacagacttctctctgtcaaaaatgtgtttgagagagccacttgcccacctctgctctctgctaaacactacatgattgtaaaatcaaaatcaaaaggccactgtaataaaaacacacttcctgctcaattactaattgttctaaagctgtggggaggcccagatcctacagtgtatggcaacagaaatgcgatactgtaaatgagataaagccagcagcatgcaagaaacctgatctaaatgcatctccgtagcttcaagtcaggagagctggtgtgtggaggaatcaactgcctaagaaaacaccaggaagaaaataatgaatgtcaagatgttaaagaaacaaaccaatcaataactacgaagctagaggtcaagactacttagtaataaaaccaagaacattctccattgttttgaaacacaatctggaggcaatgaaagttttctccctcagatggaaaggaggagcaagaaaggtcaatgacccttgggaaccacaccccctggcggttccaggtggattccctgatacttgactgtaaatgggattacaggaaatagtagcatccttaggataatgcaggacaataacaggtctgagagtctaatgcaacatttaaaatacctatggtgtgagctgggcacagtggctcacgcctgtaatcccagcactttgggaggccgaggtgggtggatcacctgaggtcaaaagtttgagaccagcctggccaacacagtgaaaccccgtctacactaaaaatacaaaaaattagctgggcatggtggcaaacgcctgtaatcccagctactggggaggctgaggcaggagaattgcttcaacccgggaggcagaggttgcagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggactctggaaactatttgtagtatgtggaaggggccagcactgagtgcacagttctttatctcttctgtgccatggaccctttggcagtctggtaaagcctgactccttctaaaaatggtttatggccaggcacggctcatgcctgtaatcctagcactttgggaggccgaggcaggcggacatgaggttaggagatcgagaccatcctggccaatatggtgaaaccctgtctctactaaaaatacaaacaattagctgggcgtggtggcgcatgcctgtaatcccagctactcaggaggctgaggcaggagaatcacttgaaccagggagtcagaggtcgcagtaagccgagatcatgccactgaactccagcctggcgacagagcgagactccacctaaaaaaaaaaaaaaaaaggctgggcacggtggctcctgtctgtaatcccagcactttgggaggccgaggctggcggatcacctaacgtcgagtttgagactagcctggccaacatggtgaaacctcgtctctactaaaaatacaaaaaaaaaaaaaaattagctgggcatggtggtacatgcctgtagtcccacctacttggggaggctgaggcaggagaatcgcttgaacccaggaggcggaagttgcagtgaaccaagaccatgccactgcactccagcctcggtgacagagggagactccatctcaaaaaaaaaaaatagaaagtatgccagagtaatataactgctctatgaacacactaaataacaagagctagcagagggttttctttagctcatgcaggttttttgtttttcgggggggtgggggggctgttttgctttattatgtgacctcagatgataaacccttggagggcaaggacagcaagtttttcatcattcaatttccagtgcaatatgcagcccggtttcctgccccaagctcctaagctagccctcgtcacaccactagcccagctcctatgggggcgtgggtttccttgactctcccagtgcccagaagtgggcctggcatataagatgtgtaagaccatagtccgcaaaatgggatgtatggacacaaaagacatttttttcctatgttctctttccaacaatccatcagcctgagaaggcacacgctcctgtgaggggatgcagcctctcttcttctatccccaccactgcccccctctcacttcacaaaggcagcctcctctcccccgctcccatctggaaggctaccaggcagcactgccccaggggcactgaacaaggggacaatttaaaacattgacactggtgctgacacagtgcctagctctgaggtcaggatgagaaagactccacaagtcagacattttctgattctctgctttcaacaaaacacaaggaggtcctagtggaagtgtcatctgatagattgcggaaagtcatatctgacgacaaattatacttttggcattattatggaaagaattcaaataactgagtgacactgtaacaaaactatcattcccatctacttactcacataaacaaggtttctgggcacttacgtgtttaaaaaaaccatacaatttatttccaataaatgttaagcaaaaatgaaaattatatcaacatttacattatttcgttgttttcatcaactgtgctctaataattataatttgaaaaaacatttcttctatacttaagagctttattattaaaggaaataaccatatgcccgatttcaatacacacactttttgttgcagggaagtactaaaggtcaatcggacactggactttcaaacataaaatgtatcatcttagtataaagtccctggggaagtagaatggaaataaaaattaaagggggaaaaggataagatgcaacattggactgcttttaaaaaatgaacttgtcgggcatggtggctcacacctgtaatcccatcactttgggaggcttaggtgggcagattacctgaggtcaggagttcaagaccagcctggccaccatggcgaaatcctgtctctactaaacatacaaaaattagccaggcatagtggcgcacgcctgtaatcccagctactcaggaggctgaagcagaattgctggaacctgggaagcagacgttgcacagtggaccaagatggtgccgccactgcagtccagcccaagtgacagagcaagactccatcttaaaaaaaaaaaaaaaaaaagcttattttaaaaatagatgatagttcttgctcctcctttcatcatgtgatgtgcctgctcctacttcgttttctaccataagtaaaagctccctgaggcctccccagaagccacacagacgccagcaccgtgcttgtacagcctgcagaattgtgggccaattaaacctcttttctttataaatcacccaatctctggtgtttctttatagcaatgcaagaatggcctaattcggaaaattggtgccaggagtagggtactgctataaagacacctgaaaatatggaagcagctttgcaacggggtaatggacagatgttagaagagtttgcagggctcagaagaagacaggaagatgagggaaagtttggaacttcttaaaagactggttaaatggttgtgaccaaaatactgacagtgatacggacagtgaagaccaggctgagaaggtctcagatggaaatgaggacattattgggcactggagcaaaagtcacccttgtgatgtcctagcaaaaaagatggctgtgttgtgtttctgccctaggtatctgttgaagtttgaatttgagagtgatgacctagggtatctggtggaagaaatctctaagcagcaaagtattcaagatgtgacctggctgcttctactagcttaactcaaatgtggggacaaagaaatgacttgaagttggaatttatacttaaaagggaagcagagcaaagaagtttggaacatttgcaccctggcaatgtggcaaagaaagaaaagcttttggttgggcgtggtggctcacgcctgtaatcccagcactttgagaggccgcggcgggtggatcatgaggtcaggagttcaagaccagcctggccaacatggtgaaaccccatctctactaaagatacaaaaaattagcccggcatgatggcacacacctgtaatcccagctacctgggaggctgaggcaggaggatcacctgaacccaagaggcagaggttgcagtgagcacctctgcactctagcctgagtgacaggtgagactcagtctcaaaaaaagaaaaaaaaaaaaaaaaaaaagaaagaaaagctttctcaggagagaaattcaggcaggctgtaaagcaatcacttgctagagatatttgtgtaactaaaagggagccaagcgctgatatccaagacaatgagggaaaggccttaaaggaatttcaaagaccttcccagcagcccctcccatcataggatgagaaacctaagaggaaagaatagttttcagggccaggcatggggttttgctgccctctgcagctttgggacactgcttcccacatgcccctgtgactacatccttggctcaaagggcctctgatacagctcaggctgctgcttcagagggtacaagccataggctgtggcagcttccaggtggtgttaagtctgcaggtgtacagagtgcaagagtgatggaggcttggcagcctctgccaagatttcagaggatgtatcaggtgcccaggccagaagcctgctgcagagatggagccctcacacagatactctactagggcagtgtagaggggaaatgtggggttggagggcccacacagagtccccactggggcaccacctagtggagctgtgggaaggggccattgtcttccagacccaagaatggtagatccatcagcagcttgcactgtatgcctggaaaagctgcaggcattcaactccaatttgctgaaccctgcaaagccacagaagtggaagtgcccaagaccttgggagcctgcccctcatcagtttgcccaggctgtggcaaatggagtcaagggctattttggagctttaagatttaatgattgccctgctgggtttaggacttgcattgggctcaatgcctctttcttttgactgatttctaccttttggaatgggaatgtttatccaatgcctatacccgcattgtatcttggaagtaaataacttgtttttgattttacaggctcataggtggaagggacttgccttgtctcagataagacttaggacttttgagtttatactggaatgaggtaagactttgggggactatcgataacggataatttgtaatgtgagaaggacatgtggtttgcgggaagccaggaatggaattatataatttgaatatttgtctcctcccaaatttcatgttgaaatgtaatccccaatgtcggagatggggcctggtggaaggttactggatcacgtgggtggatttctcatgaatggtttaagcaccatcctctgggtgctgtgcttgcaatagtgagtgagttcttgcaagatctggttgtttaaaagtgtgtagcagccccacccccttgctccttcttccaccatgtgatgtggtgttcccgcttcagcttccgccataagtaaaagctccctgaggcctccccaggaagtgcgtagatgttggtgtcatgcttgtacagcctatagaactgtgcgccaattaaacctcttttctttatttaaaaaaaaaaaaaaagataatgggtataaatcactatggtatttaaaattcacttgtaatatttaaaagagtgaggggacaattttatttttaaatgtcaatgtttgtaattttggaagttacatccttatcataaaaaaagtcaatttaaatttgggagtgggtatgcgctttcaggcaaaattcttttaggggcttcatagggataaaatatttttcttagctttgtatctacctaaaggaagacccagaaattctttggggtaccaagcatgcttccacatctcagctatatttagtctggttttacctaacagaaacaaactagggtcactgaaaacactttcttgaaccaagacaggttgcaccatggaagatcttgccgtatgtaactgctgttccaccaaggtacagacttttcttcactggaattccaaagctgactatagctctgttcaaggacagtaaaaagcacaaattcttcagtgtgccaattaaagtgcttggcaccttccattctgtcacttcagcctggactctcacatacccacaccacacccaagcatctggactcttttttacttattttatttttcagccatcatctacacatgtagatgggccagccccaacacccagtggttgaagacaataatcttcataagcaggaaattacagaggtgatcttggttctgaaccaactgcagaagaagacagatagacaatcgtctccatcagcaaccacctgcggcaggaaccccacctttttttttttatgttcggggatacatgggcagaacgtgcaggtttgttacatagtttacacgtaccatggtggtttgctgcacccatcaacccatcatctacattaggtatttttcctaatgctatccctcccctacccgcccccaccccccaacaggccctggtgtgtgatgttcccctccctgtgtccatgtgttctcactgttcaactcccacttacgagtgagaacatgtggtgtttggttttctgtccttgtgttagttttcacagtgtcgacggtctttacaatttggcatgtttttgcagtggctggcgcctgttgttcctttccatgtttagtgcttccttcaggagctcttgtaaggcaggcctagtggtgacaaaatctctcagcatttgcttgtctgtaaaggattttatttctctttcgcttatgaagcttagtttggctggatatgaaattctgggttgaaaattcttttaagaatgttgaatattggcccccacggtcttctggcttgtagggtttctgcagagatccgctgatagtctgatatgggcttccctttgtgggtaacccgacctttctctctggctgccctaaacattttttctttcatttcaaccttggtgaatctgaagattacgtgtcttggggttactcttctcatctgatatgggcttccctttgtgggtaacctgacctttctctctggctgcccttaacattttttctttcatttcaaccttggtgaatctgaagattatgtgtcttggggttgctcttctcgaggagtatctttgtggtggtctctgtatttcctgaatttgaatgctggcctgtcttgctaagttggggaaattctcctggttaatatcccgaagagtgttttccaacttggttccattctctgtgtcactttcaggcacaccaatcaaacgtaggtttggtcttttcatagtcccatatttcttggaggctttgttcatttcttttcttttcttttttttagagtctcgctctgtcacccaggctggagtgctgtggcgccatctcggctcactgcaagctccgcctccgggttcacgccattctcctgcctcagcctcccgagtagctgggactacaggcgcccactgccacaccgggctaattttttttttttgtatttttagtagagacggggtttcaccatgttaggcaggatggtctcaatctcctgacctcgtgatccgcccgcctcggcctcccaaagtgctgggattataggcgtgagccactgtgccgggcctgttcatttcttttcgttcttttttctctaatcttgtcttcacgctttacttcattaagctgatcttcaatctctgataccctttcttctgcttgatcaattcggctattgatacttgtgtatgcttcacaaagttctcctgctgttttttttttcagctccatcagatcatttatgttcttctctaaactggttattctagttagcagttcctctaaccttttttcaaggttcttagcttcctcgcattgggttagaacatgctcctttagctcggaggagtttgttattacccactttctgaagcctacttctgtcaatttgtcaaactcattctccatccagttttgttcccttgctggcaaggagctgtactcctttgaaggagaagaggcgttctggtttttggaattttcagactttttgccttgttttttcctcatcttcgtggatgtgtctacctttggtctttgatgttggtgaccttcagatggggtttctgtgtggacatcctttgtgttgatgttgatggtattcctttctgtttattagttttccttctaacagtcaggcccctctgctgcaggtctgctggagttttctggaggtccacttcagaacctgtttgcctgggtatcaccagcagaggctgcagaacagcaaaggttgctgcctgaggaaccccacttttatgcagaggtaaaatctaccaagcatgtggattctgaggtttcgtttcagctccagtggaggctgtgctgtgttgaccgtgtatgcaatggacacagaagaatgagtgtgcggcacttgcctgcgtctgccaccccacctccagatccaactcgagccaggctctgcctgcttctccgaatacatcctgcactctctgtgtctcctcacagggtagttctgctgtctggggagccgatattgggtgtgatgatctgacttggattcctgagtactccactcaccactgctgcggctctgaacaaattcccttactatctcatgcctatgtcatgtcgtgctcctctgtgtttccatctttctgtgtgccccatggaacttccccattctgcccagcactatgttctgggcatccaagtccaccactgccattagaacatcatcttcttgaggtggggagttcctgtccagggccacctggaggcctctgcacacgacaggcatttaataaatgtttcttcgatgacgtttcctattatcagtatctgggcctttcagagccagaaggggactatttaattattattactctcatttcttagtgagaggaccaatgactctcccaaggtacagcaactggtccaaggcacagactcaaccagaaagcaggtttaccaacacttttgtcttctcagcataaatattctaaagaaaataattactattgggtgcattttccacagatagatgaagagttatctgaaaaaagtagaagtgagggaagggaataaaaagggggaaaaaaaaaggccaggcgcagtggctcacgcctgtaatcccagtactttgggaggccgaggcgggtggatcacgaagtcaggagttggagaccagcctggccaacatggtgaaactccatctctactaaaaacataaaaattagctgggcatggtggctaataggaaacgtcattgaagaaacatttattaaatgcctgccgtgtgcagaggcctccagatggccctggcgcacatctgtaatcccagctacttgggaggctgaggcagtagaatctcttgaacccgggaggcgcaggttgcactgagccgagatcacgccactgcactccagcctcggtgacagagcaagactccatctcaaacaatcaatcaaacaaacaaacaaataaacaaacaaaaaaaaaaaaggaagaagaaccagaatttcttgtttttgaaaaatcaaactgaagaatgactggacacgatgtcagcaccactcacacaggaaacctcacgcatgaaacctcacacaacagcactgcagctctttcgcttggttaacttggggacagccctgagacatgagatcggcctttacagccttcttcccaggctggtggaagatcaggctgctctgaatccaggccggctggaattggcggggcctctcaacacagtcaagaatggctaacggcaggcagaaacattttgtggcctaataaaggatcaaagaaatgttccttacaaagaggaaatgaattatccacacatcaagctccttcatgtcttctgtttgtttgttttaggccctccagcctgtttggataaaacatgttacactgagaaagcatcaaagaaaacgaaacaacagtgacatttaaagggaactccgccggctagacagagccccattttgggttcagctccaacttctccctgttctgtctctcctggccatggggagtattcacccacagctgacataagattatcagcaaaggttttaacaagaaccagacctttctcttctaatctttcccccaatccaaaatgtcatgaaaaaacttcaaagaatcttgttagaatttaaaaatattctactattgtgtaactcatgctgaaaaatgcacatctaggtatgaaaaacgcacagattgctctgtcaaagaccactacgtgactgcacttccatagcagagatcccatctttcctttcagctaaatttaatctgttctaaactctgaaagttattgagtcctaaagacatttatttagcaggtcctaacaatgagcagtttataggcaattgtgaaacatgaccacaaagattattggatgggggtcagtaatttgaattgctagaaaaatatagatcactcttgactgacatgaatgatcagtggtatcatttacccagaattactcaagagagaatagtaacatggaatgagaagctgcttctaccctgaaggagtcacttttatagctatacaacttctaccctactcagtctgtgtgtggcaaaactagtttatcctcctcatggcatctacctgaattcatcttatttaagttaatttgcttatttgtctgtggtccctattagaatgcaaatcccatgagaacagtacctccacggttatttctattcccagagttgagaaggtgcctcgtacacagtcagtactcattgttgagtgactgaggagacaaacagcaggaatatattctacagccaacacttgaatctgcgatcttagtctacatagtcttccattcacaaaactctatcttctcgtacctttcctccaccttcaacctctccatgttaatgcacttcggctccatttaccagttaacgatttagtgatcccactgagaagccaggagctccaacagccaccgagaagcacagcacccagcagagctgcgtgtggaggcaacgctcacctccctctccatgggacctaaatgaccagcatagcacacgcttccttccttcccagcccttcctgtattcccagcccagtccagactagacgtccttctgaccagaagctcaccttagcaaatcccaactgatgcctcgcacgacgtcccctagagacctactgtcctctcacacgcagttctccaaaaggcctcataccccaacccccgagccctgctgcagctttctcactttcagatccacacagaatcccttttaacccctccagttatagggccagaagttgttttgtcaacagtagcaatcctgtctcaccgtctcatcaaccatgcccatccgggttcccccatcacagtgtcaaccacttgccaaacccatctccttcttatcctgtgaccagcaccaaagtctcttcctagctagctaagtctcttcctccatcctacctttcgacagcactctcaggaacgtggaaaaggttgcccacggcccttctaatagtctgtgtctaccattcttggtgctctttattccagcctagccatctaccggtagccatacctaagatgtgaaactacagattttccctatttactgcacagctaccatgacccccacaacatccctcttcttgactgtgtccctcaactcctctaccacttctgtactggttccccatgttctctatgcagcctggggcttaactatccattatgtcaacaatgcagtcaatactcactacctcagctgggcgcggtggctcacacctgtaatcccagcactttgggaggctgaggcgggtggatcacttgaggtcaggagttggagactagcctggccaacatggcgaaaccccgtctctactaaaaatacaaaaattagctggggtgtggtggcacatgcctataatcccagctactcaggaagctgaggcaggagaacagcttgaacccggaaggcagaggttgcagtgagctgagattgtgccactgcactgcggcctgggtgacagagcaaaattccatctcaaaaaagaacaaaaaaaatactccttgcctcaacatcccgacctcccaccaattttctagcccaatcttccacccactttggctgcatattagtgtcctaacatcctgggacactggaaacttgtaccccagatgaattaaattggacccaagtttctgctctgtgtgtctgaagttcctcatgtgactccagcgtgctaatagtgtgaagtgctgctgtacaccgacagctctcaacgtctctcactaggggcatagtcctgatccagtccagtagttctcagggcctggatgcccatgtcccaccctagggattctgctctgacttgctggggtacaggccagcattggggcattttcaagttctcccgatgactctaacgcacagccaagtttacaagacgtcctcagcccacctccactcttccaatgctactgccagactggtcttcaagggcagctccagtcctatccttccccacacattcaaaaatatataatttttcctcgtttcctgttgaattaaacataaacttctcagtcaaaagtggaaggctctgaattagctacctcacatcctcccccacccataagcttcatccaaactgggcaacaacttgctactaaccaaccactcaaattcttttagcccttgttctccaattaactaacctctgtcaactctgcccggtgaaatcctatccatccttcaaggtcctctcaaataagcctcctctacagcacccttcctgatctccctgtccaagagcagggagcaagctgctcacctcagcaggccctgtgagccccagaacaccatctgaagcaaaagaggcactcaaaacaaattttcaattgtgtggctgctgtcccctctctagattctgtggtgataaatccaactcaagcactcatttacacccactacccaaatcagtcaaggataccacagtgggatggcatgtcacctgccatactgccaagcagttaccaaggttggtggtaactcctgcagagatcttagcagtgaaagaacaaatgctgtttgtttaaagtcactgatacgctcccttccttttgtacacagaaatcaataatgttttttctaagtcttgtttccaaaaaactaagccaaataaaaaaaaagtcacttgaataatagaagaacaaactaacaatgataggaacagaagattcaactagaggaagaattatgagagcaaacagtggatacaacggtctcaaacatccagcagagccctgcacacaagagtaggaatggaaacgcagtagaattaaattcagtataagatgaaaaataaagaccttcctttttccatgtatatttttaaggtaaatttaattatccagaaacagacaaaaatgtttgctcttcaccttcaagaatccaccaccccttttgtgaagatactcaggctcagtagagtgcacccgtacacatgcccatcttcgtaacggaatgcctgagtgcctaagatgttcaaaccagtggagagtagcatggcgtgatgctcatggactcctctaaatgtgtgagcaaccggattacacatctcagagtgtggcctaaaagcaagataaatctacgtggatcatttgaatgttttacagatatttaaaaagagagggagagagaggaagggaatgtgagctgattatgaagtcagagaatttaatgagggagacaagctaccaaggtcagattgctctggggtcataaacttggaaagtgactatgaagctgacaaagaagttgggttgtctcaaaggacgatctgaaaataattttctacttttgttattgctaaaggactggagaatttcatttccatggactgaactgagcagtaggatcccaaaaatccagagcccaccccactctttaagctgctctgagaattggaacagctctgcctgatgaaatcaagacttcaacgtgggagagatcaccacagatcaaagctccaggtcttctctaggcaaagctcctttatttcttagattaatgttaggtgggtttttggtcgaggtcaaccagtttcccaaacctttgcttatcaagatctccttaggccgggcatggcggctcacacctgtaatcccagcactctaggaggccaaggtgggcagatcatttgaggttaggagttcaagaccagcctggctaacatggtgaaaccctgtctctactaaaaatacaaaaattagccgggtgtggtgacacacacctgtagtcccagctactggggaggctgaagtgggaggatcacttgaacccgggaggcagaggttgcagtgagctgagatcacaccattgcactggtccagcctgggcaacagagcaagactctgtctcaaaaaaaaatttttttttaattcattttctaaaattctcttttaaaattggataaccaagcttacttagctctgtcaccctaattaattagaggccctatctgaaaaaagaaaatgagtaatatttaggatgaacatgtctgtttggaaaacagtttattagcaaatgtgtgacacctccacagattttaatattaaacagtggctcccagagaagactccaagctgctgttgaggggagcacaagggacagaagagcacagagcatggctgcagtgatgggccatccttcctcccactctggtggagtctatggtactcattagcctgcatctctgtagcctaggagatttggtttcattactgtcaatggcaaagcttagaaaaataaaagtatgatcaaaacttacaaatcagcttcaagggagatcccagaactttcagtaacaaaaggacactgtgtgtgtgtgtacgcacacatgcatgtgtacacgtgtgttttcaaatttcttaaacaggaatgactctgttagctttagataaatcatgtggccaatttttcacctgggaagtgaaaggatggggcaggcagcagaccaagatgggcttaatcctgacctcctgtcaaacacagctgccagcacctcagaattttccccttccctttccttctccttttcctataattttttagattaaaaaaaaaaacttaagacttgctgggtgtggtggctcacgcctgtaatgccagcactttgggaggccgaggcaggtggatcacaaggtcagaagttcgagaccagcctggccaacatggtgaaacctcatctctactaaaaatacaaaaattggctgggcgtggtggtgtgaggatgtaatcccagctacttggaaggctggggcgggaggatcgcttgaacctgggaggtggaggttgcagtgagccaagatcgcaccactgtactccagcctgggcgacagggtaagactctgtttcaaacaaacaaacaaacaaacaacaaaaaaaaacccccacaaaactgaagactcaagaaggggagtggggagatcatactttcttgaggccacacaggtggcagccaatctgagtactgatacccacacctctgactctcaggccagttttctctccacaaaccaccaggcctgtttttcctgcttctgcccaccaacccaccccaaaaatgagttttccatataggaaagagaagagcctggcttatcttcttcaggaggtaactgtgccttccccagagagctcaggtgccaggacgtcagcagccctcagacagcagagccaggagggacacggggcagtggtgacgaagctgttcagggcaactctgggcatcctcctattttcagaataacaatcttcctggtgttcttagcagcatgattcctttttttattattattttttattttttagagacagggtatcgctctgtcacccaggctggagtgcagtggcgagatcacaagggagcacgattcctgaactgggggaacagtgctgagttgtatgggaaggtgtgttagaacagccagattcacctgtgctgcccactgagctctttccttctccatcactcattctcccataatagaacatctcaaccacacgtatcatcagtacacatcaggtgatgttggcaatgaacgagtttttttaattggaatttagaaaataaaaccacaaactggaaggagttggttgctccttccaaagcaagctactgagaggaaaagaacagggacacatccagttaattaattctccctagacggtggcagctcaagagctcagccaaagaggtcactgcactgaagcaatgtgaggtttctcttctgttccacccactcaaatgatattttcttattatcaatcctgctccaggtgctgggccaggttctgtgaatacaaaaagaattaaactacaaccctgccctcaagacttcctagttttgtgtggaggcacctaaatgaacttgtcaaaccaacctggtgcagcagggcctgcaaaatgcagtgacgtcccggccttcatcagtcatgggccactcctcattctaaagtgcctcgtgagcaccctaacctctcagaagaacgagtgttggggaaagaagaatatcagaacactactagggaacattaagcttggcccagcattctagttagtcagtgcacgtagcatccatcctccagacattaagaataatcaccacaggcctagagcaagcaaatgccggccgacaagggaagctggcctcttctgtcaaacagcagtattagagggactctcccctgagctgagtctcaaagccagggtatttgactcaagaaaggaagatttttgagatgactcttttcattaggtgttataattcagagcatgacatctacagttttaagttttccacagtgttcacttcctgaattaaaatttgtcaggacaggctgataacaagagtaatgactgctccaagatagaggtagagcaggtacacttttctttccaggtattttcttgctcctactcaggaaaaacagctcctctcacaaatgctgaatttatagtaaacttatgtagtaaatattgtctaaaccagttacaaaacaaaaacgcttcaatcttgacacaatgagcagctgcagaagtcagaggaatgcatgactcagagtcctacataactgaagccgtaaaaacactgttatgagagatacaatgttaggagaaaacagaacagccctcaagaattcctcattaatttgataatgtaatttaactgtgaggtacaaaataggagtgaacatctctggtctaagatcctggtggccttccgacttcatcttctccatccactccggggcatctttgctcttcctggaacacactcaggcatgctcccacctcagggcctttgcactgtttccttggcccagaattctcttcccctatgtatctgcaaggctagcttcctcactttttaaggtctttactcaaaagtgaactctccatggctaccttaagaaaaagttcaacccctctacctggtatttcctatcactttcctgcttttaattttttcaggactaacacactatacatgtcacttagcaagactgttttaatctatcctccttccccactacaatctcaactccatgaaggcagagaattttgtctgttttgttcactgctgtatcacctggcagagtgtcaatgctctaccaatatttccagaatgaaagaatgaatgaatttcaactagtgagctaaaatcagaactgaatgagaaacttggtaagtaggaaggaatcattctatcttcatgttcacacagtcaacaatcacaggaagagccaaaccgacaccaaactcctctgcaaggaatgcagagccagacagacagatcctgaggccccatgctcaggtggtgaggccaatatcaggcactgtctttctccccttataaccaccaaacacatgctgcttcctgatagctcagtactttgcctcataaatgtggaaaacacactagaattcacctatataaaggtacttcggaaaaatgtcttaaggcaagtgcaaaaacaaaatcaaatctaagtgtcaattagttgcatgcagggtgttaggaaaagaataacaaaacactactagagaagatacaaaataggctggcactctagtgaagatggcaattagggggctaccaaggccatcactacttctacctaagggagacttacttacttactttatatatttatttatttatttttttgagacagagtcttgctctgtcacccagactggagtgcagtggcacaatcttggctcaatgcatcctctgcttcctggggaggtgattctcctgcctcagccttccatgtagctgagattacaagcacgcaccaccacgcccagctaatttttgtatttttagtagagacggtgtttcgctatgttggccaggctggtcctgaactcctgacctcacttgatctccctgcctccgcctcccaaagtgctgggattacaagcatgagcctctgcgcctagcctaagggagactttagatttaagacagaagtatgccaggagagaggaggtagctttaaatgaatgacttcctctcatggtagggttctcatttttcacttcctgtttccttctcccaacattcaattccagttaccaatgtaatatgtctcacctgtgaaaatgtaagactccaatgtcactatacgtagaatgttctaagcacacgcattaaaactgactccaattctgttgctaagaaactgcacaagaaaagggttttccatcctcttcgtttataaaataaccactgtctatgggagaacaaatgcaatctctcaagtccccttgtgccttgttctcattttttaaatgaacagagaaagatgatagagagtggctgaaagtgtatgctatctccatttttttacatgcccttgaaaatgagatggaaacatggcttcaataacccactgctctagtatttattaatctttcaagctgaagactccccccattactccccttactccccgctcaagcaaaaatgaaaaatataccgtcaaaagtactcttcgatttaaaaagattatcccaagcagccaggagtaatttaaggtgtgcttatattcaatgtggggttactttccaggtctctgtatagccctgatgtctaaacacagacgtgtgcgcatgcgcgcacacacacatatacatacacacacacggccctaaagaacagcacaaggtatgctggcttttatttttttaatctaaaagtagggctggggatgatggacttaaaaaaagtaccggttaaagacactaagaaaagaataatcttgttaaacacaaagagcaaaatgggcatactaacttctttgaccacagcataaagaggaagcctagaaagtagtgagccgtggatgtgaatggaaaggtcacagctgaatctgtacatttatcccagaggcgacttctactgacatgaactactgaaatacatttttgaaatatctcttcccttctaataaaatgcttgtcctatttcatttactaaagggttttaaaaatacatttctctttagagcttgttaaacagtagaatctttctgcaaactaattgacagaactgactgccttacaccaacttttctgtgcatataattgatttttaatttgctgtctcatttccgaaaggacttgacaataaactccattctatccatactattgacttctttaagcaagggtttggttcaaaggccgatgggaattaaccataggaaaaatagtccaattttattaatagttggaacttcaggcaaatctcacttgaatctacatttttcttttttaatattaagggctaattctcactataggtcacattaagaatacataatatggagtaatatgtacatacgtgtaatatatcaacatttctatttctcttatttttcctactctcatatatacaaatttagttcttcataagaaacagtaccactgtcatttaaaactggaggaagggtggttagtagagaggagaatctactgtgattcaatttaaaatgtactaagtacctactatgtgatgcagtagatacattgtatctatattttgggttaatggcaaaggttccaaatgaattgtaaaaattttcaagttataatttctttagaaagataatttcaatgttctgactcaactcacatgtatgcaaacctgtacacatacgtaagttgacaatgacataaaaccacgtacgtacataaacaaagaccagaagagagcaagaagccagcaaatgagacgatgaagccagacactgtgagacgacgtgttagtggtgaggttttaaattccctttaatgattttaggatgttgttctaacaataaaaaaaacaatctgcacaaaaccctaaaaagaataagaaagtgaaaaggttcgtactagatgacctacaagactctcctatcatcatttttgaatgactacataaaatggtcaacaactctggaaattttaccattcctaaaataaatataactaacccttcccctatattgtggatgtaaaattttaaaacaaaatcaccaagattattagtatctgaaatccacgtaaccataactacaagctctgagagcctctctccctctttgtcattgtcctccttgctgttttcacctccacaacctcctgctgctattggatcttaacggggattttgctgtgaattccattttcctcagctgccatgcaaacagtaaataaaattcattgtatttttgccccactaagcagccccgtcttctggcacattcagatgcctagcttgaaaagagtgaacaatgaaaacaatgttttctcaagcagacattccaaaaagggcataacaaaggcatctggagatgctgctggggaaagacaccctgcaaatagttgtgtgtattctgtgtaagtaattccttgaccggccgcacgggttcactggattacaaatatttagaaaattactttgccatctcatgtcaattttgaaagaaggattttcatttatatttatgatagactgagctttaaattgaaggaagatttagatgttttaaaatttatgagcttgtaaataaatccatgtacatggccaattaaggtttatcactaccacagattaactatttttggataaaaatttcagagcttatttgtatctagattgttcacctcaatgtattacatcaaaattgatataaaatatttaatgggtagtgtatttcaagataaaagctatagttacccaagatgaaataaaaacaccctgtagtaacatggtaagcaacagaaccttcactttgtgcaacacctggattgttgcggaaagcgaattcaacatgaaaataattttaaaaaccaaaacgcagctaagtggataggaagcaaagagtgagatgcacagctcactggagcacccaatcttacaatcttgcaagtcaaaccaaactccacaaggaaaatgcaggccctgaattttaaaaagaattcaattagcatccccagtatttccataatcaacagctgaatgctaattaagagcacagcatcaagcggcaacggaatcccagtgcaataagcaccaacacaacagcagcaaatgctaccttcagctcgcatgcataaataaacagaattaataaccacccaagcatggaagggtgacttaatctgtttcgattaggtgcagttcagcctggggcctttatgttatatttgaatgtgttcatcatgtttaattaaaaacctaataatctaagatttgttttgtttgggtttttttttttaatgttttaatctctatttcctcctctttatcttcctaagttctaccaatctggatgacttcctgaaaaggaacagtatttttagcataatatatgtgaaattgattaaccatcaatgtaactctcagaggcagaaggcagccatttactttggctccacccttacccataccttggtatttaaagcttcacaaactgacctagcatttcttccaaaatgcttctctgatcaaaccaagtttacttagcctgaaagacatgacccaggtgttgctcacagacactcggcaaaagcaaaattaatttgcagtatccggtacagaatttgacagaaactggcacattttggcttcagttcaagatttgaagtgtctcagccccaaagcaacttcaattaggaacatcatacacgcacactgtcagagaaataaactgagagtttgagatgaaaggcctcctattgtgtgattctgaggtctaagatctccagaattcatgattatctgaaagacctaggaaaaagaggtcaggtgataggaggaggaggaagaggagaaggaggagtaggaagaacaagaagaaagagtttaatgtgtgagctttttccaaaagtacttttattattattattttttttggagacagagtcttgctctgttgcccaggctggagtgcagtgccatgatcacggctcactgcagcctctaacccctggactcaagcgattctccaacctcagcctcccaagtaactgggactacaggcacatggcaccatgttcagctattttattatgtttttaatttttttgtggagacaaggtcttgctgtgttgaccaggctccaaaagtaaaatttttaaggttggtttctgaggcatgtaaaagtttttctctttaatgtgctgattcataactattaactattaaaagttttaaaatgctggattgaagacactcaattatagtgaagaactttttaaaaggattaccttgaacaaagagtcatcaatattcttcaagcctctcatatggagagaaactatcttcatcattaagtccttacccttaataagtttacaaactcggaggacaatcaactcagaaataagaccgcaaggaatgaagagctggggatcagaagtcagcacgaggaggcagaggatgaactgccaagcgagtgacgcgcagaggggagacagtgcgaagagggagcactggccgcgggatgggccaggaaccgagctgagactggagaacgagtagggtctgcactggcatgagaggttagtttcttcatagagcagcaggcctgccaggcccaggaggtgcagaggcccagcctgtccgctgcacagcagggaactcacaccttcaggtgcttatttcaccaaccctctcacagagcagctgcttcaaagtattcatgtaaaaatgccaagggaaacccgttcatcaagactgttgtagtcagatcagacactgggtagttagaacaaattaatatgccagcggcagcgaagtttagtaataagtagccaggcattgtggcttgcctgtagtcccagctgctcagaggctgatgtgggaggatcacttgagcccaacagtttgagtccagcctggacaacatagcaagacccccatctcttaaaaaatagtaatgataataataaaaataataattagaatgttccaagtatatagaaaactgggaggaaaaaagggggaggtaggcccatgtatttatgttagctggaacacatttgttttgcttattcctgtgattcctgaggtgagaaaatgtggtaaatttaacagaagggggccacatgaacacagcaggtgttttttcacagccaaagccaggcgagggtaaagaggggactgccttgttgccacataaatctcttcaaagatttgatttggatccattcaccagaagcttccttcaacctctcaattattcagtcagtctctcttcttcactgctgaggttttcaaagtgaagcttcacttcctacacataagggaaccatttgatcctgaggctctacaagggctggatggctgccaagacatttttcaaaccaagaagcaaacatgataaaaatgaccccaaacggatacggatgtatacagttaaggatcattattccatactcaaaatattcaccactttggagtcctgttttgtttttcaaaataaaccaggctctttctgatgtgcaaaacttccctctcagctcacagcgacaaatcctcaagcagcagcaatggggagacaatcaacagctgcctgatgttacaagcaggcgctgcaggaaaaggaaagcagctttctcttcagcaggaagagaggactttggctgtgtatttttaaaattccagagggaatgaaaggtcacaagagaaatgaaagaagggagagaggagagccatggctagcgaggggctgggaggcatgagtgaggagtggggagggtgggagacaccaagaagaggcagggaagtggggaaggagagaggacgccaaagggcatggagactgaagagagaggagatggccaggaactgagggaaatgcagaagcagaagcagccatggattgcaagctgacaaggccctgaggccgcctaggccaggctgagaggactgaagacaatctcacaaagggtggttaaacgaccacagtctatacacttgttccatccttttcatctccttatgtgtttcttccacacaggcttttcgcagaattttaaaaccttgtcaatcagatctcttatccactcctcacataaacaggcttacagtaaaaaaacagtatcactacgacttctcaaaactgaatttaacgttgtctaaacattttaaaatgtttaagatgtttctttctctttaataataacgttaagatttttatggttttgtttgttttaaaacagcttcatgaactctgtaagtctgataaagttaaagtcttaaggaactattcaacaagcactccattaccaaaccctagggccatttcagtgcatctcagctccgcctagcttttcccattcctcagcccttgcccaccctcacccacagccattctaggagcaaattctcttttctctaccttcaaggtgcagcctggatctcgctgcttcttatcacgaccactgctgccacaccacccagccaccagtcccagcctggtgtgcagcaacccccagagaccaccggactcagcggccagtgtgagccccactgtcggagcaagtcactcctctgttcagaagctgctcatgtggggcacatcaccatgccctgacagcaggccaacaggtcacacctgatctgctccctctagggcacccctcccaccactcccctccttgctgtgttgcagaaacattcctgcctacttcttgaacatgccaagcatgctttcaccttagggcccagaattctctaatatccaaaaggctgccttcctcaccttactaaggtctcatctaaatgttacttaccaggactttcctgatcctcccttagctaagacagtaccccacccagctgattctccctcattaccctattctgtatctgcttcaccacccccggcacatactcatttatgaaggtctcccctcttaaaacttaagactcccaaggagggacaacacctggcacgcaagcaggcactcagtaaatattgctgaatcaatgaaagagcgggatcaggaaagcacatacaatttctaaacattctttcttagcatattttaaaatacaggagaggaacttgcaatcaataggtgtattagtgccagccttcatttaaatttcattcgacctgaaaggcaaatgtcaagcggtaacattcatactgaagactgtatttgcaaaagcacaagaaatccgtaagtcgtttacagcaatgccttttacaagtcacaagatggagatgtagcttcattaaaactgtctgctggatgggaatccatgggtttgcaaggctgtatctgtgggcacatttctctccccccacttccttcaacaggccacagcaatacaatcagtatgtaaaatccagcatatttatttcatcaactctctgcttcccgcttgtaatcaatgtcctttaaggaggtcaggggtcttacaagccctataaaaacaagtcaccaagccaagcatggtagagcatgcctacagtcccagctacttaagaagctggggcaagaggactgatggagcccaggagttcaaaaccagcctgagcaacacggcaaaacccccttctctaaaataattatgattaaaaaaaagacaagtcaccaaccctactttaggttatatgtccacgggttttaacatgctgtctttaaatagggaggtatcacaagctagcttgcaccaaaaacaagttcaaattaactttttttaggagtaactatcaatttctcctttctttccatgaaagttggacaatctttcccgacatctatgaagcctaatcttaataaaatcaagtctttctgtacaattaaggggctgaagggccccatcctcctgcctggcgctgccacggacagccattctgcatgactgaagcttctgctttccctgagcagcagggaggtcacacactgagacgccggtggcccgatgccccagagcacaaggcaaatgctggttcctgctcaccacttcgtcctcggtccagcacttctcgatgagcttgggcacaggcttcttcaccaggcgctgcagggctttgccagcatcgtaaccgctttcatgcagctaaaacaacaacaattatagttagctaactgcaccaaataacagacaggacacaatcgatccaaggcaagctcctcattgactatctcccacagaagagtcaggaaaggggcactgagactccatcatttcagtaggcgcaggaatttgttctcatccaagaccaccctatcccaacccctattctactcactctgggagagggaggcaggcaaggcagaaaatattttggcaaagataggaataggattcccctatattcccataaagcaaacatttagggaatgtttggccccgcccagtgctcaggacattccatgcaatcattatcttacttaatcctatggggaaagtattctctcatttaatctacggtttaggagctatcatcgccctacttcacagatgaggaaactgaggcacagaaagatcaagtaaagatgttcaccacactgagccagcaggtggtgaagccaagactccaacccagccaggaggacccctactcttgcctcattctccgcaaagcagcgtaaagtcacactagattatgttctttctttttagcatttcttaagttttttgactgtgctaatttcacacaaaaacaaaatatttaaagtggctaaaatttaagagctttttaaagaaagtaagtctgtaatagtatgctagtttttcagtacatatgaataaagatgcaggtttatctacatattccctttaggaccagacttgtttcttgtcaaagctaatcaacttttctcaccctgcgtcttttcaaccctgtgtagtgtctggcaccatggacaccttcccacctcgcaaagatgctccagacactccaagtttctgagttccaacttgcagataatgtagagaaacagcaggtacaaagatcctcctgctctatctacctccccatactgtggctgtcactcagaattctcattggaaatccacctttcctgtacacatctagtcttcttacacaaagattggctttgtctaagacttgcatctccagtgctgaacacagtccatagtataaggtaatactccagaaaaacttgctaacttcctaaataaaatactaggttctgggacacagcagtaaacaacacagagatccccgttctcatggagtggacgttctgatcttttcactcgtgcttcaatctcttattttaacaatgagccagcatttgccgaacattcaggtcaagtaaagctgaacattcaagacatgtaaagaataaaccttaataagtcacagtccttatttccaggaaacttacaaattggtacagatacaaaacatacaaaatgacaagatcaagtaggttgtaataattactcttgcttaggtttaggcaaagacctatggaatcacaagaggagacagccatgtgtttcctctttctaacagaagactccggaggacatgcagatgccttcctggcaactgctggagcccctgggctgggcacacagtaagctggcagtggtaaatatttgttgaatgaaatcaataaataaatgctgagacacacactgcaagtctctcttccaaacatttaactgccaacaaaaggaatatcacaaacattcattttcttttatttttttctttttttttgagacggagtcttgctctgttgcccaggctggagtgcagtggcgcgatcacggctcactgcaaactctgcctcccgggttcacgccattctcctgcctcagcttcctgagtagctgggattacaggcgcctgccaccacgcccggcttattttttgtatttttaatagagatggggtttcatcgtgttaaccagaatggtctcgatctcttgacctcgtgatccacccgcctcggcctcccaaagtattgggataacaggcatgagccaccgcacccggcccaaacatccattttcaatgctcactcagcaaaacagaaagtattaaaaatttgaatttccagagcattctcacagtttagagggcactaatttattttaaatcaagactgggaagtccaggttgtacattagctataagaataaatcaactatcttaaaacaaaacaaaacacctacaacaatgatcaatactggatcccacttgggagtggtggtgcaatgaataaatattaacttatttatttttattattatttatcaataaattcgtatttattattaccattagactcttttaaaaataaaatactattatgatttgcaaatgtttgaaaactatccaacctaggcttctttcagacgtataaaaagatctgaaataaagtcagattctcatactttgcctaatatccagaacaagcagacatttgtcaagttctataacacaatgggggtttataatcacaggtcaacgtggattggaactgaataaaaggaagaattacatgcctatttaatgcaaaaagcacacattttagtgataatttgaaatcaaatgaagttgatcaaatcataaatttttaatgaaaagctcatggcaaaattaacaacttttataagaggtaattatactgtatggggtaattataagaaaagtatgaggctaggcacagtggctcacacctgtaagcccaacactttgggaggctgaggtaggaagattgagttcaggaattcaagactaacctgggcaacatagtgagacctcatctctactaaaaatttaagaaattagctgggcgtggtggcatgtgcctatagtcccagctgcagtcccagctactcaggaggctgaggtgaaaggacggcttgagcctgggaggttaaggctgcagtagtcttgatcacaccactgcactacaagtccgggtgacagagtgaaaccctgcctccaataaaaaaaaaaagaaagaaagaaaaaaagaaaaaagggtaagtaggaaaaactatggactttggagtcaaactgcctggattccaactctagctctactatttactaggtatgcgaccttgagagagttacttatcatttttgtgccttaattttgacatctttaaaaatggataaaataataacatcaacctcttagcgacatgtgaggataatattagaaaatatatgttagctacatcttttaaaaagaaaaaaaaaatcggcctcaagtgtgatcagctttccagattacagagtagtcttctcagaaacaaaaaattttgttaagctataaacaaaaaccacttatgtgtcatataaaattacccatgttaaatgagatttgattaaaactctggtctcacatacaggaaaaaatttgaatttcaaaatcttggctgggcgcggtggctcacgcctgtaatcccagcactctgggaggctgaggttggtggatcatgaagtcaggtgttcaagaccagcctggccaacagggtgaaaccgcatccctactaaaaaactataaaaattaggcaggcacagtggcaggggcctataatcccagctattcgggaggctgaggcaggcaggagaatcgcttgaacccaggcggcagaggttgcagtgagctgagatcgtgccactgcactccagcctgagagacagagtgagaccccgtctcaaaaaaataataatagtaataagaaaaataaaatcttatgtgcctgctaccaggaaattgctcgtgagaacataaagcccactccaaaagcaaactgctgagtggatgaagctcaatcaaatatcattaatccctgtggcattccggccttttggtgaaccaagaagagttttaaactatagctggaagagatgcttccactgaagtgttgaacatctcgttgtggttgttccgtttgttagagagcatggctgcagcctgcacaatgcccctcagctgaatttctagtgatgagcttaatggggaaagaggcactcctctgaacaagtcctggcattcctacttccttcacaaaactttatttcagatggcagtttctcctgaagaagctattccagtgacacggtaactcgagcttccttccctactctgttctctatataatggcggattctctccttttgtttgacctgttgtctggctggcctcttaaaatatccctattcctcaaaaaaatagtccctattcctgagtttcccatgttatcagtaagtattgagagtccctacccgtcctcacccctacacaaagacacatctgagaagtaaaaagtgtgggattatttacccaaagtgacaaatttttttctttctttttggagatggagtctcactctgttgcccaggctggagtgcagtggcgtgatctcgactcactgcaacctccgcctcccagttcaagcgattctcctgcctcaacctcctgagtagctgggactacaagcgcccaccaccacgcccggctaattttttgtatttttagtagagatggggtttcgccaagttggccaggctggtcttgaactgacctcaggtgatccacccacctccaaagtgctgggattacaggcatgagtcaccacgcccagccccaaagagatatttcttgaatggatgaaggaagaatattattgcgctatcatcagtgtttcacaggggcaagttcaaaacttggtcaactggctgttctggtgtgccctcctccttaggaaacctaagggactctttcctccttagggaaccaaggggactctttctaaaggggcactatcttcttaatgttatagacattgacttctaccttgtagaaatcttgtctgagaaaattctgagacatctttaaagaaataccttttttttttttttttttttttttgagacagagtctcgctctgtcaccaggctggagtgcagtggcacaatttcagctcactgaaacctccacctcccaggttcaagcgattctcctgcctcagcctcccgagtacctgggactacaggcgcgccaccacacccagctaatttttgtatttttagtagagatggggtttcaccatgctggccaggatggtctcaatctcttgacctcatgatccccccctgcctcagcctcccaaagtgttgggattacaggtgtcagccacagcgcccagcctttttattaaagatacacttttaacatactagaagttgttatggactacaacagcttcataatagggaaacttacctttacaacatttggggaaaattactggcgatcaggacatctttctttccttcgacacatttactgagtgctcaactatgccaggcactctattaggtgctgggatatatcaaatagcccttctttttttctctctttgagacagggtgttggctctgtctcccacactggagtgcagtggcacgatcatggctcactgcagcctcaatctcctgggctcaagcagtcctcccacttcagccgcccaagtactaggacagctgtgcaccatgcctaacttttgtattttggtagaaatagggttttgccatgctgcccggggttgcttttttttttttttttgagaaagagtttcactctgttgcctgagctagagtgcaatggcacaatcagcccacttccgcctgaattcctgggctcaagcaatcctcctgccgcagcctcccaagtagctcagcttacaggcatgcgccaccatgcctggctaattttttttattttttgtagagacaggaactcactatgctgcctagtgcggtctcagactcctgggttcaagtgctcttcctgtctagacctcctgaagtgctgggattataggcatgagccactgcacctgccccaaataacccttcttaagacagagtctcactcttgttgcccaggctggagtgcaatggcatgatctcggctcattacaacctctgcctcccggattcatgtgattcttctgcctcagcatccagagtagctgggactacaggcgcacgtcaccacgcccggctaatttttgtatttttagtagagatgaggttttgccatgttggccaggctggtcttgaactcctgacctcaggtgatctgcccacctcggcttcccaaagtgttgggattacaggcatgagtcactgcacccagccaaagtttttctttctttagatgaggataatgttcaataaagagctaaactggatatttcaactatattccttacataaagtagaattggtaaatttatcaaaacactggctatcttaaatctctaaaaattgccattagaaacattcccctctaatacaacatcaagttctgaaggattgccataatttcatactgtgaaaaacattacgtagatttcaaattctaaacacctgatcacgaccacacagctacgtctatagtcaggaaatttaacacaggcttccccatattgctaaggtaaaatgtcctttaatgtgaataagattttctaccgttttcctaagaaggctgtgcaaaatacattgcaatgaagatggggaaaaagaaacacctctcaaacatcttacagcttcactttgtagccacagaaaagcaattaaagcaaaataattaaacctttctgtccattttgcagccaagtcaggctggtaaaatctgggattaaatgcaattttaatgtagagtatagagaactgtacattttggagctactgtaaaaagatcagtacaaaaagcagggaccaagataaagcatcttgactcagtgagcttacaatctttgaaagctagggaggggagaagcacttagatcttatgctgcccccacgcaaccactatagcaggatgtcattcagcagaaagcactttcagattcatcaccacaggtgtgtggcagtggtgcttttttttttttttctaaatccaatgatcaaggaaacatttacttgtaaatctttccgcctcttttccacatcactaaactgcatgactgcacttctacccaaataaaacctgtcttccctaaaccacaggttaagacctaggatttatgattagggaatctgataacaaaacactgatttcttgaacaatccaccagcctttcaagtcattccatctcagaactatgcctgttttgctgttttctagcaatcggcctttggtctctgggtgtgctccatggaatcctctgagatgtgattttttccttcgtttttggttgttcattgtgaaagaacaaatgtgagtgaactctttccctatgtggtgtctagccctcttctgccacaccttctgcagcagaagtccttggtgtccttgaacccagtaggacattccagcctcagaggcaggctgctcacaccatactctctttgcttccattcattcaaccaagaggtaccaagcaactctgcctgctagcaatggggagggatacagtggtgtgcaaagacaggcatgcatgaactatgcaaagtggacctcatcgcggattttggtgctaaaaacaatagtaacttctgaataataaacacttaatttggctccactataacaaaagtaaccactgtactgattcattcagagccatactgtgccacaataactagacatatttagctagttgcctaaaaagctctcagtaactaactctgggtgctacaataaattaacaactagtcaataccttctgcagcctactgaaaatagtacaggatgtgaggcaagtgacagattcttgctaatagccctgtcccgaaccagttgagttgaggttttcatctgttaaatgggcctaacaccaccagccctcagctgggtcacagaaaaatggaaagtgctaaatgagacaaaatgtgtcaagacactctgaaatgtaaaatagctgtaagctgtacagtggtatcatcatggggagtaatattttagatacatggctcttacctaacactattcaaacaagaggttcaatagagccaacaatgccggtagtcactacacatctgcaattgtcttactacagcctctgacctcctcctgattagcagaaagaaaggatcatgctacaagaaaaacatttctgcataattgcccaagttaaatctgctactctcactctgcctgacaaatcattccatgcttactttctataatttaatatatataagtgctttactggcaagcttctcgaaagaataaataatacttaatgactgcctacagtttaattaactcatgattgaacttctcatggattgctataaacattaaattatatccttcctcaaagctaccatggataaaaatcttgtttaaagctttaattctcttgcctaaacaattctgaaattccagcaaatctgtatgttgcacagagaggtgagagaatccaccttaacgcatggttataaagcatgttattttatagagcaaggatgaggccttaatttttataagattgaaaatgtgcacatgtccaagcacctcattaatattacagcagtcattaaacatctctggatctcaggcagtcttattagcataaactctgcgtattaccacaaggtttcaagtttctattctggcttctcatcttagctaccattttctgtctgcgtgatgttgcaaataaattttccttttggcatggctcagctgtcaggcacctctgttctataatgaacccatgaattacatctccctgctctgacatctctggtctcacacatcaaaatattgttcttcaattgtaatttataacttaatttaaatgtcccttttcccgtgacctttttagatcaaatggcattgcatctggcagtttctactatgccaaagcatacttttcaaatatagccattataataactatataaaaagcctacttaagttagactgcattcaggctaattaaataattccagtccatgaagaacaatattagatatcaaagtcttttgctatgcaaaatatctgtttatacatcacaagaaactgtcaaaataactgagaaaggaaaaaagtatttggaataaatcttaaaattcttcatatagttttaattaattatttcgactattaagataagtgagaaagaccttgccgaaatatgttcaaaacaaaatttaaaaatttcttagccacgtgcagtggcttacacctgtaatcccagaactttgggaggctgaagtgggcagatctcttgaggtcaggagttcaagaccagcctggccaacacggtgaaaccctgtctctaccaaaaacacaaaaattagccgggtgtggtggcgcgcacctgtaatcccagctacttgggaggctgaggcaggagaatcgcttaaacctgggaggcggaggttgcagttagccgagaccgcgccactgcacgccagcctgggtgacagagcgagattctgtcttaaaaaaaaaaaaaaaaattcttggctgggcgtggtggctcacacctgtaatcccagcactttgagagaccaaggtgggcaggtcacttgaggtcaggagtttgagaccagcctggccaacatggtgaaaccctgtctctactaaaaagaaatacaaaaattagccgggcatggtagtgtgtgcccataatctcagctactcaggaggctgaggcagaagaatctcttgaacccaggaggcggaagttgcagtgagccgagatcacgccactgcactctagcctgggcgaaaagagtgagactctgtctcaagagaaaaaaaaaaaaagaaaagaaaaatttcttataaccataattcacaaatgtcaatacattttcatttatacctccatcatcgataacctagtgccaagtcaatatatatgaaacatgtaaatgttaaaaaactagaattgaaactaagagcacaatatttatttttatttggccattatcatttcaaataatgctattaggtaccagagaggctaaaatttgtctgaatggtcttacgggagcaaaattcagggataatggaaaagacaaagaatttaactgcagagggtagggcttgagagaaaggtctagttaattttcagaaggaaatatagttattgaaccaatcttccctccctctttccatcactttctgaaactacaatgttccaggaattatgcgccagccctggagtcacatggaagaaaggagggggtcgcaacatttgctgagcagtgcacagtgtgctaggaactgtgttaggtctttatgatttcatcattccacacacctctcttccacagccagagtactaaaaatgaggaaatgaaatccagaggttcagtatgtttctctaggccacttccctagcaagtagcagcatgaggattctaacataaacccatgttctaggaagatgtccctaccctagaatgttgctactggggcagtttaggacaggcaatctggtgggagcaatgggtacggggactttttccgctgcagtgacaaagcaagcacactgtcttttcttaacttggggctaggggatgagggtgggtggaggaaaggagggagccagcagctcagaaaagaggaaagacacacatgtaaacaaactaacaaaaaaatccccatccatgaaaacactcacagtgctaaatgaaagctgatggggatgacatttgctcagtctggaaaatctaaaatgcattcacaggggaggttttgaaaatcaacaaccagtataatatgattaacttgcctatgctttatgaacagcaacaaccacataaaaaacactattctaggagaaataagcagtgctattattgcagtaaaaacaggctacacgaggcagggcggacctgcgtccttcgcttctttcgctgtcacagaagaggctgaggtaggtcatttttggaactttccagtattcaacattccttcacttaacaaagattttttcaaaggcaaaatattatagaatattcttctaaaaaggaataaacaaatggtaataatgttaatacattaatttagaaaaataaaaaaacaataaaaccattgaattaagccacattccccacgccaaacactaaatgaatggctcctgcacaggcttcacttacactttagggattaaggttgtgcctcttaattttcaagtctctgtgaaagctgaagtttatgccacaggtctttaaatgcaattatggataattaatcatttacatagttaacatgtctacagcctgacttctttttttataaatgcgagatcagccacagaatagtagaaagggagggtgcggagggtgtaggctgcttgccggggcaggaggactccacagacgcagtcaataatctactaagaagactcagcttgaggacccacaatgagtctaactctggccacagggagaaaagctcctggcacattcgtgaacctagactgtttatgctgcttttctcaataattatttgtcagctgagaaagacctatgtctggccacaagtggaaatggttcaggaccacaaatggaaactaaaatatgttttcacttactcctggcatcctcatagccttgaaaacagaaaaaaatttgtgacatgaaactgggcagaaggctggaggatgacataaaaaccacaggtctaagcatctcacgtaggcactagtgaacctactcatacatgctaaattgacctagaaagtgtatgtgaaaggctttcacacaaaaacacaaaatcaagaccagttacatcagtattaagaaacatttacagtaactgctttaaatcctacttagtagaattgaggtacagaaataactgcccccaatccaagggctcagcagtctgaatctcagtgctttgtgatgagtgattctaaggttatgcaaacaacagtccacctaatatttttggcaatgataatgaagttatggaacaacgaagaccgaagaggcatacactgatgcatataaagctccagagttgggaaaatatacaagcgactgtactttctaaaaacttcagccaagaacacagctttagtaactaagaaataagcaaaaagcctctgggcaaccaaaacagtgtccccaaaagccaaaggccctggagagccaggaagctcccactctgagctttagacacttagttacctcacaattctagctttcccaatctaataacaggtctcaaaagaaaaaatcagaaagactgtatgatttcaaaagagaagagcagcagcagacagcctgactgtgggagacacaaaaatttagcaactattatgcaaaccaaagagctcaaactctaacagttgcacattcttttgttaacggacaccagtaatgatcactcagaggcatcgagtaaaggtggacttgacttgagaagatatgaaaatgtattcctcctcatttctaaaatggaagaaaaaaagtaaagaaagaagaaaaggaggagaagagccagttttcctaaaaatgctgggataactagtactccaaagtgctgcagtggctggaatacacagcccaacaaataccaggtgtggggagaaggcaggccactcaacaaataggggagcaggaaggacaggagtggggcgccccagtgtcattacctatgaaccccagaaagttgctgggtaagggggaaacatccaagattctggaggacagggctggccaggacaacacaggttgtcagagtccagtggggctgggctctgggcagggctgtggaactgaagctaaaacagacaccagagacttgaaaaagctacagcttcaaggattgcctgagtttatcccaggccagctcaaagaccaaccttaaaacaacacaacttgcccacaagggtcactaatgagcaacaccttccctactctatcaggcccaggctaggactggtgcaggctggacccagagttttgaggggctagggtagtggctgaggaagaaacaacctgggaggtcagaacatatcaattaatatggtagttatacatgacaattttgttatctaaataaatatccttattctttgcataaggaagccaaatactccctattttataaatcaaatgtcctcacattacagaaatatcatagccactactagaaatatttttatacattctcaatatcagaaactccacactttaaataagtcataacagctgggcaaggtggctcacacctgtaatcccagcactttcagaagccaaggcaagaggacttcttgaggccaagagtttgagaccagcctggacaacacagtgagcccctgtctctacaaaaaaatttttttaaataaataaaaataagcaagtcacaacagatgcaaaaataataataatgagctattttttaaattttttttaaattttttttaaatttcaaaataagtaatatattttagtaatattttatataatagtcattttaactgtggtaggccaaaaaatgaccaccagaagatatacacatcaaatccctggaacctatgaatgtgaccttatttgggaaaagggtctttgcagatgtgctaaggatcttgaaataaaggagatgattctagataactcaggtgggccctaactccaatgacaagtacttataaaagagaggtggtgaagaaacccagactggagaagacacagacacacagaagagaaggcagcgtgaagatgagcagagaaagatggggccacagccaaaatgtgcaaacagccaccagtagctacaagaggcgaagagtgggctctgccaggaggagccggagaggtaccccactgacaacttgatgtcagatttctggcttccagaactgtgagagaacacctctctgtcgtttaagccaccaagtttgggtaatttgttacagtagccacaggaaacaaatacactaaccttcaaaaactggggataaaaaattatttaagagagctataaaaaagcattctgaggtgtttccaaaatataggaaatgaatactagggcaaatattatacattttagaattttgtagtatgctgtagaatacatgagcccttctgaaactcatgggcctgatttgttctaacaatgaggtgttcacttagattctcatcaaacaccctccccacaagggctgcagaaactcaaacatgttaattaccaaataaataaatgaatatatgattttattaaagcctttttttgttttttttttttttgttttttttttttttgagacacagtctcgctctgttgcccaggctgcagtgcactgatgtcatctcggctcactgcaacctccgcctcccgggttcaagcaattctcctgcctcaacctcctgagtggctgagattacgggtgtgcaccaccacacccgactaatttttgtatttttagtagagacggggtttcaccatgttggtcaggctagtcttgaactcttgatgtcgtgatccgcccgccttggcctcccaaaatgctgagattacagacctgagccaccaggcccggaaattttttttttttttttagacgaaggcttgctctgttgcccaggctggagtacagtggcatgatctcggctcactgcaaactccacctcccaggttcaagcaattctcctgcctcggtctctcaagtagctggaattacaggcatgcaccaccatacttggctaatttttgtatttttagtagagacggggtttcaccatattggccaggctggtcttgaactcctgacctaaggtgatccacccgcctcggcctcccaaaatgctgggattacaggcacgagccaccgcatccggcctaagcctgtttttaaatgtaaaaaggctaaaggtttttttatcaatttgctgaagacattgtgttattaatactaatataggctcaaatatgttaaaattctaactgatcaaacggtaagtggatgtttttataaataccacatatatctcaaaacattttaccactctttaacatggaaaaaaatcatctgataaagaagtttcttaaatgagtaaatgaactttctaacttatgccaaacaaaagtaaaagctgaatcacatcacattcctcagtccctgctgagcacctaggaaacaggaaggagatgcaggaaaagctgtggcatgaaggatttctgattggctaaacagcaaatcctccaaattacagattaaccagacatttctttctgtttctgagacggggtctcgctctgtcaccaggctggagtgcagtggcgcgatctcggctcactgcagcctccacctcctgggttcaagcgattctcctgcctcagcctcccgagtagctgagactacaggagcataccaccatgcccagctatctttgtatttttagtagagacagggtttcaccatgttggctagaatggtctcaatctgttgacctcgtgatctgcctgccttggcctcccaaagtgctgggattacatgcgtgacccaccgcacccggcccgattaaccagacatttcaagaaggcgctataaggtactggcctcaatttaaaccaagtttaaatagttatgtatataaatattgtgtatataaataagtgtgcttattaatttttagatgataaccacacttgcctcatagaattgttatgaagattaaatgaattcattcataaaaagcacttaaacttttgcctagcatataaatactcaaaccacaaatacatttcaattttataatcaggaagctgaccaatagttgataccttaaaaaataaaattaatagtgatgaacttaaggtcctatgactggctcaaaattcagtggaaaagctcagggtgggaaagaaatggcttatcaaaagcacatatacaaggaaaaatgaaacataacaagattacaacacaggactaaaaagaatgtgatgagcagacattcttataagctgagactgcactgagcagatgagcttttaggataactgaggggtatccctgggtcaccttatgttggtcagacctgaggagtgttgcttagtgcaggtgccacattttaaatgacaggcgaagcagaccaggaggataaataaaatggtaatatataaaaatggctaataccaccacacggatgatgcctgaaaacagtaccccctcagtaaaagaaagcagtcacaaaaggccacttattatatgatgccatttatatgcaatgtccagaataggcatatctatagagacaaaaagcagatgagaggttgcctagggctgctcaataaaaataaaaataaagaacctaattggattgtaaaagtggccttttatctccccatccaccccagagaagtttaggtaatgctctctctcatgtttagggaaaagaagaaagtggggtataaagtttgactttaaataaagctacatattatctaaaaagaaacaaagtactaaattttaaaagccatttcattcaaacaagacaaaaaataggctgggtgtggtggttcatgcctgtaatcccagcactttgggaggctgaggcgggtggatcacgaggttaggagatcaagaccatcctggctaacatggtgaaaccccgtctactaaaaatacaaaaaaaaattagccgggcgtggtggcaggtgcctgtagtcccagctacttgggaggctgaggcaggagaatggcgtgaacccaggagttggagcttgcagtgagccaagatggtggcactgcactcgagcctgggcaacagagtgagattctgttgcaaaaaaaaaaaaaaaaaaaaaaaaaagacaaaaattaaatcacgcaatttgtgttaaaatgttgttacatggaactttagaagggaatttatgaatttcttagcccaaaggaagccacacaggtgaacacctaaacacttaattttcaaaacaatagctcaaaatgtttctaaaactaaaaaattttcaaaaaataaaagttgaaaattatatattattatgctaataatcagctgaaaaggtcttggttataccagaaaacctcaactgcgtgatctttttctgcatcctcactaatgctatgattaacagcacaactttctgttgacttcaatatcctgttattacataaataaaacactggcaacagtgcctgtcaaggctgatttatatgatgtgctgttctgaaatttattggatttccataataagaaatcatagagcctatcagctttacccattagactttccaacaacaaataaaaaatcctgaacgacaagaaaacccaacatcttaccttaacccaagccagcaaacactaaccatttaatgttgactcatctggatagaaacatttaagtaaagggtgtgggtatggaatgaatgtcagaaggctcctctcacatgcttagggaaaacttatgaaagggcctcccggcaatgccttatttgggagctgagaaatattccacattcaagtcataagcactgcaaagctaatccaggtccagatactttagtgaaggccatttataatgaacaaacaaaaaatctgacaaaaattctatggacttaattttttagaataaaagagaaatgaaaatgatccttagaatagggttatctgcatattctgctatgccaacttcctaacatcaatttctggatgatcaagtgtgatatgaacttgaacttgatttatctattcaatcattcaacaaccatttagtatctctctaccatgtgtcaggcatcagactagggttagaaaacacaaataattaatactcaacagttaacaaatagtgatatttatagaccagagatgaaaaactatgaagccactgggagccttgaattctttgctgaaggagatgtgggtgtgcataaataaataagcaaacaaacatgtactctcttgaatacataaagagcttaatccaaacgtctaaaagccacccgtatctcagggaataaaactgtccaggcggaggtgaaatctttgttgcatgattataaattttacttacacacagtgaatatatagttatgtttagtgttggtgagaaaatggcaataaattactgagaaagaaaaagcaaaataatttgaattgtattagaaaccaggaaagatacctgagcccaaagaaggaaatccaatatcagtttagtaaaaataagttggcaagatatattctagaaaaccttagtctcaaatgatggggcttttctgcagtttctaagtaggaatataaaggtctattttgtaaatagccaaataaatgtaagcactcaaaggtggctaaattaaccccattaggataagacagatcatctccatgttatatagcatgatgtttacaaattatatgtcagctgcaagtgttcagatgagcctaatgcaaacactgtatgaggaaacacacacagaaatatttccacacaagatctttctggggaaacaccattacttcttcatatttaacataagcttatatttaatatataaaaatacaaataaaactttttttttttttttgagatggagtctcgctctgtcgcccaggctggagtgcagtagcgccatctcggctcactgcaagctctgcctccaggccacaccattctcctgcctcagcctcccaagtagctgggattacaggcgccaccatcacgtccagctaatttttgtaattttagtagagatgaggtttcactatgttagccaggctggtatggaactcccagcctcaggtgatccacccaccttggcctcccaatgtgctgggattacaggtgtgagccactgtgcccagccaaataaaacaattttacatttataggtgttcacatttgaaatattaaaataaaacatatcattgctacatacaaaaaggaatacgcccaatgttactaagaaatccctcttttcctaatgagagagaccaacatgtttattacatcttcttcctctacagcggtacaaagctgtttcttatgtatgaaaagataagaaatgcatgttaacataaatgaacaaacaaagaacaactgtcctgaactatctgccagttcactattggaccaaaagtagcaagtcatgtggccatgaaaataagatatttattaactacctctgtgattcttcaatgaggcctctactattaagaatgtgggccggatccggtggcttactcctgtaaccccagcactttgggaagccaaggtgggcagatcacctgatgtagggagttcaagaccagcctgaccaatatggagaaaccccgtctctactaagaatacaaaattcactggacgtggtgccgcatgtctgtaatcctagctacttgggaggctgaggcaggagaatcacttgaacctgggaggcggaggttgtggtgagccgagatcgtgccatcgcactccagcctggggaacaacagcgaaactctgtctcaaaaaaaagacatacggctaaagttttatataacctgaaaaccatcttcattaaattaaaacagactcaacactccaaacaaaaggcagagcttgccaaactagataaaaaggcatgaaacaactaaagaatacaggagatgttaccttaaatacaaagaaaaaacaagattcaaagtaagaagttgtaaagagatgtaccatgcagacaacaagcataagaaaactagagtggctgtattaacattagacaaaacagacttcaagacaaagaatattagtagacacaaaaaaggttacagcagaaaggtaaaagggtcaaaagacagagaaagacacaaatattttaagtgttcatgtgtctaataaccaacttcaaatatatgaagcaaaaattaacagaatcaaaaggagaaacaaccaactctacaatcacttttttttttttttttttttggagatggagtctcgctctattggcaggctggagtgcagtggcgcgatcttggctcactgcaatctccgcctcccagattcaagcaattctcctgcctcaggctccctgagtagctgggactacaggtgtgcgccaccacacccggctaatttttctatttttagtagagacggggtttcaccacattggccaggatgttctcgatctcttgaccttgtgacccgcccacctcggcctcccaaagtgctggaattacaggcgtaagccaccgcgcctggcctacaatcactattgaagactttcatacatgtctctcagtaacatacaactaggtgataaaaaaaattagtataagagaagatatgaatactaacgtcaaccactgacactgcataacagcacacccagtaactacagagagcaagttgatggcaagtacacatgaaacatgaaccaagacacatcacatgctcagccaagaaacaaggctcaaaagatttcaaaatactgaaatgttactgagtactctttgaccactgaattaaattaaattagaaatcaataacattccaaaaaataaaacttagagaagccccaagtatctggaaattaaggaatttagtactaaataattcatgggtcaaagaaatcaccaaaaaattcaaaacatttttgaacagaataatagatcacaacaaatcaaaatttgtggtaaaatcagctatttaacatcccactttagaaagctaggaggaaaatgatcaaattaaaccccaaataggtagaaaaaaattaataacgaacagaaaccaatgaaatataaaacaaacgggaaaaaataataaaaccaaactctaaagagatcaataatgttgaaacgtctttatattgatcaagaggaaacaaattaccagccttggcaacgtggagtccatcttaaaaaaaaaaaaaaaaagaaaagaaagaaaagaaaaaaagcactttctatataaaaaaatttagatggctaaactgtgaattctggcaaacatttgatgtagaaagtaatatcaatctttcataaacatcttaagaaaacagaacaggaagaacgatttcccaactaattttttgagggagtattactctgatatgaaaaccaaagttcttattaccaaactccttattacaaagaaggaagactacaactcagtatctctcatgatcacaaatgtaaaattccttaacaaattattagcaaattgaatccaatagtacgtagtgaccaagcaggattcatcctaggaacaaacagttccttcatatttgaaatcaatgtaattcactatattaacaaaataaagaataacaatcatataataatctcattagatgcagaaggaaaaacaaagcaactgacaaaattcaatgcccattcacaataaaaactcaacaacctggatatataagagatcattctaacttgattaaaaaaacaaagaaaggccaggtgcagtggcttacacctataatctcagcatttggggaagctgaggaggatcacttgggcccaggagttcgagaccaggctgggcaacatagtgagaccccgtcactacaaaaaattttacaattagctgggcatgatggtgtaccctgtagtcttagctacttgggaggctcagacaggaggattacttgagtctgggaggtcaaggctgcagtgattcaagattgctacactgcactccagcctgggcaatagaccctttctcaaaacaaacaaatacaacaaaaactgcattgtacttaatagtaaatgactgaaaactttctaagattagaaagataatgtccactctcatcacttctattcagtattatagcagaggttcaaggaagtgcaataaagcacaaaaaagaaataaaacacatagatcataaaggaagaggtaaaactatatttgcacacgacatgtttagcaggaccaaaaaaagccaacatataaaaactgattgtgtttctatgctatcgaagaccatttagaaattaaaattttagttacaacagaatcctcaaacaggaaatacttaggagtaaatttaacaaaatgttgtaagatctgtattcccaaaaaatcttattgtaagaagtaaaagaaagcggggcatggtggcatgcacttgtagtcccagctactcaggaggctgaagcaggagatcacgtgagccaaggacttcaagcccagactgaacaacatagcaagacctctttaaattttttttaatcaaaaaaaaaaaaaaaatcaaagacaacttctttaaaaatagagaaatatcgtatttatggattagaagatccaatattgttaggatgtcagtatttcccaaactgatccataaattcaatagaatcccaattaaaattccatcagactttttattttttattattattatttttttgagacagagtttcactcttgttgcccaggctagaatgcaatggcacggtttcggctgactgtaacctccgcctcccgggttcaagtgattctcctgcctcagcctcctgaatagctgagattacacgcacgtgccaccatgcccggctaatttttatatttttagtagagacgaggtttcaccatgttggccaggctggtctcaaactcctgacctcaggcgatccgctcacctcggcctcccaaagtgctgggattataggtgtgagccactgcgcctgcaagactttttaaaaattagaaactggaaggctgattctaaaatttacatggaaatggaaattacctcaaatagccaaagcaatctttaaaatcacatttaaagcagaaagacacccctgaggtcaagacttcctatatagctacagtattcaaaacacagaggccctaataacgatcaatgagacagaatagaatccagaaaaagatccaaacataaaaaagcagctgattttcaataacaatgtcaaggcagtcaaatgagaaaagtttttccaaccaatattgttcaaacaacaggtatctgtgtggaagaaaatcaattttcactccataattaacgcatcacaattcaaaatgaatcaaagacctaaatgtaagaagtaaaacttctagaataaagcacagaaacaatctttgtaatcttggagtaatcagagatagtaccataaaaggaaaataatgacttattaagcttcagcataactatatattaaagtcaacattaaggaaaaaaagtcaggccaggtgcggtggctcatgtcttaatcccggcattttgggaagctgaagtgggaagatcacttgaggccaggcattctagaccagcctgggaaacatagtgaggccctgtcactagaagaaacaaacaaacaaacaaaaactctaaaaaaaattagacaggtgtagtagcctgtagtcccaggtactcaggaggttgaggcaggaggattgcttgagctcaggagtttgaggttacagtgagctataatcactctactgtactccagccttggtgacaaagtgagacttaaaaaaaaaaagaaaaaggaaaaaaaaatttttttaaaagaatgaaaaaaagtcatggtatgggacaaataattcccaatacatatatcaaaggacttctacctgaaatattaacaaacaatccttataactaaattgtaaaacaaatttttttaagtaaacaaactatttgaacagaggcttcacaaaaaaagataaacaaatgggcaataaaacaggaaaagatgctcaaccctattaaattaggaaattccaataaaacctcaatgagataccagactacacatccattaaaatggataaaatttaaaaaaaaataactgacaacaccaagtcttggtgaagatgctaaagacgtaaaattataacacactactgatgggaatctaaattggaaccactttagaaacctgtaggccgggcgcagtggctcacgcctgtaatctcagcacttcgggaggcccaggtgggaggatcacgaggtcaggagatcgagatcatcctggctaacacagtgaaaccccatctctactaaaaatacaaaaaattagccaggcgtggtggcgagtgcctgtagtcccagctactcgggaggctgaggcagaagaatggcgtgaacccgggaggcagagctcgcagtaagcgtagatcgcaccactcactgcactctagcctgggcgacagagcgagactctgtctcaaaaaaaaaaaaaaaacctgtttgacagaacaggcgcagtggctcacgcctgtaatcccagcactttgggaggccaaggcgggcggatcacgaggtcaagaggtcaagaccatcctggccaacgtggtgaaatcctgtctctacgaaaaatacaaaaaaattagctggacgtggtggcacatgcctgtagctactcaggaggctgaggcaggagaactgcttaaacctgggaggaggaggttgcagtgagccgagatcgcaccactgcactccagcctgggcaacatctcaaaaaaaaaaaaaaaagaaaagaaaagaaaagaaacctgtttgacagtttctgagagagcttcctacgtacaaacaatcctgccactccaagtatttacctgagagaactgaagataaatgtcaacataaagactcatacaacaatgttgaaaaaacttttatttataatggccaaaagcttataaacaaccagaatgttgtttaacaaggttaaagaatatgaaaaaattgtgaatatgcatatccatacaagggaatacttatcaataaaaaggggatgaactatcgatacatgaaacacaactggctctcaaaatccttatgcccaaagaagtcacacaatatgattccattcctgtaacattccgcgaaatgcaaactactccaaaatgattttaaaaaaataaaaaaaacattgaaaacacgatacttcaatggctatctgaggctggaagcagaaaatgattataagaggccatgaggcaacttttgggggtgttggaaatgttttgtatcttgacattatagtagtttcacagatttataagtagtttcacagatttatatatctgaaaaccctcaaattttttactttgaaacagagcagtttattatacataaatcttacctcaataagttgtttcaaaaattacacactagcaatctcttttgttaataatgaagaaaaaacagaataaaaataagtaatctaagagcttagattcaaaaataggtccacataattgtcataaagaactgatagctctgggcaacattgtgagacatcatctctgcaagtaaaaataaccagctgggccaggcgcagtggctcacgcctgtaatcccagaactttgggaggccaaggcaggtgaatcacctgagatcgggagttcgagaccagcctgaccaacatggcgaaaccctgtctctactaaaaatacaaaattagccgggtttggtggcacatgcctgcaatcccagctactcggaaggctgaggcaggagaatcgcttgaacctgggaggttgtggtgagccaagattgcgccattgcactccagcctgggcaacaagagcaaaactccatctcaaaacaaaaacaaaaaacaaaacaaaacaagaaaaacagctgggcatggtagtgcacacctatggtaccagctactctggaggctgaggtgggaggactgcttgagcccaggaggtcaaggctgcagtgagccgtgatccaccactgcactccagcctgggcaacagagcaagatcctgcctcaaacaaacaaacaaacaaaaaagaactgacagctcaaaaattttctaaaccaattgcagttttaaaaatgaaacgatttatttaaatttactcgtatttaaatactcctactggatgttcaacacactttaatgtggccatatagcctatttcatttaagttctatgttgccctaggaagcaggaaatatacactaattactcacaggtttcttctaaactgataaatgcctaaccttgttttaaatctatgctatactctaagaaaacaataaatgctttccacacaacaatgtatatatctttttaacttattacttaacacagctcaaatcttctattactctagggaagtaaaaaatcccagtaacttctctcacaggatattttcattcatttttcattaggaaaatgcttgcaactgaagttttcggagtcagttcaacagtgaagtacaaaaattaaaacagcacataacttttcaattcatcacaaaatatgtacacataacctaagacacctgagccatgtcaggctagtctgaagagtttcagtgtcataaaaatgaaaaattgtacaacaaaaaaatctctgggagtgctaacaaaaccttcagaaggagcttgccacaaagaaccatgggcaaaagtagccaaaatgatttctatactgaagtatggtctacagaattcttaagagagtttggaataaaaaggggaataaatcatatacattcaagaaagtgccaaaaatagacatttaattaaatatggcaagatcttcattattcaaaattcaactgatagcacagttatgaaagcaggatttttttcacaaagcttttatacagagaacaactggccagacatggtggcccatgcctgtaatcctagcactttgggagtctgagacaggaggattacttaagaccaggagtttgaaatcagccctggcaacaaagtaagacgatgtctctacaaaaaaaataaaacttaaaaaaaggccaggtgcagtggcacacacctgtaatcccagcactttgggaggccgaggcaggaggatcacttgagcccaggagtccgagaccagcctgggcaatacagtgggacctcatcttgacaaaaaaaatttttatttaattagtcaagcatgatggtgggcgtctatgatatcagctacagctcttgggaagctaaggtgggagaaaagcttgagcctgggaggttgaggctgcagtgagccaagactgtgtcactgtactccagactgggcaacagagcaagatggtctcaaaaacaaaaattagctgagtgcggtggcacatgcctgtaatcccagctacagctactcaggaagctgaagtgggaggatcacttgagcctgggaggtcaagcctgcagtgagcctgcagtgagctgtgactgtgccactgcactccagcctgggtgacagagcgagactttgcctcaagaaaaaacaacaacaaacaacaacaacagaaaaaagttcctatcaaagactttctctttgtacacacacttttaaggtattctgaattcacagacattcatatctaacctaccacagcctctactgggcagtagtatcatcaacctctgagtttcagcttcctcatctgtaaaataatcttaaaggccccttctggcttaatcatatgctcaaaataaagattttgtatttaaaactaaccaacaaaaaaatccccactaactatcctatcgaatcagtgacaatgtacacaaacacacaatatttatgacaatgtgaaaaaacattctcttatttacagaatggcatatccctagcaaaaccactcaaatgttatatcatactcaagaaacctaattatactaggaataaaaatcagccatatcacgcagatatctacgtttcctcaaaagcaagctgcacagtagatttctaaatcaggaatggggactactttcttccctctgttaggaacttttgggactgtcagtatttaagtcatctagccgcctcggattctcctatttagaaactgggacagatgatcttgaaagtctcttctaactatagtgacctctcaagaaattaaaaaaaaagaaaaaagaaaaagaacaaaggggtgcttaaatgacatttggttaatcatcagaagaggtgcttagcctcatactcaacagcctacatacacatacacaacgatgcagactatcaatatatcagaaattgattccataaatatcattagctcttcagatttaatggtttcacattagtaatgatagagaggaattatttcatgtaactttaaaatacattaatattcctatacagccccatgggatatagcctaaggccaaaacaaataaaaacaacaacaacaaacaaagaacgaaagacaactggtttcagtaatcatattgtttgcagcagtgtgttgttatctgagctgctgtgtgtttattatgggattaaagtagatgagtaattatgatggtatgtcatgcaaccaactcagtaacattagcctcatttccctttacttttaattttttagaaattattcgtgtaaaactttttatagtcatgtaaaatattaacatgttccaaagtatactttataaaaaacaagtttatgcaaaaaagtttagcttcttcccatccctccatgtgctttaaaataaatacatggtctcagaaacagtgaagtacaaaaacacggcttctagattccaatcttgggggtatgaccttaaattgtgacttaatctctctcaacttatttccttatgtctaaaaaggtgataataatagaacctagaggccgggcgtggtggctcacgcctgtaatcccaacactttgggaggtcgaggtgggaggatcacaaggtcaggagattgagatcatcctggctaacatggtgaaaccccgtctctactaaaaatacaaaaaattagctgggcgtggtgggtgtctgtagtcccagctactccggaggctgaggtaggagaacggtgtgaagccgggaagcggagcttgcagtgagctgagatcgcgccactgccagagcgagactccatctcaaaaaaataaaaaataaataaaaataaaaatagaacctagaggtggttgtgaggattaagcaagatcttctatgcacagtacttggctttgtgaggcctcagttaagtatcaggtgctattattaggatctcatttgagagtcacctcaaacctgcagcacagacacagattaggaaatgaacctgcaggtgccacatcactggcctggagcccccatggcacccaacagccaagaccacaactcactcctgagtctacaggcgacttcatgctccgcactcatcacacattccctacagccagttcaggggaaaaagaagtgtcttcccactcagggtgacttcaaaagacttactgtgttcagtgcattcagagtggtgtcatcccgagaggctgcgacacagccgtcctctgtagagcctccatcacacattcctgcaaatgccgccatgctccttcagaagaaaaggtttttcctttattagtacatagtaatatcaggacagagacttagaccttcaattttcagaggacatttccagcccagaacaaattccattactacacgcatgatgaaccagttcccagctctgcctctgctcctatttttttttttttttcttttgagatggagtctcactctgtcatccaggctggagtacagtggcgcaatcttggctcactgcaacctccacctccaggattcaagggattctcctgcctcggcctcccgagtagctgagattacaggaacaccccatgcccagctaatttctgtatttttagtagagacaaggtttcacagtgttggtcgggctggtctcgaactcctgacctcaggtgatctgctcacctcagcctcctaaagtgctgggattacaggcgtgagccatcacgcccagaccaaaaataaatttaagttcctcttcactcacgcagaaagacatatgttacttttagtcagatccatttgtattgtttcttcccacgttttagcagtactaagattttagatttgagagcatgaagaatctaaatctatgagccacaatatttcagtagatgacaatcttctgaaagaaaagtctccagaaaacatgtgaaattaagtcatctaaaattttacttaattcctctcattctgcatatcaactacctttaggtgaattaaaagtaaaaaatcatggctgggtgtgatggctcatgcccgtaatcccagcactctgggagcctgacgccagaggactgcttgaggccagagagttcaaaatcagccctgacaacatagagagagaaaaaaaatatattagccaggtatggtggtgcatgcctgtagtcctagctactggggaggacgaggtgggaggatgacttgagcccaggaggttaaggctgtaatgagtcatgattatgccactgcactccagtgtgagaccctgtcttaaaaaaaaaaaaaaaaaaaggtgagaaaccagagataaaacctcttagtcattcactccacttacacattctcatctctactgaatgccaccatgcacaacaccgttgactagaaaacagccaggtaactggggcaacacagaaaggaccccatctcaaccaaaaacaaaattaaaaatagccgggcatggtgccacgggtctataaccctagctactcaggaggctgaggcaggaggatcgcttgagctcaggaagttaaggctgtagtgagctataattgtgccactgtactccagcctgggtgacacagcaagaccctgtttcaaaaaaacaaaacaagtaacaaccaaaaaaaaaagaaaaaaagaaaaaaaagaaacccacaaacccatccagggttaaaattcagatgccctaatccttgctttcatgtttttgttgtcgttgccaagacccagaatcactacatacaaagtctgcctgcctgctctgtgacacctgctctgtgacgaccgctctgtggtgcccgctctgtgccgtgtgaggagcgaattcacacttctctctgcatcgaaggcatttgtatgttctatgcaactgccacgagggtgatcacagataaatattctcatgtaggcaagccacaaaaatgtcaagttcaggacaggcactaatgaacagccacaaagtagagacagaacatgaaatctgtagagggttttgtttttgttttaaattttactttaaggtccaggatacaagtgcagaacgtgtcggtttgttacattaggtatatgtgtgccgtggtgctctgctgcacctatcaacccgtcatctaggttttaagccccgaatgcattagctatttgtcctaatgctctccctcccctcacccccacccctctgtagtggggttttcagatgagctgaatgactgaagtactcaactggattgagaggttttggtaactgtatgtatggcctaagctgttttcctcttgaaaagttccaaaatttgatgtggggcaaacaccaagaagaaaaacattacttcatcatgaaaaaaattacttcaaactatttttctctggtaagaagagccagggtcccgattacagagggtgtaaccaaacttaaagtcagagaacgcccaatatagaaataaaatctcaggggaaatgcaaagtttactgcctataatcagttcagatggtctaattcagaaagcaggatgggggtagattcctattaccttgctgccctcaagtacataaggaggtcacagtcgttaactccaggcatccagaccagttcctcatgttgggtcactgtatcaccatctggagaaggaaatggttgcagatctggaagtttggcctgtaagacagggatgagtaagtcacaatcaaggcatgtattaattataaagagctatctcaataagcagtctttaggaacatatacaatgttttactgagactctttccttggacagcagaaaaataacaacaaaaccatgagtcatttaaactgacctatttcacatgtcaggatcatttcaccatagaagatttcacaatagactgcttaatatctgcttaacagtgtcaaagtaaaccagtgccagcatgataccaagagtaaaactgaagcacacacatatgcataaaataaacaaaaaaacaaaataatgtctttagatgataacagctattgataaagaaggaaacacacatacatttccaatataacaagttgacaaagaagacatatgcaaatgatacctcacctaaggatatttgctaaaaaattaagtgagctatcctattagaatagtgttactcttaagacagtcaatagcaatataagtcatggtcaataccaaaactagatgagtattaagtaaacattaaaaaatatagttgaggccaggcctggtggctcacgcctgtaatcccagcactttgggaggccgaggtgggtggatcacaaggtcaggagttcaagaccagcctggccaagatgctgaaaccttgtctctaccaaaaatacaaaaagtagccgagcacggtggcgggcgcctataattccagctactcaggaggctgaggcagagaactgcttaaacccgggaggcagaggttgcagtgagctgagatcgtgccactgcattccagcctgggagagacagagcgaaattccatctcaaaaataaaataaaattaaactaaattaaattttaaaaatttatatatagttgaggctgggcatggtggctcacgcctataatcccagcactttgggaggctgaggtgggtggatcacctgaggtcaggagttcaaaaccagcctggccaacatgataaaaccccgtcactactaataatacaaaaattagccaggcgtggtggtatgtgcctgtaatcccagctacttgggaggttgaggcaagagaatcgcttgaacccgggaggcagaagttgcagtgagccaagattgtgtcactgcactccagcctaggtgacagagcaagactccatctcaaaaaaaaaaaaaataaaaaaaaaaaaataaatatatacacacacacacacacacacacacacacacacacacatatgtagttgaattgacctgtggtaacagaaatcagggcagtgatttctttacgaaagaaggaattgcttgtgaagaacaggaaggacctttctgggatgacagaaatgttctgtgccttgatacgaatcatcacggcagattgaaaagcatacataagatacgaacaattcgctgtacatagagtatacctcaataaaaagaatttaaaaaaatattcgagcaacagtgctccccaccaagactgtaagtgatcagatttaaatacctgtggcattttctcacccacactctgctgggacagagcaagagcaagcaggtgccatgaccaccataaccagcagagacctgtgaaaagtcagatatttgcaagatactcatgttctcatcctgtcaaatgatgaccatgggcacatgagtctgatagagctccatgggacatgaagcctgggcaaacaatttaagtgaatgcagcaggctgaatataagccagcaccatccaacagaaataaaataagaattatatatttaattttaaatattctagtagtcacgttaaacaaaatgccatatcccaatctggactagccatattccaagtgctgaacagctatgtgtggcagtggctcccgacctggatgtgcaggtgtgaagaactcaagagtgaagtggaccacggggaaatggagatagaaccgccccatccagggaatgctgccacacaggaatgggacccagtgtgtgtacatcctccatctttttccaaattccagaaatcttcacatttatgtaaaagtttgtggttttaaatgttggtattcaagtttttgaggcaactgcatagcaaaacatcacattagtaggccatgtggctctcaggctagccatcagcacccacacagctttacaggctgtcttccatgcctctaaatgtgtatcaagctgactttctccaagcaaggatgttcttctttggttaagtattgacttctctaacattgaactgagtgtcacaattagttctgcttaacacatagtgaaaatagtgggataaaattaaaacacaatgggcctggcgtggtggctcacgcctgtaatcccagcactttcagaggccgaggcgggcagatcacctgaggtcaggagttcgacaccagactgaccaacacggtgaaaccctgtctctacgaaaaatacaaaaattagccaggcgtggtggcacacgcctatagtgccagctacttgggagggtgaggcaggagaatcgcttgaaacctgggaggcggaggttcccgtgagctgagattgcaccactgcactccagcttgggtgacagagcaagactctgtctcaaaataataacaacaataataataacaacaacaataacacaacaaatgttggagtcaaaaggtctttgacactagtactgagttctgcttccccagcaccgagtacagtactgggtacagcagttctctaatgtctgttattaatcgaaaagtactattactgtgagcaggaccaacctcccccccattcttgagaaaaatggactagaaatataattagacagtttacagaaaaagaaacgaaaatgcctcttaatcataagaattgatgagttggagacggggttttgctgtgttggccgggctggtctcagctcctgaccgcgagtgatccgccagcctcggcctcccgaggtgctgggattgcagacggagtctcgttcactcagtgctcaatggtgcccaggctggagtgcagtggtgtgatctcggctcgctacaacctccacctcccagccgcctgccttggccccccaaagtgccgagattgcagcctctgcccggccgccaccccgtctgggaagtgaggagcgtctctgcctggccgcccatcgtctgggatatgaggagcctctctgcctggctgcccagtctggaaagtgaggagcgtctctgcccggccgccatcccatctaggaagcgaggagcgcctcttccccgccgcccatcgtctgagatgtggggagcgcctctgccccgccgccctgtctgggatgtgaggagcacctctgctgggccgcaaccctgtctgggatgtgaggagcgcctctgcctggccgccccgtctgagaagtgaggaaaccctctgcctggcaaccgccccgtctgagaagtgaggagcccctccatccggcagccaccccgtctgggaagtgaggagcgtctccgcccggcagccaccccgtccgggagggggggggggggtcagccccccgcccggccagccgccccgtccgggaggtgaggggctcctctgcccggccgcccctactgggaagtgaggagcccctctgcccggccagctgccccgtccgggagggggggtcagccccctgcccggccagccgccccgtccgggagggaggtgggggggtcagccccccgcccggccggccgccccgtccgggaggtgaggggcgcctctgcccggtcgcccctaccgggaagtgaggacccctctgcccggccagccgccccgtccgggagggaggtggggggtcagcaccccgcccggccagccgcccagtccgggaggaaggtggggggtcagccccccgcccggccagccgccccgtccgggaggtgaggggcgcctctgcccggccgcccctactgggaagtgaggagcccctctgcccggccagccgccccgtccgggagggaggtggggggatcagccccccgtccgggaggtgaggggcgcctctgcccggtcgcccctaccgggaagtgaggacccctctgcccggccagccgccccgtccgggagggaggtggggggtcagccccccgcccggccagccgcccagtccgggagggaggtggggggtcagccccccgcccggccagccgcccagtccgggagggaggtggggggtcagccccccgcccggccagccgccccgtccgggagggaggtggggggatcagccccccgcctggccagccgccccgaccgggaggtgaggggcgcctctgcccggctgcccgtactgggaagtgaggacccctctgcccggccagccgccccgtccgggaggcaggtggggggggtcagccccccgcccggccagccgccccgtccgggagggaggtgggggggatcagccccccgcccggccagccgccccgtccgggagggaggtgggggggtcagccccccgcccggccagccgccccgtccgggagggaggtggggggggtcagccccccgcctggccagccgccccgtccgggaggtgaggggcgcctctgcccggctgcccctactgggaagtgaggacccctctgcccggccagccgcccagtccgggagggaggtggtgggtcagccccccacccggccagccgccccgtccgggagggaggtggggggatcagccccccgcctggccagccaccccgtccgggaggtgaggggcgcctctgcccggccgcccctactgggaagtgaggagcccctctgcctggcgagccgccccgtccgggagggtggtgggggggtcagccccccgcccggccagccgccctatccaggaggtgaggggcgcctctgcccggccgcccctactgggaagtgaggagcccctctgcctggccagccgccccgtccgggagggtggtgggggggtcagccccctgcccggccagccgccccatccgggaggtcaggggcgcttctgcccggccgcccctactgggaagtgaggagcccctctgcccggccacgaccccttctgggaggtgtgcccagcggctcattggggatgggccatgatgacaatggcggttttgtggaatagaaaggcgggaagggtggggaaaaaattgagaaatcggatggttgccgggtctgtgtggatagaagtagatatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcgtgctcgttaagagtcatcaccactccctaatcttaagtacccagggacacaaacacttcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaataaataaataaataaataaataaataaataaataaataaaaaagaattgatgagtcaacctctctgacaacagaaatgcaaattaatggcacatattcaattttgcatctatcatactgacataaagccaaatgtttgacaacacataaagccacgaaaaaaattagcactcatattagttgctagtgtcaacacaaactgatacaatctctgtggaggggaatgtggcaaaacccccaaaattatatatgcacttgtcctctaagtcagccatcccgcttctggggatatagccccaagatacactggcaaaaacatcaaaatctatatgcacaggctattcactgcagcattacatgtaatggcaaatgactggaatcaactcatatgcctattaatagggatcagatgaataaactgctacattcatacatggagttctatgaaatagtattatagaagggaatgagaaggagctctatatactgctatgaggagaacacaagaatatactgttaaaagaaaggtagcaaaaggatgtatattatgttattatttatctaagaaggggcagagggaatgaaaataagaagcttaaataataataatctcattaaaactacaccaaatggaaagaaatgcaacaattgagctggttctactctaggaactgtttcaagtaactctaagatatattaatttgcttatacagccctggcaggatatacataacaaaatgcaataccaagctgttttcaataagcatactgtttgtagccatgtgattattgctattctgggctgttatatgtgtattatggaattgaagcaaataagtaattttgttggtgtcattaaaaaatgggatttgagtcacgggaaaaaaataaagatatacataaaagaaggacagaattagtataaaggccatagaaaaatctgaatttgaattggatgtatcagcataaatttagaatgtattttatctttaagaaagtagggaaataaaacacctatttcctattctgtctactgaaaaggcctcgaaatagcaaccaacccagtaagaatgaataccccagcacccagtatgtaaataccacttcccactacaataaaagagggctcttctgagacaagtttaattccacatctagggaagacaatgtataaggtgaggcagtaaaatcatgtcttactagagaaaaacgattaagtgaaaaggacaaaaaccactgggattaagtgaaaaggacaaatacgaaggaagatgctcctactggcccaaaatggatcttttaatcatcaataagaactgattaaagttgattatagattaaaaaataaaatccactggtaccatggaaagataagggtgaagtttcatttatttgtacaaggaataaatggatggcagaattagaatatcactgttttgaaatccctaataaaataatggatctaagaaataatcagtggtggccaggcgcggtggctcaggcctataatcccagcactttgggaggccaaggcgggtgtttcatgaggtcagaagttcgagatcagcctggccaacatagtgaaaccccgtctctactaaaaatacaaaaaagtagccaggtgtggtggcgggcgcctataatcccagctactcaggaggctgaggcaggagaatggcttgaacccgggaggcggaggttgcagtgagacaagattgtgccactgcactccagcctgggcgaccgagtgagactccgtctcaaaaaaaaaaaataaatgatcagtggctgctaattacaattaaaaaagagacatatgagcctcctggcagaagcacttaccaccacccaggaagcatttttctggaaggcagggtaccaaactagaatgaggccgaacctctagatttaactactaattctcaagtcatgcaaagagcaaagtaacaaatttaatgcaatcagccaaatctagactgcagaacaccctacaggatgaaatagcttctttaccacatacactgggggactaggggaaggacctgggaattaagagagatttaagagatgtatcaaccaactgcaatgaatggctctcatttagattctaatttgaactatgaaaatataaagaaagagagaaagatacagacagacaattagggaaatctgggcatcgtatacacttgaatattaagaaattggtaatttttatatgttctgatatattgtgattgtgtccaaatcccttatttttggaacatctacaaggaaaatgatgtatttgtgaggcgtttaaaataacggcaggaagaggtgtgagggggaataaatgaaatgggtttgactaggatttgatacttgaggaagctgagtaatgaagagaaggactttactgtattattctttccctgcttttgtatatgttaatattttcctaataaaaaggttaatttttttttttaaagactggttctgtcaccaggctggagtgcaatggtgtgatcgtggctcagtgctgcttcaaccgcctaggctcaagcaatcctcccacttcagcctcctgagtggctgggactacagacatgcatcaccatgcctacctaatttttgtattttttgtagagatggggttttgccatgttgcccaggctggtctcgaattcctgagctgaaatgatctacccaccttggcctcccaaagtgctgggattacaggcgtgagccaaaagtcaaaaattttaaaaaggtaaatgttgccaattcatttttaaaagttttattatttttggtgctccaaaacatttctttttgaaaatgaagcacacagaatacatttaaaatctgatgtaaaaaaccaaacatctgattttaaatggtggtatacaaaaatccaatcacagtaaatttgctccttttccaagaatgtaagcatcttttccttaggaactacattttcttttatggtaggaaaaaaaaaatctataaaataaaagtctggtacaaagatctcaagacactggaaatacacagtgagagggaaaaaatgggtagtaaaatacagtgcaagagaaagtagagaatgggagacgaaactgagtggcattaggttgagtatcaggttcccagaccgaaaatacagccccgaggtggcagtcaggcccacctaatggaacacaccaacaaaagactctacttgaacaagcagacactgtcctcctgcagcttctttcagtctgtatcagttataaccccaggtctgggatgagaagtatcttctataaactatgtgaccctgatagtttttgtgttcacttcacttcataactccttcacttcttaagttctttcattacagagttaaaataggttatttaaaaatgtaaatgacacacaatttagaaatgctcaaaatctagacagaaataataactagacagacgactgaaatctctatgcacttccaaggctcactgctgcctgtatcccatgtctttagacatgatggccttagctgtggattccccagcatccattccaactcaagtgctaatcatgttaaactctttcctcatggtttagaaatagacacatgacccaatccatggcaacaatatgtgggtctactggggacctgctggggaaattttccttgctcctaaggggaaaagaagtccaattctttcttcctctcaacacttgctaaatttcattcattgtaagatccactgttattttatgtgcactgagaaaggataaaatatagccaataaattataaccacaccacagaatgtacaatgaagcccaactataggagcaaatgtgaaggaaaaaagtgtatcttagaattagtcaaactgagctgaggatgacgccacctccatggaggccagctgggtacaagagagtctcagagaagcacagcagagccccagtcctgcctgaccaggatgtcatgacatgggagacagaaacagagccagagtcctgtcagtgaaagcatcctaactgatactgagatcaaaacagaatatgccgggcccagtggcacatgcctttagtcccagctactcagaggctgaggcaggttggactgcttcagcccaggaggaggtcaaggctgccgtgagccgtgatcgtgcctctgtgctctagccttggcaacagaatgagacctgtctctgaaaaacgtaaaaacaacaacaaaaaccaaagagctgtaataaatgcaatgaaataagaaagagcaacagtcgtgacacagcaaccctctgactgaaaagtgtcctaaccatcttgactctcctgaaggaaaagaagttgtttatttttttgcagacagtctcgctctgtcgcccaggctggagtgcagtgtcgcaatcttggctcactgcaacctccgccccctgggttcaagtgatttctcctgcctcagcctcctgagtagctgggattacatgcgcacaccaccatgaccagctaatttttctatttttagtagggatggagtttcaccatgttggccaggctggtctcaaactcccgatctcaggtgatccgcctgcctcagcctcccaaagtactgggattataggcgagagccaccacgcccagccgggaaaagaggttttaaacatcttttatctttttttttttttttttttgagacagagtcttgctctgttgcccagactggagtccagtggccacagtcttggctcactgcaacctccgcctccggggttcaagtgattttcctgccacagcctcccaagaagctgggattataggcgcctgccaccacgcccggctaatttttgtatttttagtagaaatgggatttgccatgttggccaggctggtctcgaactcctgacctcaagagatctgcccacctcaaccttccaaagtgctgggattacaggcatgagccattgtgcctggctttaaaaatgttttaaataaaaatatgtgatcaagtgttcatcaatggatgaatagataaacagtgatacgtacatacaatgggtcatttagccttaaaaaggatagaaattctgacacatgctattaacacggatgaaccatgaggacattatgctgagtgaaataaatcaggcacaaaaagacaaatactgtatgattccattcacatgaggtacttttatgaggcagaacagtcaaaaacagagagaggaaggagaatggtgattgccaatgctgcagaagagaaatggagttactgtttacgggtacagaatttcagttttgcaagatagaaagagttctggagatagatgacggtgatggctatacaacaatattaatgtacttaactactgaactttgcacttaaaaatgggagatggtaaatgtatgtggtgatctgaggagggtggaaaaaaaacctctgtatttataaaaaattcccgatagcaataaccacattctaagatgctgcgcaacagaataaagtgccagcagagtaataagaaacaaaaacctattaaggaagctatgaaaatgaacttcacctgatgactaggaccgacacgaatctccccctgggtactgttcagcctcctggaacagaaatagagcagattaagttagcgcaatacagttttgacataaacattcacacatttttcaaaaaaagtaattctcttcaaataaatgaggaaaaactgaggaagaattaacgtccccactacttctaatgttctgtatacatacaccacccaccaccacacatgcacctctaaaaccttttcctttgaaaatcctaagaactgcagcttcctttcatgagaaccttcctacatcatcgttctttttttgagacagagtctcactctgtcgcccaggctggagtgcagtggcacaatctcggctcactgcaacctccgcctcttgggttcaattgattctcctgcctcagcctccagagtagctaggatttcaggtgcctaccaccacgcccggctaatttttgtaattttagtagtaaatttcagtaaattttgtaattttaataatttgggttttcatcatgttcagccaggctggtctcgaactcctgaccctcaagggatccgcctgcctcggcttcccaaagtactgggattacaagcacgagccaccacacctggcccctataccatcattctttcatgcctcagagagatggacattcctgtagtacaattccagtcagacatttcttccgttcaaaacatctcagggtgccctaccataagccttataaaatacaaataagaaaacttatcctaggacatatactgagccatccatccatccatccatccatccatccatccatccgtccgtccgtccgtccatccaacaaatatttaagtacctactataagccaggaattgtcctaggtgttggggataaagcaacaaacagggacaggtacagaggctcacacctgtaattctagcactttgggaggctaaggcgggaggatcgcttgagcccagaagtttaaaaccagcctgggcaacacagagtgacgccatctctacaagaaaattaaaaatcagctgggcatggtggcgcacgcctgtagacccagttactcaagaggatcgcttgagctgggaggtcaaggctgcagtgagccatgttcgcaccactgcactccaacctgggcaacagagcatgaccctgtctataaaaaaggcaacaaacaaaacagtgtcaaagaagatggcctaaaaggaggcacatgctcttgtttttctctcatggatctgatacccatacccactgtgtttgaaattgttaaaaatacattttggaaagctatcgtttcctttagggcacctgggcccagtactttcttcttttaatccaatcattttctcatgaagaatcttgcttgggcaaaggtggtggtaaatgtgacaaaggaagaaaaaaagaagaggaggaagaaggggagaaagggaggaggaagacaaggaggaggaggagaagacgaagaagaggaagaagaagaaatgtggtggcccagtcatcaagaatcttacaagcctccagctggcgaggcagcatctgtaccaaaacaccagaacaggccgatgcccgtattcatcaacataagacacttcaaaagacacagtacaaaaatgtgaaggggaggtaccaaaatgaggcggcttcaagagaagacacagaaggagataataggcctagcagcaggaaaaaaaaagaggactttccaagtagaaatgaaagcatgcagaggtggcaggctgaaagggaggggcggtgacagggaaatgcttgcatgtgggctgacttcatcatacaagtcatcttcatttcttcattaggagaatggtatgtggaaaaacgaagctaaaagatggattgttctcataggtttatgcaggaaatggaagaagctgttttaggaggtatgtaaaggaatcaaatcagccacaagttattttaatcacaagcgcttctttaagaaaaacaagcaagcagtcagcgttaccactatttcccttccaacttgtccttttctattttctaactagctgtgagcaaaacaagctgccaaaagctctaaatactttccaaatgctttcttgcctacaagtaggtctagccagaatgtatcatttcagaaaccttcagccacagcccattcagtaacttctgcctgcagctcaacctttgggttcttccagaaggtctgttactctggagttctccagtggttggatatcatttccatatcatggctacactgttaagtccttgataattccagaaaaaacattcctgcttgatttttattttattttggagatgaggtcttgctatgttgcccggtctgttctcaaaaccctgggctcaaagggacccccacctcagcctcccaaagcgctggaattacagacatgagccaccgcactcaccgcccaaccccatttttattttaataagccaatttatcatcatatttagcttaaaaaaacccaatgtaccatggtaatgaaacaaactcccaaataccctgttgactagaactacttatatctcacgtatttccataaaaataggatgcagataattattattaaactaataatacaaatgagacaaaaaaatgtattgggccatcttaagagacttgaaaattgtttaagtttataacagggaagagtactaataagtaggctataacatgaaaaccaagataaaataaggaaacttcttaaaagcttatttaaaaatccctctttgcaacaaaagtatttttaaattgtatgtaacttttaaatatcagggttctatagcaagaaatacaacaaagttctttttgagcaggtaggatctgaggtgcagacaatggcattagcctactatatgcaagagttacagaatatagaataaatggcaaaagtactttttaggtccaagatataaagaggtagatagcaacacaccaccttagacaaagcttgatgcagctgacagaaaaactgtcagaatatgagctgaaggtgaaagacaagaagtacacatggtggggaagtgccagcatccagctgtatctggatccaccgagcaatcagaatcctccttactgaactaagtatccctcccctgctgccgcactgctctcctctcttttttctttttcttttttttttttttatcctgtatccccagacagctgcatcacccttgataggtcaggcagccacaacaccccagaatgtttccctggcacatggaaaaagcacccccatgaggctgcagccaggtgcaaagtgagtctgtgaactgctcccttcttgaatgcacctttgtggttcacacctcactcattaatgatatttaaacatgacagtatcaacagcttgtaggaaacactcttttttttttttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaggaaacactcttaatcatcaattgcaatcttgatgcaatgactacattttgtcttttacttaacatttctcaaacttttaggtctctgtacccttttacactcttaataattactggagtgtgtcttggtggtcccagaatctgtctcttgtttcaacaatgtctgaacagcacatatcctgggactccatctgttccagcctccaactgccctccaatctcccctccatttgcaacctccagcacccttcttctcggccatatcctgcttctgggaccagccaccactgtttttgtggttagctcctcaaccccgcaagctctgggaggcatgagtgacttcttccacgaatcggccaagaagattcagggcactgagtgtctcttgaagatgtgtgtgtggcagcggcacccatttccaggatgtggagaagccatctcaaaatgagtgggggtaaaaaccctgggttccatggaagccaccatggctctggggaagaacctgaaccagatcctcgatctttaggccctgggttctgcctgcacagacccccatcttctgtgacttccggagagccacttcctagatgaggaggtgaaactcaacaacaagatcggcgactaccagaccaacctccccaggctgggctgggtaaatgtttcttccaaaagactcaccctcaagcaccacgaggagcctacagagcccagcaaacttttaggagcccctctcaaagttcagggctactgcctaagcagcgcctccagccactaccctggacccctctcccaagccgtggacaaaacagaaataaagcttattacaaaaaataaaaataaaaattactgaacatcccaagaaatctaaatttttgaaaactttcaaaatattgatttaaaaatagcaataagcccattacataacaatatacatattcttataaaaagtaattgcatttaagcagaaacctttagtaaaaagtgaggcattattttatgtttttgcaaatctcattaatatttgacttaatagaaaagacagctagattctcctatctacttttgaattcaatctgctgcaatatattgttgtggttaaattatatgaagataatacagcctaacacagtgatgtaactagaaaagggaagaatatagcctttttgatactacaccaaaaactcaacaagttcccggcactctggggggccgaggtgggaggatcacttgaggtcaagagttcgagactagcctggccaacatagtgaaaccctgtctcgactaaaaatacaaaaaattagccgggtgtggtgttgcatgcttgcaatcccagatactcaggagcctgaggcagcagaattgcttgaacctgggaggcagaggttgcagtgagccaacatcgtgccattgtactccagcctgggcaacaagagcgaaactctgtctcaaaaacaaaacaaaacaaaacaaaaactcaacaagtaatcatttcttaaagatgtgtacacaaggtgagtctaaaagcctatcaatagtcttttgactgtgctactctgaaatccattggtctgtcttgcctttgaatgaatggatcttctactcagatgtgattttgtaatgtcatgcattggttttatagagaatgtcagtttactcagttctgcagatctttcaaatatcaaccagttctttatacagcattttttaaaaatcatattaatatcacctatctcataagaaatgcctttcagtgtagagaagctgtcaggctcagagtggtgagtacaagcttttcgaaattctaatttttacttgaaagttcaaatcttagccttgtcaaatagtatcagtgttttccttgaaataacaagctcacttaattcatcttcaagaaagtttctgccaaatgcccacgtctgaatgaccacagtttgtctgtcagttgttctttcaaagagtaactgatattccatgaaaaaagtggctagcttcgcttctaactcaaatgtctcgacggaaccaaggcttctcctcaagacaatcactgtcttttggtatagggcagaagacttttaagtcgggaagccaagtcttgggattaaaaaatactaataggctgggcgaggtggctcacgcctgtaatcacagcattttgggaggccgaggcaggtggatcacctgaggtcaggagttcgaaaccagcctagtcaacatggtgaaaccccatccctactaaaaacacaaaattagccataccgggtggtgtgtgcctgaatcctagctactcgggaggctcaggcaggagaactgcttgaacccgggaggcagaggttacagtgagctgaggtcacaccattgcactccagcctgggcaaaaaaagaatgaaactccgcctcaaaaaaaaagaaagaaaagaaaagaaagaaaagacaagacaagaaaagaaaagagaaataataataataataatgaggtccacaagctatgctctgagaagcactgattatggcacattctgaacttcagcaagtgctggaggctaaaattcatctagaagactccagctttcttctttgatgaataacaacagtagctaacatttcagcacttactatctgtcctaggtgctctacagtattatctcatttctaggtattaaggcatttaattcatgttttgatattaacagacatgttagtattgctattcacagaaattcaggtgtctttctatcctgtgttcaaagcaacacagcactacacgtggtggtgcacacctggaatcccagcactctgggacgctgaggcaagaggacagcttgagctcaggagtttgagaccagcctgggcaacaggctttataaaaaatgtttttttaattagctggtcacggtggcacgcacctataatcccacctactcaggaggctgagccaggagaatcacttgagctctggagtttgaggctgcagtgagctatgatcacaccactgcactccagcctgggcaaaacagagctagactgtctttaaaaaaacaaacaggccgggcgtggtggctcacctgaggcaggcaggtcacctgacgtcaggagttcaagaccagcctggacaacatggtgaaaccccacactactaaaaatacaaaacttagccgggcgtggtggcaggcgcctgtagtcccagctactcaggaggctgaggcaggagaattgcttgagtctgggaggcagcggttgcagtgagccaagatcatgctactacaccccagcctgagtgacagagcaagactgtctcaaaaaacaaacaaacaacaacaacaacaacaacaaaacatagctactaaagaggtttctgcttggatgtacaatgctgctgaattaacaaagtaggtctagtcaaagccagggtggtcatcaacttcggaagaaaaatccagaccaaaggcagtatgaatcctagccaagacatataaaggatactactgtatgaattaagaaaccaaagatgcaagtaatatccagaataatgcaacatacacacacatctatctttatcctcatcttaagagttttcacatacgttatcttaaatctaggtgtaggccgggtgcggtggctcgtgcctgtaatcccagcactttgggaggctgaggtgggcaggttacccgaggtcaggagttccaaaacagcctggccaatatggagaagccccacccctaaaaatacaaaattagccaagcgtggtagtgggtgcagtagtgggcacctataatcccggctacttaagatgctgaggcagaaaaattgctcaaacccaggagatggaggctgcagagagccgagatcccgccagtgtactccagcctgggggacggagcaagactctctcagaggaaaaaaaaaaaaaaaaaaaaaatctaggtgtattatagttacataacaaacacaagcaaaataataatactagctatcaattactaagtgctttctatgctgggcacatattatttcattattccacgacaactctatgaggcagtatctccataggtaataataataacaatactaattttaacattaataaagcaactaatatatccattgaacatttactatgtaccaggcattgcaaggtaagcaatttccatttattttcttatctaatcttacaggcgaccctgtaagataggtgctattgtagtaagtgtacaggtcaggtcactgaagccaagagacgttacgcagttgcccaagattaaacagcaaataagtggagaaatcaggaatcctactcaaggtcagctgactccaaagtcagagctctcaatcacactcccatatggcagaatgattaagttactgaaccaaaatcacacaattaattacaaacagaatgatgagaatccatatccctttccctattttggttctatgtttatttcaaacacccaagcaagacaaaatgatcaaaagaatttttttaagtttgaaagtcatgatgaaagagaaaaacctatcaaagttagaggccaatgtatataatactcttgaaatgacaaaattacagaaatggagacacattcgtgattgccaggtgttagagatggtggggagagggagggaggcggagggtgcgaccacaaagggagagctttgtagtgatggatagctctgtctcttcattgttgtggtggttacacaaagctatccatgtgataaaatggcacagaactacacgcacacaatctactaatgccagtttcctggttttggtatcgtattacagttacaaaagatgagaccactctgtggtatctttgcaacttcctgtgaatccaaaaaatttaaagttttaaaaaagtcaaatgaagggggggatatactacaggcagatgggaaatcagaaagaacaccagacatgagaaaagctgattaaaggacaaacagatcaacctcaaattacactgtacacagctgaaccagtaactgaagaaagagggccacagcttattagcaatgagattcaagaaattaactccaagtgacatatttattttttccttatgtttactaaggatttctgctgtggattcatcatcttggagacatctttatactgtgaatcatattacaaaaaccgaattaagaagtgtcactatcatccccagcaaaagaaggaatttctctgtgtagctaatgtaaataatatgtttttcaaaacaacttaagttcagcctacattattctacaaatctttgttttagaatatgaaaaaaatagttccagaagccaaattacaacaataatggtaagttgttgtttttattcctgaagtattaaaaaaacagaaagtcattgtatatgaaatctgatacaaaaaaaccccagtgtaacaaagcagtatccatagcaactacaacttaatatttcagtcctcttcaactgcagtggattaaataaaatgacaagatgttccctttgaaaagtaacctgttaccatggaaacgttttattctaagaagtaaacagggaatggacagaaaggagcagggagcctgtaaatgaatatcaaaaagggagaagcatctttgcagaggagatggaggtggcgatggcaggcaaagggagggtctgtgagaagagcatgcctgctagatgcaggatcccagcccaacccagaggcttggcccagaacatgatgcggccacttcttcaccctgaagaaaggggaaggggcaggaaggcaatgttctgtgaacattcaccaaagacgcccaaagatctctatgtgatcacggtgactgcttaagataggcacttgattctacaagggaagatgagggaggaggatagagatatgggaagaacacatgaacagaaggcaccaccatgaagcaactaagggcaagagctgaccccctcattcagcccctccccaagccttgggtcctaacagtcgtgtagcctgtggcccattcccaaggtgctgggacagaaaaggctcaagtcagacccttgttctgtggctggcgtcatgtatgaatgagatcactgagaaatctctctccctgtccttcagatggtaaatatcacacagcagacattcttatcttttccacagggtattaagttgagcaggaagactgacatggcatcaacagaatgaagatcttagaaacgctacttagtacacatttagaaaatgaccacagaagaagtctgtgggtccagaacaaaatacactacattttaagaaaaccaaaaggcaatttatcagaatcacttttttagatggattgtgaggtaggagtgaaagcgaggattaagaaggaagactagtgcaatatgctgggtttctcaattttccccagcatgaacacatacttcaaagctgccctgaacaagtctgaaatttctttttaaaatctaacatagtatcttaaaaagccatgcgaatgttgtattctatcccatcatatattcccattcatttttagagaaaaatttccataaatctgaataaaatcattgtgctggccgactctgggcacactttctgtgggttagccctgctccttaagaaacagcaataaataaataaacaaataaacaaacaaacattaaaagaaacatcattgtacttcctattaggatctcccatgacactgtcacacccacacctgagtctagatgttcaaaagcagggaaagagcatggtcttcagaattaaatgaacctgaattaaaattttagtatcaggccaggcatggtggctggctcatgtgtgtaatcccagcactttgggtggccaaggtgggtgggtcccttgtgcccaggagttcaggaccagcctaggcaacatagcaagacctagtctctgcaaacaaacaaacaaacaaaaaacccaaccaaccaaccaaacaacaaaaacaacaaaaattaaaaattagccaggcatggtaaaatgcacctgcagtcccagctagttgggaggctgacacaagaggatcacttgagcccaggagttttgaggttgcagtgagctatgatcacaccactgcactccagcctgggcaacagagcaagaccctgtcgctaataaaattttaaaaataagtttcagtacccaggttttgtttgctctgtgattttgaggacacaattaaatctaattccttagtttcctcatctatgatatgaagttgataatgttattatgcaaggttgctataaaaataaaagatgatttatggaaagaactagacatagtacctattgcttaggggtcattaatattattaaactctatatactggcaataagtgagaatggaagctaatcctgctattatgagttcccgaagtaccacttacctctccttccacccatatcacagtcaggattttatatttattttttgtagttatttctttgaatggctgtcttgccctctagactggaagtacatgcgggtaagaactaaaactggttttggtcaccataatgcagaactcactggctcttactagatacatttttaataaataaatgactccaatattctaactcaactactgcttagccacagacagcaagcaagggctctgctgcaaagcttagctagtgaagtccccgtgacagaaagccagccctccaagcaaaattaacttaaacgtaggtttgattaaactgcctaacaggaacaaaattcattattcaatcaaaaataaaactaaaaacaaatacaaatgaaaaaacaaagagatttagtcaacttaaagttaccacttccatattcacacacaaataaatacaaaggccaacacaagaacttgtccaaaatccaaaatcataaaattctaaattttctctgtggaaagttcctgagaggccattgatccaatcttctagcttaatagaagaaatcaaggcctgaggaaagaaaagtgctcttttaaggggtcacactgagttaattactgaagaagactccaggccacaccggcagctctcccacagggtcctcctaaatataattcagggtccagaactagaaatttggcattgcctgaagaataataagaatttccatgctggtaagatgcagtaaatatggcctccacacacaataatgtatgagtaatgtcaggaaaaaaactggtcaaaaaaatttaacaggtgagaaagatccagtttcaaagtgctatagtgactttgctccgttgtctaaatttcttatctgccttctctctcttctccattatgtggtaacctaccgtgtatctggcaacgtcataaaacaacattccaccacaggctcctagggaactttactgtaatggcctgtggcaaagtttaggggctgcggcctaacaaagctgcctgcacacacatggagattcagccaaaaaactttttaaaaaaaaaaaaaaaaaaaaaaccactatgaccgaaacccacttacaaagcagcagtcactgtagattaagctgctctcctgacccaagatggtgctagctttctgcatattgaaatcaaactgtataacaaagctgaatgaagcacccccagaaaaaaaaagggactttggaccaagcaagcatgtctacaacacgtctaaaggtttctttgtcccctcagggaaatgttataaaaaaacatgacaattgccttattcctcctcgctgcagtggtatgaatatagaaggaagagaacacaaacaggcaataactaacacacacacatgcacctagtgtgtgtaagtgagaaagtggcaggaaatgtttaatgctgaacacacccaatattataaattatggaagtagagcttctttttttcaaaaaaaaaaaaaaaaagaactccaagatgtataaagaaaaacataaacactcaaagagagtaagaagaaagtggatcagtaaatagttattaaacatactggtggttaataattagtgtaattcctaaaacaatccctagcattgtcttagttgaacaggctattaaaaataaaaagatgttggccaggcacagtggctcatgcctataatcctactattttgggaggccaagacaggaagatagtttgaggccaggagttcgagaccaacccaggcaacaaagtgagacctgcatgcctattttttttaattaaaaatttaaaaatatatgttgttgttgagataatcatatctacatgagcttgagactgtacatttgacctgcgaattaataacaataatgtactaagcaactatgtgccaagcacttccaagttgttttcatctaatctttacaaaaactgtaagaaatatttatttccagattacccatgagaaaaatgaagctcagaggagggaaggaacctgtcgaatgtcaccgcttgcccaattgtcacttattaggtggaatctgaaccacactacctggctccaaatctagcctttcctcttaccacagatgatgcattcatttattcaacatattcataccaaagacccatttgccaggtactctactagaaatggagaccgtaagaatagacttggcccctgccccaaaagcttgatgtccaatagggaaaaaaatcaaataatcacaaataaatgtgtagctcaaagaagtttgatagaaataatctctaattttcccagttgaattaagtgttttaccttagactcaaagtatcatagagtatacaatatgagatcagttatctttcagaattgttttaaaagtacattcaagcatgagtctcattagaccaaaaagaaaaataaatcagactcatgctttatcacccacagttgcaggaatacaggcatgcccctatcagaaactgctcagaagagatgataactaattatctgtgcttatttaggagaagatttgtgaatgtacacaccatctaaaatattcctttagctattattttctaccttctctctcatcctgtcagacatttatgttacagtcttagaatacacggttttctggtggaagacaactcggttgagtaacaaacaaaaagtacctggcaaatgcgtctttggtatgaatatgttgaataaatgaatacacaaagtaaaatggaaaagaaaacaaattcagaaggaaaagaatcaggaaaaaagaacaactagagaatcacagacatctggtcttagatatattagagtcttctaattcataaattaacacagtagccacgagtcaaggaagaagtgaaaagaagattaagaatgaagtgtcagccgggcagggcggctcacacctataatcccagcactttgggaggctgaggcaggcagatcacccaaggtcaggagtttgagaccagcctggccaatatggtgaaaccccgtctctactaaaaaatacaaaaattagccaggcatggtggcagatgcttgcaatcctagctactcaggaggctgaggcaggcaaatcgcttgaacccaggaggcggaggttgcagtgagctgagatcacaccatcatactccagcctgggcaacaagagcgagactccgtctcaaaaaaaaaaaaagaatgaagtgtcaggccaggcacgctggcctgtaatcctggcactttgggaggccaaggcagcatggattgcttgaggccagaagtttaagaccaacctgggcaacaaggtgaaatcccttctctacagaaaatacaaaaaattagccaggtgtggtggcgcccacctgtagtcccagctatgtgggaggctgaggcaggagaatcaccttagcctagggaggtccccagggaggtcaaggctgcagtgagctgagatcacaccactgcactccatccagcctgggtgacagcgtgagaacctatctcaaaaagaaaaagaaaaaaaagtgacatgtcaattaaacacaatcaagttcattctagctttcaaccaaagacagactgcaaaacttatgttgacagaggaacgctttaaatgtgaggctccctcagattcgaattcgagattctattacaatgataagaacaactaataagatattaactttgtgaacttctctattttttgaaacatctacttgctacattcccaacatttcctgatattctcaagtgcaacagaagcagaaccataagccaaaatgaaacaaactagcatcttttccatgttcaagctacacagaccaaagacttcatcaaccaccagagtaacttcccatgtgctgttccctcacctcctccaccagacaagcacagaagccctgaagcaagcctttagcattccaaaaaatatttttcccagacaggataatatagaagaaatacataccacactcattagagttactttattggatttgaaacatagacaaattcgactcttaacaacagaatatccacagatcacagtcagcaaccacaagtcttcaccatcaaatagatggcggcatccaagctccataaatacagatttgtactaggcccacacaggccagccacaccagtggcaggaacctgatccagagctgattcggctgtgagcacagcttcctgttcacatttttatttgttaactgtaaagaaagtttcagaagaggtaaagatctagaacagaaaggcaatattctcctgactcaaacaatgagtttgttccttgagcatgaaatgtgagtcctgcccagatcccacaagtgcatgacagaaagtggtgcagtgtccagttcctctcgtctattgaagggatacttttattaaaagaagcaggaaggaagagcaatggtgcttttaaacagagtaaaataaggcgagttccagaagcaacattatatggtatggggtacctccccaaaactccccagtgcaatgcccaaataaatatggtcacaatgggaagaaagccctcacatgggtaaaaaaattgatcacaaaaataataaacgcacaccctaaattatccttctacaattcatctccttagttgcaatcccaaaattgaatctgtaagaatacagattatacttcagtaatattttcagtgactagaattcaccaacattagccttcctaaaaactttccactaaaatcaagggcctccctggaaagagttgaccatgcaacactccaaattcacactacaccactaagagcttacacaaggaatttctccttgtatcaatgcatagtaaatttcttctccttcctatgagggtttttcagttgcacattcttctatattgtatgctttcttccatcctcacaaatgcacaaaatttaggtggcattcaaattttttctaacctttatcagaagaaaaaggagtggaaacaaaaaggagcaaacagtataattcaaaaacttcatttaatatctacttgggtaagaattcaatttgtcctaaatcttattctgactggctccctaaataaaccacagtgaaagccatctgtctgaacctgctctgcaacaggacaccccaaaagcacaacttcccctgggtagaagaaactagtgtctggctatcaagcagtgggtacgaaatgaggccttgtcaatgactgccttctcagcaccaactactctttttactccatttaagagaatagaattccaagtcacatgacaacatacacatatgcaaaaaatgctatccgattctaaaacagatacaaaaataaacaaaatacctaaacttcaatttctaacacaaaagtcaatgcatactttttttaattgccaaagaattttccataagctctaaaaggaagatgagtctgcttccttttgaaggcaagagactaagtaaaaactgatgtgacataacctttcatttttaaaaaaatcaattttaaggtgttattgttgcaatcataattcacaactgttccctgaatatgtcagacttcagaaaaagatcacaaaaattataatttgctctggcaaacaggctctcaatcaaaacaaggttccacccaccttcaaagcaaccaatagaagcccacctaccatccttcctaaaacatccaaacagagctgctctgcggcccaggcattccatactagccacaaggcaagggggcggcctgcaggcttgctctgcaggtcttgaaggcaaacaagcttggcaacacacacccagcacgactgaggttaagattatactacgagccgaagaggtaaggggaagaggacagggacagagggacccgcaaagcttcacattctatatctgctgaatgcctctccggtagtccccattcttagttctgattttacgcttcacaataccacctacatggccagctagggctgaattaaaggctctcaggaacatgcactatgaatgatgaaatgattcataaacaccttcagaagtgagaaagagcagcaaaacccatcactgtttcggtgaggccaggggaagatagcctacctgcaggggctgaatggatcatccatgactaacacgggctctggtgagtctagctggattcctgaacctttactttctgctaaaactctgcccttttctacactaacaactcaaaatggaggcacatgcagtctcagagacctcatagagctttcactgagcttgtgctatgacctaagccttcacgcagaacgcagaaacttcccctcactctgacaggactgagcatgtgctgtgaccctccctcatccacacactgtctctccacgacgcaatcaatctcaaccctgctgtttccgtaaataaagcccagccaacagactctgcagcttctccctgcacaccaagctagtgtgcagggaagtggggccttagaaaggggatccaagacagccaacagcagggaactgagcaagcccagccatggagaggcttcagttaaatgccctgctctgtcaggaactcagcaagccaagccacggaggagcgtcagttaaatgctctctgctctgtcagcacaacagcaagttttgtctttttttttttttttttaaggtaaatggtgattttaaaaagcaagatcaccaagaaatagaatcaaaagacagatatgaatgactacacacaagatcaactaatagaaatactgcaacacatttaaaaacatagtagtagctacttaagagaagcaacttcacaaatttctttttgaaactctaaacattttgaaaaagaccaaacaatccgggtaaagttatggagtgcttggccttgtcacacaggtacagacacagtgtagatggtattgtgagcagggtagctaaagaaaactgtattttctgcaaacagcttaatcttccttagataagaaactaaaaataataaataaaacattccccaaataataaattaaaacatttcctaaagtaatactagcccaatcaagtctagcttgaagaatctaattctaacaattagaaagacaggaaggttcaagattcaacatcgtgccacaaacacatgaacatccaaaaatctcatttgaggtcctgattcaaaatactaaggcagatccatataagaaatcctagctttggatgtgcaggcttagtttccacttacaaactaagaggtgattctatagattattaatcagttacaaaaagaaaaagaaatggaagaccatgaacctcgccaaaattataaaggacaagatagggcaggaaagggcagtgccaattctgtttcccagaaatgtaatggaatgtcaggaaattaaagcctgttgaaaagaacacacagtgtcctcaagattcctacagtgaatgcagaatcaattccatttccatagcactcccgtttatgctatgaaataaactaaattctgaaactatgattcaataaactcttatcctgccgataatgtaatttagaaaatacaagaaatgccaagtacacttaaatacgttttcctttgacctaacacatgaaacaagtatctacaggctggaagaacattttcccttattggtatgtgagacaacatattcccaaaactgctgttactaccaacagtctagagaaaaatactttctaaacacaaaagcaatggaattagaacctagcagccaaataatatgaatatgagcagcaaagaatttcctcccaaaagtgtatatattaaaaaaaaacaaactatctaaccctttcatatggaaaatgtttacttgaagaaatcaacacaaaataatatgtaataaattcatcagtctctgaaagcccatgaaactgttacatagagcacactataaaaacggttactgtaacagcaagttaagaaatgtggattctaattttggtctcattagatgccctgagttaccaaaatccaatggccttcccctgtgataatggattccaatggtggcgccagcctttgtggatatcctcttcattgtctttcctggtgctggcatctcacagttggcttcacatgccatgccaccaagacagacagccctttctcttgttacccctcaggggcagcgtaccccagcggccacaccccagatctcctctccttcacactctctcccgtggaaaagtcacccacactaccaccatgccagccagctccactctgaagacacttccttcctggcagcagctcagaaatgcaggagcccccggaatcctctcactgtacctctctggggaactgcacctctcttattagattctaagtccttcagggacaaggacactacctaaatcatctttattggaaccacccaactctcctattttgtacctcaaagaactctatctgaagcagtggaaagggcacagtatcactcatatagtatggctggccaaaattacataacctagatctaatcgtggggaaacgtcagacaaactcaaactgaagaacacttgacaaaactggcttctaactcttcaaaaaggtcgatgtcataaaaaatctttaaaaaaggtgaggaaacatgttgtgaaaacaaagagagacaagggatattaaagagacacaacaattaaatgaggcttatgatcatggggaaaattactatgaaggccgttgttgaaaaaactggcaaaatctgaatatgaactatattggactatatcatattgtattaatgttaccttttctgattttgataatcataccatagttatgtaagataattttcttgttcttgggaatacacactaaagtattcaggggaaagggtgtgatgtctatatttcattcccaaattgttcaggaaaggaaaatacaggttgagttatcctaatcccaaaatcccaaaccaaaaatgttccaaaatctgcaactttctgagcaccaacatgatgctcaaaggaaatactggaacgttttagatttttggattaaggatatagaataagcaaatattccaaaattccccctcccccaccaaaacatgaaatccaaaacactcttctaaccccaagcgtttcaggtaagggacagattcaacctgtaccacagagagagtcagacagcaaagatggtaaacacagacagcaatacagcaaaaaaagagatagaggttatctcataaagtgtatatttctaataattttgtgcatgaaacaaggttttgattgggttttgattgtgatctgtcacaggaggtcaggagtggaattttccacttgtggcatcacttcggtgctcaaagcattctggattttgaagcattttagatttcgaattttcagattagagatgctcaacctataatagagcaaacctataataaagtttaaaaggtaataaaataaaataaatataaagcaaatatggcaaaatactaacaactggtgaattgagtaaaagatatatggaggttctttcttgtactagtctcataactcctctttgaattatgaatataaaattccaaacagaaaaattttaaatatattaaacaaacagaaaatatatccaccagcctccacaaccatcagttctcccttcttttttttttttttttttttgagatggagtctcgctctgttgcacaggctggagtgcagtggtgcaatctcagctcactgcaagctccgggtcctaggttcacgccattctcctgcctcagtctcccgagtagctgggactacaggtgcccgccactacacccaactaaattttttaattttttttttttttttagcagagacagggtttcaccgtgttagccaggatggtctcaatctccagacctcgtgatcctcccgcctcggcctcccaaactgctgggattacaggcgtgagccaccacgcccggccacaaccatcagctctcatggcatctggagagctgacacaaggggcaatgaatgacctgcctccctgcctgcagtcatggtgctctcacccccaaacagaagtcaattaacacccagctccaaactcactccaatctcaagaatataggatcagtcctcctcctcctcctcctggtcagagaatctcaaggagtcttgaaaccgagcagttccataattaggttagccactaggtcacattcaaccacaaattccaattttagaaatggggctctgattccatggagcaagccttgctttacactgagttcaccctggtaccctactcagtgcttaagggcatcccagagaggggccttgttttctctcctagttctcttgaacacgggctgcctgtgtactgatgctgactacccacctggacctcactcctgccaccacattttctagcccatcgtttgccagcctgcagggatgtacatacaatctgcaacctggcaccctcgtatttccatctgttgccaactgccaaggccttcccagaagtcctgtgatccccatgtacatctataatctctggatcccagacatccttctctcctcctattaatcccaagtgaacaacaggtgtaggattagcacttctgaatagactaaatgagagctgagtgggagagaagaatacacaattcaaatcaattttttctaaaattaaaaaaaccactttgtccactataatacttaaatttgtagtgagtagattatgtacctctatcaaaggtaagtaaaagctgtaacatgaaaattgcctaagttttatcttaaagaatttcctacttcccagaaacaaaaaatgtctacaacgttgtattcattaacaagaaactttaaagccaaaatggggaggcggggcggggaggggaagcaacactcaggaaattctagagaaaaagtttggaagagatattctaattagtactaacttcacatcaagagaggagaagtattcagaagcagtttatttaaatttcatttactaattgccccgcatatctagacatggaactgagttttcgttttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcccgatctcctgacctcatgatccacccgcctcggcctcccaaagtgctgggattacaggcgtgagccaccgcgcccggcctgaactgaactgagttttctatctatctatctatctatctatctatctatctatctatctatctatctatctatctatctaactttctatctatctgtccatctttctatctatctgtccatccatccatccatccatccatccaggaagcttgctgatttacctattagctttaacaatttggatgggcccgggggctcacaaatataatgagaggccgaagtggtgggtgacttgaggtcaggagtttgagaccagcctggccaatggggtgaaacccagcttctactaaaaatacaaaaataagtcaggcgtgatggcatgcacctgtagtcccagctactcagtagtctgaagtgggaggatcacttgagcctgggaggcagaagctgtagtgaggccagactgcaccactgcactccagcctgggcaacagagcgagactccacctcaacaaaaaaaaaaaacacaacacaaaacaaaaccaacaccaacaataaaactaattttttcacaagttttctcagatttcctatggtgaaaattatactttattaataaatgttcattttttcatttccaaccctcacatattttcttcttcaagtcttaatggatattgaaatcctgctattgtttctggtttcagaggaaaaagtttccacactctgcctttaactatggtgcttgctgtaagtttatggtaagtattctgttagattaaggaaattcattctacaattaattttccttttctaagagtcccctccccaattattacagagcgttgaattttatcaagtgctttttctacattaagatgattgcatgggtacaaaaaaagaatgaatgaataaggtctagtatttgactgtgaaacagggtgaccatagtcaataataatccaattgtacattttaaaataactaaaatagtataattggattgtttttaacacaaaggataaatgcttgagggggtggacaacccattttaccatgatgtgtctataatgcattgtatgcctgtatcaaaacatctcatgtaccacatacatacgctatgtatccacaaaaattaaaaattaagaaaaagatgattgtctatgttttcttcttctatatgtcgaagaggcaacatatgctaacagataaattattaaggcattcttatattctataaatttggacatgcatatttaccttgctagactccgtttgttaacatttcatttaaacattttacattcatgttcataagattgaacctataaattttatttttttaacctggttttataataaaggttttattagcttcataaaatgactcaggggacccataacaactttctctgttctctggaacactggtagaattcacctgtaaagcatgagtctgattcatttttctttttctcttttatttggggggggtccggggaggggggagacagagtttcacttgttacccaggctggagtgcaatggcacaatcttggatcactgcaacctccacctcctgggttcaatagattctcctgcctcagcctcccaagtagctgggattacaggtgtgcaccaccatgcctagctaatattattatttttaatttttttttgagacagaattttgctcttgttgcccaggctggagtacaatggcacaatctcggctcactgcaacctctgcctcctgggttcaagcaattctcctgcctcagcctcccgagtagctggggttacaggtgcacgccaccccacctagctaaatttttgtattattagtagagacggggtttcccatgttggccagactggtcttgaactcctgacctcgggtgatccacctgccttggcctcccaaagtggtgggattacaggcataagccactgcccctggccctttttttttgtatttttagtagagacagggtttcaccatattgatcaagctggtctcaaactcctgacctcaagtgatccaccgcctcagcctcccaatgtgctgggattacaggcatgaaccaccaaacccagcctgatttatttttcttttcggtctaatgagattaaaaaaattatccaatgcaaattataaaaactgcctttaaagggagaaggtatgcagtttttacctatttcctctttcttccaggcggaaatctggatgtaatggccatcactacattgccaaccttgaaacaagagaacagtggcagacaaggtagtaaagggtggacccctgatgactgtgaggtcctagtctaggagtgcttcctttcaaactctgcttacatgagagagaaatgaaagtgatattttatttaagccttttacacagtctctttctgaagcttccagtatttgaagttctcgggtgtgtcttgctgtttgtctcatctgaccacagttaatggtacatggtttcttccgatatttctgacggtgagcttggcattcaaggatattttatctgtggggatcctacaggatcttggatgagggtgtctcccattaaaaaacattttacatatgcttctgccaggtatcttgaagggtttactggcatgagaccactttttatattgccttcttatcctagagttctcatattctgaagggcccagaatcccaaccctaaacaggtgggtttccctgttactcccctctaggttggaaaatgttaacaaactcaatccagcctcaccatgagctactgaaagatcagcttactgctttagttttcagtttctcttaattctttggagctcagctccgcagttaaaagttttgttatgtgttattccattactccaggtaacattcctagatgttatctgacaaagggtttttgaaatgatcaaagggtttttgaaatgatcaaatcaaatgatcaaatgaaaaacaggcttttgtcctgttttattaaagttatcttaacttcagtaggctttgttttccaaaaatacatgtactctcaaccatctccaatattttccatctcaggtaaatgtttctgagaattcaaatgtgatggcagataaaagcaaacaggaaaaaatttgtatccagctctagctgctcatcttcaaaagctacacaaagaccacgagctgtggtgagtggaaaagggaactgttactcaaatgcaagtaaattttagaatgtctcaaattcaaattagttgaaatacaggtgttttagattgttaacttttccacttaagtataaagatttatgttgaggaaaaaaatggtcccaaggtcacagagcaaagtgacagaaaattaagaaataaagacattaaaaataatgaaataaggtttcttaatgttaaagaagaatgttacacataaggaaaagggaataaactagcagaaattctgtagtactggattgaacttggagaatttcacatgaacttatgaatatacacacataaatacaaaactataggtgcaagtgtgtgcattatatatgcgatagatacaaacacacgcactccctagctctgtttctcagaaggtcagagagcagcaacacaaagtaatgagcacacttagcaccaaatctaggctttaaaatatcattctccaaacactgggacaatctgacctcaaaatgaataacaacagcagcaggttataaacaattaaataaaataggaggccattattccgctaaataaatgaataaatcgaaagtttgatgaagatgagatctacacagtcacaaagcaacctcccacaaaatggttattaattaaaaagggaaaaagagacaccgtacaatggcaaaacctggcagacatcacgtccagcaactggtcaaagtgaacattaccagcaactggacaaataagaattgtatactgacaggatacagaagaaaagaacacaaaatttctgtgatacacgatctaactctaataataaggaaacaccataaatgcaaactgagggacagctgggcacagtggcatacaccagtagtcccagctactagggaggctgaggcaggaggatcacttgagcccgggaggatcactgaggggggagggaggatcacttaatctaggctgcagtgcacttaaaccgtacctacgaatagccacctcactctagcctgggcaacataataatactccattgctatttaaaaaaataataacaataacgcaaactgagggacaggatacaaaataattggcctattctcttccaaggtcatgaagccaagaagcaactgaaaaactgttccagatttagggagactaaacaaatatgacaactaaatccataatgccaaacaagatccttctgttgtaggtttttattaggaacaccggcaaaatttgaatagggcctgagaataccatggtaataatattttcattgttaatttcctgattttgagggctgtattgtggttatgtaagaaaatgctcatgttcataggaactacacaaaatactggagtatgaaagagcttcagggtgacaacatactttcaaatgattcagttaataaaggtcttctactctacttacaaggaactattctgttttaaaacaaaataaaatgcacacagtattctaactaccacactaactcttaactcttgctattattaacattattgcagttgtcagtctaggagagagaaagtatagtccctgtaaatgcctcaagtttatgactgctcctgaacataatgatagtaacatataagcctcaacactgctgcaaaactacacttctaggaagaggaagaggagaagggagaaaaggatgagaagaggtgggagaaaagcggacagcctgcaggagatttagccgggcatggtggcccctgcctgtaatcccagcactttgggaggctgaggagggcagatcacgaggtcaagagatggagaccatcctggccaacatggtgaaaccccctctctactaaaaatacaaaaattagctgggagtggtggcgggtgcctgtagtcccagctacttgggaggctgaggcaggagaattgcttgaacccgggaggtggaggttgcagtgagccgagatcacaccactgcactccagcctggcgatagagcgagactccatctcaaaaaaaaaaaaaaaaatcagatatttttcaatcttgtctctaaaagaaaatttgtaattacttctgcaattcccaagaagaaacaaaaaatctgacagtttacagaagttttctgcagggtagctttcatcatccccatcttactgatggagaaacagagtccagaaagtgcatgctttacccatggacacgaggattaagtagcagcacgggactagaacccaggccacccagatccaagaggtgagatcttaccagatggctggaaggatcaagccgtcagattaaatggctagaaggtgttagacaaatgaaaaaagcaactaaggacagtaaagagaggcatataaccacgtccctatggtcatctctttttgtaagctaagaccaatctattttatattttagtttaaccaccgacgctggtgttttagccaaatgcacctaaggcctcctaactggctttatttatgaagacctctgagctgaaatttattgactttattaagtttcttggcagactctggatcagacccttcaaacaaacagagaacacaatgacattacttgcagagtatgctcaccacagaagtaaatctggatgaatcttgttcacatgtacaaaactgaacactccctgagtgcagaaatgtcaaaaacaaactccaaaagcaaagcccaattacctcagggttcaaagtcaggtcaacattagatttaaggctctctcatttttcacaatctcttagtagtttgtattctacttgggcaaaaaattatgccccctaaatttttgcccaattaagttttgttcccgctgagtggagcggctcatacctgtactcccagcactttgggaagctgaggagggaggatcgctgaagcccaggatttagagaccagcctggggaacatagtgagacctcaactagacaaaaaatttaaaaaatgagccagggatgatggcgcacacctgcagtcccagctacttgggaggatgaggcaggaggatcacctgagccaggtaagttgaggctgtggtgagccctgatcacgccactacactccagctgaggcaatagagtgtgaccctgtctcaaaacaaacaaaaaaataagttttgttacttaaatttcatggctagcactaatacagagtcataatcccttatctaaaatccttaggatgagaggtttaccagaattcagaatttttattttagcactacagcaaatatatcacagcatgtaacaccccagcagtgttcatgtaataatccatattccatcatattagtatttttagagtaaaacttacacaaactcacacaaagtgaactgaattaagaatataaatagcctcctatcagttcaggttaggttcagccatcaaatacattttggcaccaaccttggcataaaatttgttagatcttcagaactttcatatttcagaatttaagataagagagtatggatctatattactatagatgctttatcagtattaataagtattctagattaaaaagaatgaaatataagtttatacctaataataacaaagtaattccatgccaattaccaagaaatccattcttcccaaatgttaaaggcaacaaattctagagtacagaacagtcagtcagtttcccactatcacacattattagttcaataagtggtaatccatcaggaacaaaaaaaatcagatccctgacaagatacaacattcagaaatataatgaccaggttagagaaaaaaataaaatgaagctgtacactgaaatttaaaaaggatctatgcaaataaatgtgaaaaaaattccaaaatttcagtgctgttcaatatgctaacaaagtatggaaaattacataaatcaacgtataactacttttggaaaatcagctctgagaaataaacagttccatcttaaggttcactttcaactgctcacttaaagttcctgcattatttaaggagacaacagtcatgaaagtctgcagtcatggaatcactattccttaaatttccagtggactttcctatatgcagtattgcccaggaccattacacaatcagaagaactttgacatttcctttctacattaacttacatacttacctaaataactcagggcactaagagtcagcatacagtacactatgtagccacgactacttactagtcctactcattaaaactgggggaaaactatataggaaaccagcttatcatacagcctcctccctcacaaacgtgaaacaaagacagaaacagaggtaaattctgcaagggtatgcaccctgggaattctaagaactgggctgtgcacagccagtttttctacactctgttaaattagatgcatttttggatcatttgagcagctgtgggaactatagccctaaccccaaacttcagagatataaggaaatgttcgggataacaccagcaagccaaggcagtaggctgcattagctccactgctgcaaatgtctacaacggcctttacacttcaactgtgagaagtttgagatttgcctcaaagtttacttataaatgggcacttaagtatttgttcagttcaagtcatccaacactactcaagcacttaaaacacacaaagcagaaggtggacatagggaacacaagtgtagaagaaaatcagtggtgactagaaaggtcactaagggaagtgattcaggatgcagatcctgtaagtgtgctgctatcatcatgtctctgtgttccttattgcatccatattttaaaacaaacccgatgggatgtattgccctgaaagactgtcagcagcacacaatgaaaaataagaaaagaacttgagtgagtgcctggtttacaaaggtaagttacatattacttttaataagcattcagcaaaacatgtataactaacatttgtaaaaaataattttggttagttgttacaaacctgagagttgaagagttaaaagacaaaagctactttagttaattaatataacttgtgcaacaggaaaactatcaagtgattaaataagcacaatatcactaaaataacatccaattcctttgtatctagagagaaatccaagttcaagcattttacaatttacctgggcaacaggaagacatgagaaggtagccaataaatgcatatgtaaaataaacatttcaaaatatcagatgcttaagaaatattaccactgaccagcttctttatcattggaacacggcatacttttgaaaaaacaaacaaacaaactcaaccatcatagttttctttcttttccttttttttttctttttttctcgagatggagtcttgctctgttgcccaggctgaagtgcagtggggcaatctcggcttactgcaacctccgcctcccgggttaaagcaattctcctgcctcagcctccagagaagctgggattaaaggtgtgtgccaccatgcccagctaatttttgtatttttagtagaaatagggtttcaccacgttggccaggctggtcttaaactcctgacctcacgatccgcccgccttggcctccaaagtgctgggattacaggcgtgacccacctacacctggccaagcatcacagttttctaaaggagaaaaggtactctttgatgagcattatattactatccatacatcaagcactatctagaatctagcttctgatgctgtctagaaaatagcatccaatattgagaggaagagagggagacagacagacagatacactaatgcgagccccaagagagctgtgggcagcttcataaaaccacaacaaaaaacacgttcccttctacccctacgttgactactcaacaacattctaagttttacatacggtttctgaaagtcctctagaaaaatgttctcaataaaatgatacccattttgcctttacacttaatgtagttcttttgctaacttctttgagccaagtattatttattatttatttatttatttattttttattcttttaaaagacagggtgtccctctgtcgcccaggctggagagtgcagtggtgccaacgcagctcactacagccttgacttcccaggctcaagcaatcctcctgcctcagcttcctgagtacctgggaccacaggtgcagcccaccacgtccagttaatttttattttatattttgttgagagaagaggtctcaccattttgcctagctaggctggtctcaaactcctgggctcaagcgctcaagcaatcctcccactgtggcctcctaaggttctaggattacaggcatgagccactgcacctggccggggatgttttatttccttctaaatcttcacatgtataaacatgtcttgggtgtccagagcatatattacttgatcagtggctaacatcctgtttttaaaatccttaataaaatatgcagtcacatgatcaatacagggcaagtatgaatatatacactcataaaaattcttccacgtgctacattaaagtagcatctatgacagacataaaaattgttaaattactctgaccctattgcttctcattttaaaaaaatagtaattcaaactgttacatagatcttaccaagatgttttgagaacttgatgtgtctgactcatactagtagtcttactaaagatatttcagtgtgtgttcctggagttttattaccaagagtgaacaaaacaaatgagtaaccaacaaactttccaaaattacttagtctttttcaatatggtattatggaaggcttgacagaatgtgaatcagggaaataatctaccaattcttaatacttaattcaaaatacagataaactaaaagtatatctttatcccaccttctttcaacccaaattttctcatttttctttttctgaataaaagtaaagagcaaacaaaaagccactttagatgtcaaagacattaattacaactcctcccaaagaagtttactgaaggactctggagtcattttttttaagtatgttactagtgtatgtccagaagcataaactacacacacacacacatacacacacacacaaatgagaaaaggaaaagagttctcaatgaatggacacaagtgactcacttaccttgtctcagggttatatcctaatatgtagaaaaatgaatccactcgggctttaaactctctagcagcaaatatgtcagaaaaatgggagatgttacacttccctctgggaaaaagagaaaaaaataattagtaataccctcaactgcttttgctaaccaaaactggagggggaagggtggaggaagcactgaactaagtccatgtgcatggagaatcggctacaaacaccacactttatttcacctattcagctgtttcatgactgcttcactgtacacctgtgtaatctgactgcttttatatcaccattttactaataaagtaaaattaattaaaacaacaaagataaactggagacaggactatgagaaagaatattaaacaaagtagaaatggagaaaaattaaaaccattgtgaatataagaaaaactcagtttaaagcctttctaaatcataaaaaaaaatgagcctttcttcctactatattatgataggcagaaagtttaactgtttaaagctaaaatgtggaatatttgacatgtctttggaatacagcttctggccaataaacatttttcttctcctgcaatgtgcaacaaataaagttacttggaaattaaaacctagagaaattttaacttttttgcataaacatgggccccaatatacaaggagttttcaaattttggggtaactttaaatggctataaggttagaaatcactttcccatagaaatactaaaataaagtggagtaaagttttcaggttcatttaccacctaaagttaaaccaacctgtagttgaaaaccctacaatacttactccaaaacggcttaagcaatgtttccatgcaccaagtatcaacgtaaatgccagaagcattatatcacgtggtgaggcctaacttccaaatccaaacacacacacgcacacatacactcactccaggattcccaaagaggcaggggaggcttaagaactctaactccctcctggtcactttaatgccaagtggaagccaaaggctacagtgaggttagatggaaatggaggaccaaaagttcccatttcatatcaaaagccgtgcagcatacttccaggacgtggcctcccactgcttgagcaggctatctgttgtgataagaactccatgagtatgcacggtaacaacatacacaccagctaatggccacagtgttaggaagagaagctggctgaggggttatcagcgtgggttcattcattcacttcctaccaagaaattaaaaagcaaggttcttctttaccttaagggcttaagtacctgtaaccaaagcagggtcagccaggcacagtgacttcacacctgtaatcccagcactttgggaggctacgacaggaggattatttgaggccaggaattcaagaaaaacttgggcaacattagttgagaccccatctcaccacacctggttaattttaaaattttttgtagatgggagtctcactaggttgcccaggctggtctcaaactcctggcttcaagtgatcctcctgccctggcctcccaaagcactgggattataggtgtgaaccactgcacccagcccccatctccattttttaaattaaataacaatgctgttgatataaagtccctttggcaactatagattagaaagtatctatagttctatagaatagaagctacagaatagaaagtattccagggttactgagcacttcaaacaacactgataaaactgagaactgaatttaaaattttatttgatcttaacaaataaattatttgatcttatgtaaatctaaatagctacgtatggctactagctaccatagtgaacaacacagatttataagacatttccatcacagcagaaagttctattagaagtgctatagtattcatacctactatttgtagatagtaagatccaattcaaggaaaaatacagactaagcatcaacttcccaggcccagaactgcctcttctagtatttaactagaactaaaataagcttctgggaaagaaaatgcaggtatgatcttttttacaaatgaacaactagctcactttgaaaccactcatccatacaaggtgatttaatccccgaaagccagaagaaataggttcctttagcagtaaaatagagataacacctactgcacttataaagacaaagcctacaaaactctactacacaatgctatgtaaagtaagttattcctattattgtacattactaaaggaaattgattcttcttttattattgttcgttatttcactcttaaactggagtaattaatgtatcaattaaaggtaaagaaaacccttaactctaaacacaaccactagaaatcaggtatgtttagggcagggtttatcaatcttggcactaatgacagtttgtactaaataattatttattgtcagaggctgtcctgtacattgtaggatatttaagagcatccttggcctctacctagaagcacccatacacatttcttcctcacaacaaaaaatgtctcaagacttgccaaatgtctcctgtgagggaagaaactactggcttacagaaagccaaaagcaacaggaatagaagcatttcatctgataaatgattatgaagttgtcgtaaatgggatttttctctaccatcaagccctttctctatttgattctgtttgtatatgtgaaaggtactgacatttaaacatttcacttttttatcctttcttatgcttctaattgcactgtacctctaatacaatgtggaaagagtgaacatccttggctagttcctgatgtcagtggaaatgtctctcatgtgttcctattaaatatgacactagctttacagacaatcaaaccataatcatagtattggaaataattgactggtttcctcctttagagttaatagtttgatatatgctatcaatagagtgaaaacctgaaccaaccttgcattcctggaataaatcccagctggtcataatgtattttttaaacaaggtattaaatttttaaaaaacaaaaagaatttggttaactacatctaagttttcttcctcccaaatttgtttttatctttattatttccttctttgtacatttttattgttgctattattcatgaaaggtttattcataatagcctaggaacaacccaaatgtgcagcaacagggaaataaacaaatcgtatatatgtacaataaaatactacacaaagatctagtgatacataaaataccatggacaaatctcaaaaattaaatgttgagtataagaagccagacacaaaaacagtatacactgcatgattccacttatatgagctttagaagaggaaaaaataatttatagtgagagaaacctgaacagttggtgattttgggtgggaagtttttagagggaaggatcttgagggaacttcctgagatgaggggaatatgccaggtcttgtttagggtcaaacacatttctgaaaatgtacacttaaaatctacattgtactgtatattaaaaaactactagaggaaagtaaaacaatgagaatcattaccatatagctgtagccatatggtaatgattcataatcttgccagttagccagccctcaaacactgagtattgagcagagctgaagaaagggtttccataaccaggtaaggccaccaggattggctctgactgggtggcacccatttgaagtattttacaaatcaactcgtgatgaacagtgtttacctttaaaaatgtgtgtatatgtgtgcagaagtatgggtatgattttaagtattcagtgttttttatcagagcactcttctcaccatgatctctgtcaaaagtaggacattatttgacattgtttacagaatagatgaggagggaccgttaagagaaaattgccatcacatccaccttgctgaaataaccagttccagagcctcctaaagtcttgtatactctgtatctaaagcaatgcttcactgttaacagaaatatgactaaagacagggaagccccatgtgttagcatcctttcattcaacagtaaaaaaggcgtcccggaaatgactcatttcagtaatccttccgagtggggcgggccccagagagttttacacctggggcatcatccgaagggtcttctggctaccaagaggaggtggctatatgaaaaggatgaagaagagacaagagagcccctcttaagtaaggagacaatacaaatgaaaactgtggcctagaaattcactctcttaaaattaccaataactgggaaggtcttcccgtatccccaggcatgcgcaaactccaaagactcaggacaacgtgcacgagcacacacagaatgtttacagtagcaaatctgttgaaagctattattatcattattaagatggagtcttaagaataaaaaattattaataataaaaaataaattattaataaaaaattcttttttttttttttttgagacagagtctcactctgacacccagactggagtgcaatggcgtgatctcgactcactgcaacctccgcctcccgggttcaagcaattctcctgcttcagcctcccgagtagctgggattacagacgcgtgccaccacacccggctaactttttatatttttagtagagacgaggtttcactgtgttggccaggattgtcttgatctcctgacctcgtgatctgcctgcctcagcctcccaaagtgctgggattacaggtgcaagctaccatacccagtctttttttttttttttttttttttttgagatagggtctccctctgtcacttgggctgaagtgcagcggtttgatctcagctcactgaagactcaacttcccaggctcacgtgattcttccagctcagccttcccggtagctgggactacaggtgcgtgccaccacacccaacaattttttgtagagctggggtttcaccatactgcccaggctggtctcagactcctgggctcaagcaatctgcccagcttggcctctcaaaatgttgggactacaggtgtgggccaccatgcctggacaaaaataaataaataaaaataaaaataaataaaaatatatatatataattttagtttgtacttccccttttgcccaggagttgcttaacaggaagttttaaatttccaggtgaaagggtcttctgttctttgttttccttagtaaactacaattttattgcattttaatcggaatgattttttttctgtgatctaatatatgaccaatttttgagaaggtggcaagatacacaaatcaatgtgtattctttattattacaggatagagttcaaagtatgtctgtaggccaggtgtggtggcttacacctgtaattccagcactttgggaggtcgaggtgggcagatcacaagaggtcaggagttcaagaccagcctggccaacatagtgaaaccttgtctctactaaaaatacaaagattagctgtgcatggtggtgggcgtctgtaatgccagctactttggaggctgaggcaggagaatcgtttgaacctgggaagcagaggttgcagtgagccaagatggcgccactacaaggatgggcgacagagcaagacttcgtctcaaaacaaaacaaaaaaaaaaaacaaaaaaaattaagattattagcttagggggaaaaagtccaaaactgtacaaaatctgtaacaaggaagatttttaaacactcctgaaagacaaaaaaggggatatgaacaatggtaaaacatccatgttcttagataggaaaactcaaactggcatttctccacagattaattaataaatccaatacaatcccagtacaaataccaacaagctttttttttaaaaaaaaaaaaacaaaatattaagcttcacatggaaaaacaaataactaaaaaagaggggaacatatattaaaacatactataaagcctctgtaattcagagtgtagtgctgacacatagacaatagaacaacaaaacaaaaaagcaagtacaaaatacatatggaaagcaagacaatggtgacatctcaaaccactacaatcaacataggtattttaataagtaatcctagaacaactgggtagaattattttttaaatatggtgtagggaaaggctttctaactatgactcaaaatccagaggcaataaaagactgataaatttgattagataaaaatacattttacacaataaaaaatacaacaaataaaattaaatgaaaactgacaaaagtgggagaaaaatatttgcaacaattgccatgtaccacggttgtataaagcactttttaaaagtaaaacaaaaagaaaacccaatagaaaatacataaacagacaatttacaaaaaagagacaaaaatatccttcaaacatatgaaaaaatgttcaaactcattgttagtgaaataaaataaaaacatggagataacacttctcacctatcagacttgtaaaaatttaaaaagacaaaacattctattaggaaaacaggctgcttcatacttatcagaaggaacacaaattggtacatgccagctgaagggaaatttggtaatatgtaacaaaccgcataggcataaacctttcaacccagcaatcccactattataaatgcaccctgacgttcccaatgataagaaaatatatatgcacaaagatattcattgcagcatcatttataattgcaaaatcctaggaacaacgtaaatgctcatgcacaagagagcagttatatcaactacagtatatcaacataaggaagtaaaagagaatgagaaagtcctctatgaactgataagagcaattcccacaatatactgtcatcaagtgaaaagagcaaagtacaaaagaccatctacagtattctacccttcatataagaaagacggggttttaagaaaagaggcatgtatctgctgatttgtgaaaagaaaatgctggaaggatgatccagcaagtaaaatgatcagtaacctagagcagcaaggtgggagcgaagagggaaagaagtagaggatgggaacatggtggcagggttgaagagtatcttcttataaccctgactcttagaaccacagcaatagtccacatgctctcacacacccataaaataaacagtccaggtcaacaaggagaaaccaaaaataggatgtaaacagcaacaaatgaacctaaatgtattacaaataaacaaatgcacataaggaggtaagaaagaacagaactgacctaagtaagaggaaaagcagtatttggcactataagaccgaaaacaaaaagagtcaataaacgggtttctcaccaagacgtgggttacaaattctgaaactaagttgtatgcatttgagaattaaacaaaaacaagtaagtatattttagacaatgagaactgagtttcttctgtgttggagaaagcagttataaataacggaaagtgaagaataaaatcttcaggccaggcccagtggctcacgcctgtaatcccagcacctcgggaggctgaggcgggtggatccggaggtcaggagctcaagaccaacctggccaagatggtgaaaccccatctctactaaaaatacaaaaaaattggccaggtgtgggggtgggtgcctgtaatctcagccactcgggaggctgaagcagagaattgcatgaacccaggaggcagaggttgcagtgagctgagatcacgccactgcactccagcctgggcaacagagcaagactctgtctcaaaaaaaataaaataaaatcttctagtgttggactggaattgaaattaatataaccttacaagtctggagttaggggaagttaataggcacaggctggtatacatacacatcctagctctgcctgctaactggatctagaaacaatgatatccagtagtaacacacatgcctaatacccagatcttggtttctaaacactgctctccactaaagggaaccccggttcctcacagaatggctaattccagcgctggaagttagaaaataaaaaacgagcctgagaacatcttgtggagctagaaataagaaagtgctcaaaaaaatacagaagtttgctgataaagtgcaggggccaatctgaagtagctcctaatggccaaagctgggcaataaaacaaaaaataataaattataacaaaacaaaataaatatccgtaagttcatgctgatgtaaatactcaaatagatttatgggataaaagggagatttctttactacagtggaattccaattaataagtgtagaagaaaagaaaaaaaaatgaaaaaccaccataggcaagcttcacaaaagtaacttttacaggtgaaatccactgataggtgcttaaaatcactgggtgaaaatttaaggagataaatgatttgcagagtgtcaaagtatctcccaggttaattaagcacaggggaaaatctgctttacagtgaagaaacctggcagaagccacattcatcaagtggacaaggtcaatgtcaccagtaattagacattatcaacctcatgaagcccatgataagatgcactcagaaacatgtaatttctgtggttcttgcccaaaatgcctaacttcagaaaagccaaattgagggacatttgacaaaacaattgatcaataatatttacaataccaaggaaggtcatgaatggtaaggaaagactggagaaccattacacactgcaggagactaaggagaaataattaaatgcaatgtgggatcccatataagatcctagaacaacaacgaggacattgctgaaaatcaaagagaatctttagtctaatgctattgtatcaatgttaattccctggttctgataactgtactatagttgtagaagaagttcacattgtgggaggttaggggagggatatattgaacctgagtacttgtaactttgctgtgtgtctaaaaatagctccaaataaaagaaagtttttcaaatactatgaagtactcaagggcagacggaatatcttactgggtaggttcccatcaccaaatatagagcccttcatctactagtagattaataaaaagtgttaaatgatgaatgaataaataaagcaattgacaggttatgatgtctaatgaagtactaagcatgtatagacaaaacaataaaaatgctgtaggtcaaagttatttcacatataaaaacaactgtagattaaagccagataaggattcttaaactgcaaaactaagagctctgagacaccatgaaactccttacagaacttgcaggagctaaagggtgttttttgttgttgttgttgttgttgttttttgttttttttgagacagagtctcgctctgtcacccaggctggagtgcagtggcacgatcttggctcactgcaacctctgcctcccaggttaaagcgattctcctgcctcagtctccctagtacctgggactacaggcaccagccaccacactcggctaattttttgtatttttagtagagacggggttttgccatgttggccaggctggtcttgaactcctgacctcaggtgatctgcccaccttggcctcccaaagtgctgggattacaggcgtgagccaccgtgcccggccactaaaggatttttaaatgttttaaggaatggttgggaaactgtccacagatgtgactaatctgtttcaagccctaaacatatacatgaacctagttgctcataacaaagtagggagataaattaatttataatgaaaagaaacagactggaagcctcaaacagctaatttagggctccttggccctggtcttccagaaaattcatcctaaagcatcttcctataataggagcccctgggtaaaatgacagcctataacctgacctgcagtaggatatttctttccccaagtgactcctccaaataggaagcaggtaatcagaaagctggaaaacagtcctcagtcagcaagacacttacgatctcctgtgctgccctccacaatcaatactggagaatgcactgatgcgagtacacaataaacccaagaatgttccccaggtcacatgtcctcagtccaatcacaaagcaatcactccagatccttggatccttaataaaacattatccttaggggagaaaaagtagcacagaaaacaaattacaagttacaagtttatctgctcgttcttggagtgtgttgagatagctccctaagctgaactcttctccatatacctgaaggaatctaaatatctaatccctcctccgccaacaggccacagagaaatagtaaaataagtgtatgctgagtgattacaccatcattaactcagtacaaaattacacttaatttcactttttcttttcttccacttatacttttaagaactcagcagaaattcaatgagctatggagtgtactacacatgttactagggcctgagatgctctttgagggactttcacactccttaccatactggatgtggaaccagatgtgtgtgtttggttcaggattctgtcattagtcatgtgaccttgaacaagtttgtcaaaggttagctcaaacgttaaaaaacgtgacactggccacaaggctacagcagagccaggactcaaacacaagtcctctaacttcagtctattataccacaatgccagccaaaaattcttacccgggaataaacagaactcaaaaaatattcaaaatgctaactttactctatggtggttatggataaagtgtgatgaaataagatcagcagctgtagaaacttaccttgaaaggtagagataagggatagctaaggtcaagaattcaaaactaacagcaatgcagtaatgctgaacttcaacacacatttctacaactgcgaagggctcagattttcttataggaagaaactctggtaggaaaaagctataatctcacaatttacaaagaaactacagggcattttgttttccttttgattcaccatggctaaaggataaagctctctctcctcctttataacccaactctagcaccagcttgaaagcaaaccttatacatcagtttcctcctgagtgaatggaatggcaagagccccctcagagttactgtgaccggatgaaaccacacaaccgagccctttgatcttcaagaagaatggtgctaagcactaacatgatcagtctttttcttttttcttttttgttccccatggtttttttcattacatttgtttgatcccttttcatgtgcccacagactattttatttgtatctctctcaaaattgaatttatttttagtagtactggtttataactatggagaaagaataaattatttctgtgaataaactatgagaagaaaattggaaaaaaaaggtaaagcttaactttaaccatcccccaccaaatacaccccaaacattttttaagctaatctaccttcgtgaagagaaagagaacaaacagagactgctggggggcactgccatcccattctgttttatgggagtaatgggacaggcaaagcttctttcacagtgagcgctgctgccaagagcgaggccggatcactaagtgacagcaacgcgaccctgcaccattagggaagtgcgtccacacacacgtgtgaccctgcaccactgggccagcacgtccacacacacacaaaactgcaccactaggccagtgcgttcacacacacgtgacaccacaccactaggccagcaagtccacaaacactcatgacaccacaccagtaggccagctcgtccacacacatgtgtgcaacactgcaccactaggccagcatgtccacacacacgtgacacaccagtaggccagtgtgtccacatatacgcgtgcaacacagcaccactaggccagtacatccacaaacaatcgtgacaccacacaagtaggccagtgcatccacacatgcgtgtgcgacacaccactaggccagtgcgtccacacacacgtgcaaaattgcaccattaggccagcatgtccacatgcatatgagacactgcaccattaagccagtgcgtccacacacacgtgacactacactactaggccggcacgtccacacactcatgcaaaattgcaccactaggccagcacatccacacacacacgtaaaattgcaccattaggccagcgcgtccacatgcacgagacactgcaccacaaagccagcgtgtccacacacacgtgacactgcaccactggatcagcacatccacacactcacgcgacactgcaccattaggccagcttgttcagtgaccaaacaaccacctgtcatctgatgtctttgaaaaaaatccaagtcacaaaaggatgttgtatttgacacttacaaaatcaaattcaaggtaaaagttttataaagcagctaccactttttatgaccactttaaagaaaacaccacaggagaaaaaaaaactaattaatgaggattataattatatacccagtgaaaagaagataaagtattaccactgtagcactccagctgtggtggccagtgaaaggacagtgacttacacatttacacatctccaagaaacatctgattgtaaacttagctacagtaaattcatggaaatcagatggaattatttaggataacttgttcttctaaaaatgctaaagataaaaatgggccagacgtggtggctcatgcctgtaatcccagcactttgggaggctgaggtgggtgatcacttgaggtcaggagttcaagaccagcctggccaagatggtgaaaccctgtctctactaaaaatacaaaaattagctgggcatcgtggcacatgcctgtagtcccagctactcgggagactgaggtaggagaatgaatcacttgaacccaggaggcggaggttgcagtaaagtgagccaagatcaagccactgagctccagcctgggtgacagagcaacaccccgtctcagaaaaaaagattctacaaatctcaataccaatgataagtactcaaatatgttgattttaagcatttatgtcaaaacatgttgaatacagttacatatctcacatatttgttcaactgaaactctaaatcgattaaaatcttttccctcaacccgtgagacaagacggaaacaggaaggaaagagtatgcaaaccagtgtaagaagtattccaggatttggctgagtgcggtggttcacacttgcaatcccagcactttgggaggtcaaagtgggtggattgcttaagtttaggagttcaagaccagcctgggcaagatggtaaaagctcatctctatgaaaaatacaaaaattagccaggtgtggtggtgcacacctgtagtcccagctacttggggaggtaggattgcctgagcccaggagtttgaggctgcagtgagccataatctcaccactgcactccaggctggacaacagagcgagatcctgtctcaaaaaaaaaaaaaaaaaaaagacaagaaatattccaggattaagtcatcggtcccagctaacaatattccaggattaagtcaccggtcccaggtaacaatattccaggattaagtcaccggtcccagctaacaatattccaggattaagtcaccagtcccagctaacaatattccaggattaagtcactggtcccagctaacaatattccaggattaagtcactggtcccaggtaacaatttaactgttccatcaatataatcaaccctgcattaacttcctttgttcagcaagtgagcttaagcttggaaagccaatcttaaaagtcacacaaagcttgtggaagttcacaagaagtttataaaacactgagaaactctctaaattcatctaaattcctgtaagaagtcaaacctaactacatccatgccataccccacagcagagttggcaaactatggccagaaaagccatatctggcacaccgcctgcttcctgtggcctgagagaagagttttcccatttttaaatggctgaaaaagaaagcaaaagaagaatatttcctgacacatgaaaattaaatgaaactcaaatttcaatatccatcaagttttactgcagcccagccacttcatttatttccatgttgtctattgcttttatgccacaatggctgagctgagtcactgcaacagataccatgtgaaacatcagctgacccgaaaagcttgccaaagcctgccctaaagttgctactaatttaccttgaaataactgactttagctatgtagctttgcaaaaaagactccaggtggttttcctgaataccatctgagcatcagaatggagaaattattgtaactcattgtagttttaagataaaagctaccaaaatcctagtattttgttaaaaccatattacagtacttaacaaaaaaaaagtagtctttcaccactttatttccagtgaggaaagggttttaagaatatcagtagtcttacttcctataccacttaaaaggcacaaagtcagccatacacacacaaaatgagccattatgggcatccttttcttgaaagagacagaaaatacccaaagatgcaaatgtcatggtcatttttttgacataatttctgaagacattatgactggctggaatgttaccttctgcctcagaatgaaatcttcaatatctttctacccatctcctccccctgccaatgaagctgtatagtaggaaatttttcagacatacagaaaatggaagaatagttcaatgaaaatctctataaattttgcctgggttctcaagtaattacacgctgccatatctgcttcatccatttctctgtcttttctagtggcaggaattaaatctttagaaagtaaactgcagaccatcagaacactttttcccacctcagcttcccaaaatgccaggattacagatgtgagccaccacacctggcccatcggaacatttcacccacatacttcagcaaacaataccaggataataatttccaaggaaatgaagatacaataatatagaaacagcattaaaaagtaaattatcaaaaaaaaaaaagagagagagaagtaaagctagattagtgaagacacggagaacctctgcaatctcaacaatccagagcggacactggcatgttcactgaggccaaaagaggagtctgattaatacagtgactactaaaagatcaggagaaattactctccacctcctgcactcagtgactcctccttcacatggaagagcacgtctccagtacttacctaagggcagcagcatggtaagtgtcaacgtaatcagaaatgaagagctctcggttcttgataactgggtctgtaatgacaagttctcttccagagtctgtcaaaaaattaattaagacgacattaaaactgagtttcccaaaacaagtaaaaaaaatttgtaaaacttttctttcacgtttaccacccactaaataaccgggcctggttagcatcgttaagtatgcaaaatagagaagaggaatcataaattgcaagaataacaataacagaatgtacagtttttgtcaacaaagtatcttcttggctatgttttataccccttagtaagaccctatattttgccaaaatggattaagcacaaatggaaaaagaagaaaaacaactatcttatcctagcacctccttcaactaccaaaatacttagtgatcctgtcttatttttcttgctaaatattacaaaatggagtgaacttacacagtttccattgataagaatatttttaacaaggaactataatttacacgctttaacagaggtttttttatagtttcaaagaaggaaaaaaaaaaaacagaaagataaaaaaagaacatcattcttccaagctgtttttcattggtttgttgactgtgagaaaagtggagcaggatcagggccaggcaaagtttgatgccagcgccagcactgccacttagacaatgcatggccccagcaacgtccttagcatctctcaacctcagtttcctcatctggaactagagagggacagacccacctcacgtgactaactggtagccaatgtgaatcatcaagcataaggcctaccaacactccaaaatccatttttcaaaaagttatcttcatttaatgaaatgtctttagaaagaactttgcccaaagctaagaaacacacaaatcaaaccacaaggacatatttaccattttcattatgtcgatcctgaaccaaatgctgatacacagaatctggaacctcagattgacggtagtaccatttgacgttcatgaggagatggtccctcttactctgaaaaggaaaatctaacagcattaggaacaggatttcaggtggccacaagtgcatatcatacccatgaccaaaagcccctgtaaacgggtggacacgtagatagggagagacacaattaccatcaggaccacaacaatacataagtcagttatgaggtcaagttttgttttttaaaaacacccatcaatagatccctctcaccttacccctctaaactgcttatttcaggaaacaaaaggagaccagtcttgaatctgtttatctccccagtttaactaatccattcaaaattacatttttatttaacattaactatacaatactacattaatatatccttctattttaatctttaatcattttggtaaatatttagagtcagtgttagctgactgtcaaggctcattaagggcaataaggctagaaagaacttaccccacaaggcctggcacaaaataatctcttctccaaggtttgcctattacccagactaaatcagattctccttccactgtttagccacagttattgttaagtgccaaatgaatatagcgaagaatgggtggtgatgaaggtactatgagtccagagacctcatctcatttatttccgaatctccagataatagaacatcttgtataaaattatttgtgaataatgaagaattttatgattatcacataaatgatcctgtaaatgtttgtaggacactgcactatgttatccctaaaagttaattttgttcccagtttgttcagagaataaaggatcaaatattgcccttccattagcaagttatggggctgcagcttgcaaaagatcatctctgtggctggtcaagaaatagctcaacagggagtgcactgaggttccctgcggcctcctaaaatacttttccaacccatgtgcggccttaacaggcttctccaaggtgaatgcagtatcatgcctttcagcagcctctacgttctcatcacaggcccgttggtcagtaatgaatgagagctaaaattcaagaaatgcctcatgtttataaaggggatgcctaaatcctaaaatatgataaaagagccctcattaatgaaggaagatgcttcctgctttaacgagcaagtcacaaatatagccaacactaaaacaccaggaaggttccaaaaaacctttgctaaaaaacacttaaaagccatttaaagaatcagaaagatgacaattgccacaagtttcaacagaactcaaatgtgaagatgtgttatttcttttttttttccttttcttttttttttttttgagaaggagcctcactgtgtcgcccaggctggagtgcagtggcgtgatctcggctcactgcaacctccacctcctaggttcaaacgattctcctgcctcagcctcccaagtagctgggattataggtgtgtgccaccatgcccagctattttttgtatttttagtagagacatgttttgacaatgttggccagactggtcaggaactcctgacctcaggtgatccatccacccacctcggcctcccaatctgctgggatttcaagcatgagccaccacgccggccgaaaatgtgctgttttaaagtaaatacaaaaattagccgggtatggtggggcatgcctataatcccagctactcaggaggctgaggcaggagaattgcttgaacctgggaggcggaagttgaggtgagccaagatcgtgccattgcactccagcctgggcaacaagagcaaaactccagctcaaaaaaaaaaaaaaaaaaaaaaaacagaacaaaacaaaacaaaaaaccaaagtaaataacataaataccaagattctttttttgcatttaactgtgccaaatacacatgcctacaaaaatacggcatcatcactggtttaattacactttatacatagaataatcctacatgatgagtactctttaatatttatgcattttatgcctttatattaaaatttctgatggcaaaaaaaactttctacactgtttatgcttcagatgggaaaaagaggacataccagtatgttaaataaatagaataaatgttacatgtagcagtttagagaaataattactttcagcaggggattatggatgtgctaacatctgacttgagaaaaaatgggagagatttcaatgaattttttcattgaaataaagatagacaaactactgaacatatccagaccccacagtccatctgcatgcatcaacgaagccattctggggaaatatggagaagaacctgagtcctgactctgtctggcctttagtgagcttacaggacaactggagttttctaactctattgctgaccaaatacacaggcagcaagggacaaatcgccaggacatgggagagcagctagaaagtgtaggagatcaggatataccacctcaaaatatgctctctggcacaaggattatttagccaagaacttaagaggggtagaggaaaaattatattttgtctccaagaaaacttagtttcttccctcggcaggataataaaaagcaggaccaggataagattactcattatagaaaaaatatatataaaccaggggaagaagcagcacctgtttggcagtgcttggggatgcattcagttaaaatacgctgtctataataaggacttgctcaacctcagcactactgacatttgggccagaggattctttgttgtggggatctgcctgtgcactgttagatgcttatgacatccccggcttctaaccactaattgccagtagcacccatcgtccagttctgacaaccaaaactgtctctaaacattgctaaatctcccctgtggggacaaaattgtccctagttgagaaatcactggtctagtaattcattttgttttgttttttaaggaaaacaaaatcagaatggcaaaaataaaacctggttcgagcactacagggtagggaagatggcctactggaaagaagatgggaaggcctgtggccccctccaatctcaattccatgacttcccatgtatgtgacttggggcacattaccgagattctcccaatctccccttttctgtaaaaaggagatactgaaatctacctaaaataattactgaaagaatagaaaagacagaaagcatctagaactgagtaggtgctcaatgaatattgtttcctctattggtaggtgattgtaaccaatagttcacagaaaaatctgaagaactgtgccgagaagtgtgggagttacttcttcaccagaacttggtttcctacaagggatgatagtgatctctagtcactgagctactaatacatgcttcagtgctcacagaaatgtattacttcactgagcatacaggagtccagatctactagcactcctaacaacaatcttttaaaatctaccatctatgtatttctgcaacacatttaagacatctgaaaacctgaagggcaacagaaataccttttagatacagtaactcaaatttgtacaatgtctatctttcagaaccaagccagggatactggtgatcttctgaagtacaatatctatgttatcttatggtgtaggaatacctactgattacacacacaaataaattaactgctttggtttatttgtacctagatgtatgactcctaatattatactttacaatggcagtgaaggaactattggattccccaatgcagtactatgcaataaccagggagtggcagcattgtgctgaaaagacttcacaatcaattccacagataaaacacacaaaggtagactggaagtaaacaacaatttgaaacaaatttaagtagctgtaatatccacaatctttctaaataggccggtaacttaattaaaaatgaaaagtccataaagggaggcagtgtgtggtttcagcagtactagattacaattaggtaatctaggattacagttcagtctgcaactgctagttgcaacctgagtggagtcccccaaccctatgaaaagtgaaggggtggaacaaaattgtttctatgctctctttccattcttacatgtttatatctagatttcctcctcaaacaaaaccaagtagataaaatgatgctgtgggagaatctctaattttttctctgtatctgtgcaatggcactggctaacggtgccatcctaaaggtttacaaattaaaatgtcaccttcagtggaagctggccactgctataatactgagggaagaagagagcatcccctccctgagtaagtgttcccagagctacctcagacacaaaagtattgctagaaagttagacacaggtaattatgtaattcctactactcactagttgaagaattttgttcaaaatcacagaaaattaaagccagacgtgaatttagagatcatgcgattcaagcaaaactgtctaagtttgaatcctggctctgcaacttactaagctatgtgactttgggcaagtaacttctccaagcctcaatgctctcatatacaaaatgggagaaaaccaagtttctaccttatttggttgtgaggattaaataaattaatataaagcaagtggatgagctcaaaaaatgtcagatattactatcattgttttacagaaaaagagagcagcaaagatagagagaaaagaggtcccttaaagtttttgcttttctaagattcaaaattatgttagtaatagtgtcatacagcaaattaagaggaaaatgtcttcatttttccaacaattctagaagcttgtcaagaatttctcaacaaataagcctcattttttactaccaatataatttaacaatggcataaatgtcaaaatgtttataaataatatatttcaaacagaatgcagaataaagagggaagtgaagcttcctgtgtgaaagcaccctagggtgtacttctgaatagtaagaggagaccactgggaagtaaataacttctcaccagtttgtttgtttgtttgtttgtttgtttagagacaaggtctcactctgttacccaggctggagtgcaatggcaccatcatggctcactgcagcctcgacctcccaggctcaagtgatcctcccgcctcagcctcctgagtaagtaggaacacaggcacccagctaatttttaaaatttttttgtagaggtggacatcttgctatgttttaagccactaaacaggagcacatccaatctgcttaacaataaagtttcaggactctgggcaaaaaaaaggggagggggagttgtttctgggctaaattatagaccctggctggatttctcttgaaatgaagaacatatgtcgatttaaggagattaatagaggacaaaatccatcccccaaatctgggcttagaaaaaagatccttatggtagctatctgggagcagaatagcaaagatttctacacatctttgaataacagacaatagtctgttgagatttaacaaatttaaaataactgaaatgaaacactcagaactagataactgacaagcggtagactaggggaaaaggaaggcaatggaaacaggcaaggccaagaaaaagttgctgttgaagggcaactgtgttgtcatcagcaacacacaacacagtctgcccaaacacagacacagggtctaacgttgagatggaaacttcctttcctagagatctttcatgattattaatttagtgttttatcaatttaaatagcctgagtctttcctagaaacagtcttaatatcagcctcagggcaatgtttttccacaacataaaaatagtaataataatcgagggggtatctggatagttcataaataccaataggactagggcagagagagagagagagtccttcacacagaggtggcctgcaagccagacagaacaactgtaaattcacctacgatacagaggaaagagcttctttgtcccactgatcaccagctgatgatacctgccaccagctcacagcagggattatcaggtccccaaagcctccaaaacagaccactcctgtccctctgtgttatcaaatgtgacagagatatcaaggccaaagacagcctcaacagagtacaaagatggatattagcaaataaataactttgccaagtcaaaacaatctgctggagagaagaggagtaacctcctgcatatatttaactgcttagtcatgggggctcttgattcagaaccaagtgaaatcagatcaaaattcttactctataagccaatatagccaaccaagtttctccagaaatttgggatgaagtggctaacatgtgtatactgtatggcttaaaaagatactttctgaagaaacttttcatgcatttccacaacatggtgataataaggttaagagttgtctgaacattagaggtttactgtataattcagaaatgtatacataaaacttttaattggtagtcagacactaattaagcatacagaggggggaacaccgtctcccagagacatcactatctcccttcaagtgtgctcaccaaccagtttaaagaggcattaactctgccagttgagcccacctccacttacaggacaatgactgttagacgtgtcaccttagctaagaccttggggacacagtcataatggctttgatcattcctgacttcaagggagaagggtagggacagacaatggggtcaaagatcactattcttcaaagatcaaagctaactccagatacagactgagtaacctcttatccaaaatacctgggaccagaggtgtttctgatttcagaattttctagattttggaatctttgggtatacataatgagatatcttggggatgggacccaagtctaaacacaaaatttatttatgtttcatataaacctcatacacatagcctgagggtaattatataaaacattttaataatatatgcagcctgtcacaaaggtcagatgtggaattttctacttactgcatcatgtcagcactcaaaaagttatggattttcaaattagagatgcccaacctgtatttatttacacaggtaaatcaaaactaaagataagctttctgtaccagtcatagttacccaacttcatggataaatatctgaaattaaatttaattcaattaaaatgaaattagatccaggaatcccacttctgtgaatttaccaaaatatttaaaatcagtttgtcaaagagaagcctgcactcccaagtttatcacagtactattcacaataaacaagttagggaatcaacctcagtgcctatcaacaatgaatggagacagaaaatgtggtgtgtgtgtatgtatgtgtgtgtatatgtgtatgtgtgtgtgtgtgtgtgtgtgtgtgtgtgtgtgtgtgtatatatatatataaaactactattcagtctttaaaaagaagactcctgtcatctgcaacaacatgaattgaactggagaatattatgctaagttaaataagccaggaattgaaagacaaataccacatgtgcttattacatgtggactcaaacaacccaactcacagaagtgaagagaagtggttacagaggctgggcagtggggggaatggggagctaatgctcaaagggtacaaaatctcagtaaagaagaataactgggttttttaaatgatcgactgcacaacatgattaatatagttaataacagtgtattgtacatttcaaaattggtaagagagtaaatttcaaatgttgccatcataaaaaatgataattagcttgaattattctacattgtattaatgaatcatacatcattttgtactccatacatatatacaattataagttgtcagcttacaacaaaatgaaattttaaaaatgaaattagataggaaatatcttgtaatatttcaagcctctaccctatttaacataagactctaagaatgcccgggcaccgtggcgcatgcctggaatcccagcactttgggaggcagaggcaggtggatcacctgaggtcaggagttcatgaccagcctggccaacatggtgaaaccctgtctctactaaaaatacaaaaattagttgggtgtggtggtgggtgcctataatcccagctactcgggaggctgagtgaggcagtagaatggcttgaacccagaaggtggaggttgcagtgagcggagatcgtgccactgcactccagcctgggcaacaagagcgcaactctgtctcaaaaccaaacaaacaaaaaggatctaagaattttacatatctatatatattatccatataactttacagccattacagctcaaaacgccaggaaagaggtatagaaaaacctaaagcagagtataccaccaggcctcaggccatcaaggttcatgtatcccagggttctgctctgacatggggaccagtgggtaaggggaaaaactgaaatactgactccacagactcttctcaggagaaagaaaggactgaatatactttataattacaccatcctatacacatctcccaaatgcactgagtcattaaacattttgtttcattttgagagggcagagtgaggcctcgcaagtaaatttcttattgccattgataaagtatccactcttgtttgatcctggaacaccttctcccaaccttggtgtattttagtgtagcgctggaactgaacagacctaaaaatccacagggtcgtcttctgcatccactctcagtggggcctgaatccacctatggaaggaccacggctgtggcacagctcccctcaggtggccacacaactcccatttctaaaataccttaaaacaaggggcaggtagaggaaaaataaaacaaaataaaatacctgggctgggtgtggtggctcacacctgtaatcccagcactttgggaggccaaggcaggtggatcacaagttcaggagttcaagaccagcctggccaagatgatgaaaccccgtctctactaaaaatacaaaaattagccgggtgtggtggcgaccgcctgtaatcccagctacttgggaggctgaggcagagaattgcttgaacccaggaggcggaagttgcagtgaactgagatggcaccactgcactccagcctgggcaacagagcaagactctgtctccaaaacaaaaaacaaacaaaaaaaaacctgaaaacaaaaattaaatgggacacagaatcctgttggtggtaacatcacatttattagcatttccaaatgggtatacctggaactactggtacatccaatatatagcagacttctggagggatctgctcacaactggaatagtaattttttttttttttttgagacggagtctcactctgtcacccaggttggagtgcagtggtgcgatctcggctcactgcaacctccgcctccagggttccagcaattctcctgccttagcattctgagtagctgggactacagcatgtgccaccacacccagctaattttttgtatttttagtagaaatggggtttcatcgtgttagccaggatggtcttgatctccagacctcgtgatccgcctgactcggcctcccaaagtgctgggatttctggtgtgaggcaccgcacccggccagaactagcataatgaatttttaaagagaagttaagtagatgaaagaaatagaagaccatggccacatccatctgactaggctgcttactgcttgtaggcactaggatcaaggttagaggctcattttcaaaacctatgagtggtattcaattcaaaagactgttgtcaagagataacatcagcatctgggtctgtgtgaaaggatttaaatcaccttctatcagatgttgaagcatgaagggggaatggtaggaaggcagatgactattcacagtgtttacaatcaagatatacaaataactggctacatacaaacactcagaaagatgatgtaactatgaatgtactgaagcacaggctcagatgatgggcaataatttcaaaaccactgtttcttgatgatgccttgtttgttaaacttctgccgctgttaaattatttttacactttaatatggagaaaaatcaaccaatattttggtaggaactaaaacagtgcatgaaaactaaatcatctctgaaatgctagctaaggagtcaaaactcattaaggattttctacttaggattatattgtgtatgaacactgaaattttcagacaattcattcttgtatttgtttgtagcagagaggccaaaactaagcacaggtaaaaccttgggaatatttgtacttcttgccctcatctgtaaactacaaggctgggtaactagatgacctctgttgtccttaatatcacacacacacagagataaactgtacgtcaaggggacttagcagatagggacagacatagcaaactaaagagcacttctgtagctccccaaaagtatcccacaatgtacttcaacctgactgtggggttaatatcaggtgtctgaactggattaagggacatctagatagttggtaaagcattatttctgggtgtgtctgtacaggtgttcctagaggagactggtgtgtcagatggtagcctgtgtgggaagatctgccctcaatgtaggtgggacagcatctaatcggctggggtccagaacagaacaaaaaaaagcagggaaaaggagactttgctctctctccaagagctaagacacctttcttctcctacctttggacatcagaactctaggtcctccagcctttggactgaggactcacaccagcggccccccaggctctctggccttcagcctcagacagagttgtactataggttcctttggttctgaggcttttgaacttgaactgagccatactatcagcttccccgcatctccagcttgcagatggcctgcgatggtctaaatgtttgtcaccctcagaaactcattctgaaacttaatccccaatgtaacagtattaacaagtgaggcctttaagaggtgattagatcacaaggagcctgataactcattaattcattgatgcattcatgggttaacgacttatcacaagagtgagtctcttataaaaaccaggttggctctctcttgtgagccctactgtcctggatgccttctaccacattatggcacagcacaaagccctccccagaggccaaccagatgcagccccttgacctgggacttcacagcctccagaactataataaatttattttctttataaattacccagtctcaggtattcagaaaaaaagactaagacatggctatcatgggacttagcttctatgatggagtgagatttattattcccttaataaatcccctctcatctgtctgtctatccatctgtctatctttctatccagccagccagccagccaattggttctgtctctctggagaaccctgactaatacactgacaaatactaaatgtcagattcagctttaaaagttcagttttgaagggtcaatttggcaagacgaaatttcgcagataaattaaaatcctacccttggacctccaaaatctgctgaccaaacacaaaaatgaatcccattctaaacagtattctcccagcagctctggttttatcagatcaacattctgaagcacaaattttctctttggtccaaaggatttctcccataaaggaagaaaaaaatagctattcgtagagagtgtaataagaaattgtcaaattcccccttaatccctactaaagctttaaacagtccattaaatttctttaaaagcaaaaaaaaaaaaaaaagagtacaaatatcacaaaatttgacatttttgtaataatactttggttgttgtttggtgacggcggtgatggcagtgatattattcatttggagggaattaatgacttcttacacatgacatagccagaaaagttacagagctcaaccacacatcaatggtggggtcagactttgcggtaatgagcaggatgtcaaagaaagggtggggaatttctcacattatttaacatcacattattttataagtaagacttaccaacttatgattaaagatacatggcagagattttacaattaaaaaccgatgatgagctaccatgataatatttccttgaggttgggcacagtggctcacatctgtaattccagcactttggaaggcagaggcatgaagaccgcttgagcccagtagtttgagactaacttggacaacaaagtcagactctgcctttacaaaaaatttaaacattagacaggcatggtgtcatgctcttgtagtcccagttattctggagactgaggcggtaggatctcctgagcccaacagctaaaggctgcaataagctatgatggcactgccacactccagcctgggtgacagagctagaccctgtcttaaaaaaaaagaaaatattttattgactcaatacactttttacagaaggacctctcaaacatcttaagcttcaagattccttagattcttaaaaattattaaagagtcaaagaacatgggttatagcttatcagtacttactgtatttaaaaataaaaaaatttctggctgggtgcggtggctcatgcctgtaatcccagcactttgggagactgaggcgggcggatcacgaggtcaagagatcgagaccatcctggccaacatggtgaaaccccgtctctactaaaaatacaaaaattagctgggcatggtggctcgtgcctgtagtcccagctactcaggaggctgaggcaggagaattgcttgaaccggggaagtggaggtgaaagtgaaattgcgccactgcactccagcctggcgacagagtgagactccatctcaaaaaataataataataaaaataaaaaaataaatttttttgtaatttatgaattcattaataacagtaataaacccactacatgctcgtgttaacataaataattataacaaataactataatttttagaacgaacataatgtaggaaatgagtaacacttttatttctgcaaatctcttttacttctggcttaataagaaaacagattcccatatctacttctgcttctgtattcaatctgttgagctatatcacacatcatttagccttttgtggaatgcactgtacactcctgagagaatgacagtgaaaaaaagcaaatgacgtcttggtatcattatgaaaacagttcaaccctacagacccctggaccatagttaagaatggctggtctctgagatgaagtcgacaagctgcacagatggctccaggtgccctctcttttagacacaatcatttaaataaaaagtatgctcccgaaacagcacaatgactagagattttaaggcacaaattcatttagatgtcagatactattaaaaaagatttcattattatttatacaaccaaacactccagacattccagtagagagcagaagttacacaagaagaaaaatctaaataggaagctctcattgtcaaatttaaggtatctttccaaaaactgagctcaggatataaaagaaatatttaaagcttgattcaaacaagtatttgtctacattaaaaaggtatactactttaaaacaacggtgaacccttgaagctgaaagcatgcagaaaataataacctagataatttccgctattccaggcaactttctggccatttcaaaaatgatactgcttcctacctgagaaaactggcatcattaaacaaaacctttaagaaaaagaaagatattagcttacaatgttaactgaatcatatcttttataatgactaatatacctaatttatgtgaatctagcaatattccgccctctcctggtgatatgctttttgtaccactgctgtctgaattaaaccctgagtgtagagttggtaacacagtaaagtaatttttagcaacacaaatatttgcacttttaagaagcactagagacacagttttagaaattactgactcaaaagttggcctgcataataggaatccaagtacagccagcaacttaccaataaacaaattcaaatagttggataagaaaagggaaaatcagcaggaacactaaaaaattatattttcctggtttacgtaaatcagtctgtcttatcttaaatatcttaattatttcttctcttcctttaacttaaaccaaaacaaagacggtaacctttaatactagttagtctatttataaccgttccatctacaaacatttttctaatacaaacatgccctgatagcttatcttggtgcacatgccagacaacaaaggcccactggcctgctggagaggagaaatggaaagcaggaaatgagaagccttagttaatctccaaataatcgatcagtgtattcagtcaagtgtgagctgagctgggaaaatgctgctttaaaaaagaaagaaagaaaatcaaagagcatgtgactggagccacaattcattttaaaatagggtaatttttgtcaaaaagattctgcatcacgttcaagcaccaacaacaacatacggaaatgttcatatcttctgcagtaagaccccttcctttaaaatctcttgtcatcttttttcaaaaacaagttccaacttttgggctttgtttcttatttcagtttatcttaattattgaggtataatttacatacacacaataaaattaacttattttgtttctactagttttgacaaatgtatagagttgtgtaacctccaccaaaatcaagataggcaacattcccattaccacaaaaagaccaacttccattacagaatcaacatttgctgtgatgaaaaggctttgggtgccagtgttgccagaaaagcaacattctaatctaacttccttcctccattttagcacacagagaagttaatatggagaaaaacaattcagagtctgctgtgactcttctatctattgctagagaatactacagacaggaatcccatgatctttaaatcaagtaatcggctagataaaacttctgggctaagaggtaatatggtctcaggaaattcctagaacatacaacagttttagcgacaagtgatataaaaataaacaaaaataatttcaaattagatctgagatatactttcctcaaactatataaggaatatttattgggcatctgctaggcaccagacactgttctggagatggttgctgagtatatagaagtgggaaaaacaggaagtcccagtcctggtagaacttccattccaatggaggagaagaccccttaccaattcccccaaccctctcctctaaaatgtccaataacggttaagtgcttttagaaagttatgatgaatgaaatctgccacttagtaaccataaatcctaggcaagtaacatttatttacactgttatttaatctctttggatattattttccttaaaattagtggtcttctcaaaagtacttcaggatagcaggaaaaactgtattgtgacctgatatgtcatatacagagacaggtttaaataaccctaatgattccatacaccagtttctctacctacaggacctaggaggaaacctaaatgtcttgcttgcttgctatcctgagcgtgttcatgaaaactcccaaaggtggctctactttcttgctttatctttcttatttttctttttaaagttttattatgaaatatttgacaggcagaaaggtataaaaataacagaaccatctgtaccaaacatacctaaagcaacaaaaacattatcgaacctaaagaagctgcctgtggaacctgcctacagcccagaggtaaccaccaccttgaattcactgatcattcccatccagtacttcatgcttttacttaatatatatatataactaaaaatacataaggtattattttgcatgtttttatactgtacataaatgacactagactctttgagttcttctataatatgctttgttctttcagcattacacttacatgatccatccacgccctagttcacttattttaagtgacatgtattaccttcatatacagcacatcacaatgtgttcatacattttcctgatagtagacatttgggtcatttccagttttccaccattacaaccttggttgtaataagtattcctatatatgttttcacacataaaacttttctattcaaattatttcgattactctgaatgtttggtatcacagctaagtgttcaaattttggtattggtaaaatgttgttcacagtgtcttactaagtaatttaaatatatattaaaggctaaaaaagtttatgtctaagcatggttttagataaagccattaactgtgatgtgttgccttttatttctggagacagtctcactctcacccaggctgcagtgcagtggcccaatcacaggtcactgcagccttgacctcctgggctcaagctctcctcctacctcagcctcctgagtagctgggactccaagcaaatgccaccacgcccagctaatttttgtactttttatagagatggggtttcaccatgttgcccaggctggtcttaaactcctgggctcaagcaatcctccctcctcagcctcccaaagtgctgggattatagacatgagccaccgtgcccaaccaatgtgttgtatttccattaataattcactgcaaaatattttctaatttccactgtgatttcttatttgacccacagactatttagaagaatctgggttccttctacacatctgtgtatttcccaggtactccttttggtcttgattcctagcttagtagcactatggtcacagaacatgttctgtatgatttcaatgctctgaaatatgttaagactatgatctatatatagtcttttttttttttttttttttttgagacgcagtctcgctctgtcgcccagactggagtgcagtggcacgatctcggctcactgcaagctccgcctctcgggttcatgccattctcctgcctcagcctcccgagtagctgggactacaggcgcccgccaccacgcccggctaatatatttttgtatttttagtagagatagggtttcatcatgttagccaggacggtctcaatctcctgacctcatgatccacctgcaatattatatagaaatgaaaatactgcaacttacaaaaacatgaatttcacaaacatgctaagccaaaaaaatcagacacgaacaaatatatattgcatttcattcccttcatatacgaagtacgaagacagacataactaatctgtgatggcagagctcacagcagtagttacgcagttagtggctaggagagggcacgagggtaacctctggagtgcacacattttatttcttgataccagaagttagacagatgtgttcactatatgaaaattcactgagctttctatttagaatgttctttcatgaatatatattagacttcaattaagtctaatttatgaaattaaaaattaacatctttctaaaattaaaagtctaattcgcaaatgctaaaatttacatacacatatacacattaacacgtatgcacatgaagtatctctggaaagatacaagaagctggcaacaattgttgcctctgaggaggagaaccctaaaacaacttataccaaaaagtaagaaagtgctcaaagaatgtgaaagacacgcgaaactcagcctgaaaggacagacctgctggactagttctgctagaacaacttgagaatcaacacataatgttagtaatagagtagaaactacaaagaaaaccagaaatcgtgcatccttgctgatataggtaaatgaataaagtgaatagttgctaaataaccggacactttcagagtcacagggcacctttccataaaatattaactgataacaaaggatgaaaaaagtaacctttttttttttttttttaaagacactgttttgctgttgtccaggctggagtgcactggtgcaatcacagttcactgcagcctcaacatcccactctcagactcccaagtagctaggactacaggcctgtgccaccacacctggctaatttaatatatatatatatatatatatatatattttttttttttttggcagagacagtgtctcactatgttgcccaggctggtcgctaactgctggctcaagcaatcccccaacctcggcctccaaaagtgctgggattagacttgggccattgtgcccacctcaaagaaataactttataattaacttttgggccttgtaaacccaatcttaagtgatcaaagtgaatgccagtaacagaaggaaccaaaattgtgccctacttggcagggtacaaggaaaagatcccaaacctgaatctaataatgaagaaatacgatacaaatgaaaactgagaaacattctacaatgtaactgaactgcaatattcaaaagtgtcaaggtcatgaaaatcaggggaagactgaagaactgttctaaaatgaagaggattaaagaaacataactaagtatataacctataattctgattagatccattccctacacagggcattgaaacaaaagccaaaatgtgtacagggtctgaggattagacagtaataatgttattaatgttaatttttaggtttgattgttgacttgagggctacatcagaaaatgtccttgtaagaaacacacatccattatgtatcagtgtgtaaaggggtatttatttggcaacttattctccagtggttctagggaaaaaaaaaaaaagttctctgtgttgtacctgcaccttttctataggcatggggtgggttagataaaagactggagaaataaattttagtgccaattataaaaatatgtaaccataggcagtggtcactaaaagccattttgacaaacaatcagagttaaaactcagtaaataagaagaaagttacatgtaactgtaaggataaaagcatgttaatgccagccagttaaaaattagtttcaggaatttagtccataataaagattaaattacagaatagcagggaaagatgaactatttaatgagtttgtagagattcctagaaagtcatctaaaaaaaattaagttgtatctatacctcatactgtatgattcaaaatgatctgaaatgagtctaaatgggtcaaagattgaaatgtaaagaataaaaccataataaaaaaatgcaaattaaacttatatgaagaatatattgctcatactggcaaatatccaagttgataacactctgctggccaggttatgggaaaagggttgtcattatgttttacagaaacataagctggcacaattgtgttatagaaagagtaactgggcaacatctaccaaaattacaaacatattcatctgtttctccagcacttattgaaatttattctaaagatacatttgtgctgggcacggtggctcatgcctgtaatcccagcactgtgggaggccgaggcaggcagatcacaaggtcaggagatggagaccatcctggctaacacggtgaaaccccgtctctactaaaaatacaaaaaaattagctgggcgtggtggcggcgcctgtagtcccagctacttgggaggctgaggcaggagaatggcgtgaacccgggaggcggaggttgcagtgagccaagatggcgccactgcactccagcctgggcgacagagagagactcaaaaaaaaaaaaagatgaaagaaagaaatttcatatgacttttgaatttttttgtttttttaaattatataaatgtattacctattcaaaaactatttttaaaaactcacagggtgtttgtttatgtcataggcctttgctctctctctctcccctctctttctatcctagtatattgctgctctttcttttttatgtagctagccttccagtggatagatggtgtctgaccaacagaattggaacctgcatcagccatatactgttaagagaataaaacggaacagaaacaagcctgtataattacagttggtcatgccaacagtctggtgaccaatcttttacacttaaaacttaaagaagttacacgttttcaactgcctgtagaagaaaatcacatactccttggccccccatactcatcatgctgacacagatcacttgagcttaaaaatgctcacaatgtttctgaaagtgaataggcacagagccttcaaatatgagatctagagtatctcactgaatataagatattccactcaatgctaccttataaaacaagccctagaatcaaaatagcttatcactacatcttattcattgtgagatataccgctgaggctggacatgcactttaaaagggaaagaggagccgggtgcagtggctcatgcctttaatcccagcacttgggaggccgagatgggcgatcacctgacgtcaggagtttgaaaccagcctggccaacatggcaaaaccctgtctctaccaaaaatacaaaaaagccaggtgcggtggcgggcgcctgtagtcccagctgctcaggaagctgaggcaggagaatggcttgaacctgggaggcagaggttgcagtgagccgagtttgcgccattgcactccagcctggatgacagagcaggactccatccgggaaagaaaaaaaaaagggcgggggggagaggaaatcattaataaggtgtaactgaaacctgtcctgaaagaaagcaatgagcacctctttttatcataacatattttgtctatgtttcgtatttccacaaactcctctttgattacagattatgtctttccaagaagactatttggcagcaaagtgctgacaaagtattgatggcagacctccttacacaaagcctattagcatttctattgctgcactgcacactctggtattataaatcacacacactcagcatcatgcccaataatcaaacagttacctaacaactaagggtattacaaacgcattgaactaatctttgaatatatgctgataattaaattccattatggtttctaactttaaacctaaaggcaggcaacactgaaatcaagtgtcatccactgtgccctcacatatgccatgaaatgtcatttatattatatagttcacttccaattactgaatacaccagccagagcatctatcactaatattaaaacaagcagaacccagcagtagagcagtggaaggcatcacatggtttaaatggatttctcacctttcaagtgtcaaggggtctttccaagaacatctcacttagggggttgttggccttttaacaaaggaagctgctccagttgaaagaaacattcaaaagacaagacatgctgtaaagcacagctcagagctagagacatctgccccttgtgttaaaacacaaaacagtaaaagatcctttatatgaaaaataaatacatgtaaaaattgagcttttgtcaaggttactaacaaagaagttatgttaatatctaaggagcccttgtttaggcacatgccccacagaaattagggagccctcctgtccagaagatctattaatttcccagtttttaagaccaaagaaatgtttcttgaaatccttgcttggagccccaaagttaaagcagccatcaagcacaaagctatgccccactgtgttccgctgtctgtgtccatgtctgttactcacgcagaaccaccacgattagcacaagttaaatttcatggctacgtagaaatgcacattccagctctctgcctactaccatcacatgatgatctttaaaacaagaatcaagaaaacgttcctaatcctctgtgttcagaaaagcttttactgtcaaaagaaaactttaatagctgactcttggtaattaacacataatagagccaccactaacctattaacaatattaccgtattctataattggagggtaaaaattagctatagagggaattgtaggaaatcattttctagctctaccatcaatgttatgtcagataggctaacaagaaaaactgttagagttctaaatggcagtaaataattattggaacataaaatgaaacaacgcccaagaaaattcaatctgaccacacagaagaaaagatagtggaaccaggcctagggaatttatagagactactgcctctgcattaataaagaaatcattatctggtaactataactcaaatcaggctctagaacaatggttcttaacttttgctacaactaccccatctgaaatctgcatgccatgcaaactactgcctaaggcggggcacagtggctcacgcctgtaatcccaacactctgggaggccaaggcaggtggctcaccggaggtcaggagttcgagaccggcctggccaacatggtaaaaccccgtctctactaaaaatacaaaaattagttgggcgtggtggcgcatgcctgtaatcccagctacatgggaggctgagacaggagaactgcttgaccctgggaggtggaggttgcagtgaactgagatcgcgtctgggatccagcctgggagagagagagcaagactccatctcaaaaaagacaaaaagaaaaaacacaagataaaggatgcttaaaacctaaccaagtatcaacagtaaaatcgaaggacacttagaaaattaactgacattatagacaacgtcaagtaatttgacatcatctcttctttgaaattcaccatcccatcatgtgagcctatgtatacagctcctagtagcggataaagtaggcaaacttacatgaagaaagaattccattactataagctatcattaaacaacttaaatatctagagaaaattcatgaataataactgaggtgattcagagtccacagcataaccagtttaattgcatttaccacataactggtccatatacactggaactctgaacgtgctagacgagtgaaagcaaatgtgaaagcttttatttcagttctaatgtactgcataataaaatttaaaaacacacacaactaaaatgtggattaaatccaaaaactataatttcattaaattgcattataagattttcacttactaaaatacagaaaatgttttctaatatgcattggacttttttagttatactttacatgtgaaatgcagagatttttagatacactatttagtttttataaaggctcaactcaaaacagttctatcactccagaaagttctctcaagcactttcccagtcaatcctcaccctacccatagaaaacctcgatctagctagctagctagctatttttggagacagggtctcactgtgtcgctcagactggagtacagtgtggtgtgatctcggctcactgcaagctccacctcccaggctcaagtgatcctcccacttgagttgtgtgccaccatgctcagctaatttttttatttttgtttttgtagagaagaggtgtcatttcactatgttgccaagactgatctcgaattcctgggctcaagggatcctcctcccatctcaggctcccaaagtgctgggattacaggtgtgagcaaccagatcctgctactactctgatttccatcacagattaatcatagggcagattcatatttaactttttaagaaattgtcaaactattcaagtggttgtaccatcttcattgccaccaacaatgtatgagaacttgcattcctgacaaccttgctaacattcagggttatccatctcttcaatttagccattctagaggctgttttggggatcttattgtgacttaatttgcatttccctgatgaccaataatgatgggcactttttcatgggcttatctgccattaatgtgtctctgtttaagactctgtcaattttaaaacactgatttggtcttatcctataagagtgttgtttgttggaaggtatttttttaaatgtattctgcatccaattgctttctcagacatatgagtgacaaatattttcttacagtctgaagctgccctattttcataacaatgtcttttgatgaattccaatttttttcatttgtggttagtactttctatcccctcattaagaaatcattgcctaaatgaaagtaaacacactctcctgatttcttctacaagtttttataggtttgagattatatttagatcaatgatccatctcaaattaatgtatggtatgaggttgggttatatcctgtttttcacatagggattatccagttgttccagcccatttattgaaaagatttttttcccactgaaaataatttgatcatatatgtgtggattcatttaattttgcattcaagagatataaagcacatctcagtccacaggatcactggcattttaatcttactttgtatagtattaccaatattggaaagcatcatttcctaatattaatatacctcatatttacatgaaacaaaatattggtgtaataggtacatagagattttttttccatttgagttatgcaattacacttcttaaatatattattatttaatatgtatgcatatacactggaactgttgtgacacttttaatggctaatgttcatgtttataaaatatgtaaattttcagctattaatataattgcttgctggtatataatatcagataaaatgtatataacaaaaataatcatataaaataacaccgtttcctcaaatctccaacctcagctaccacacagttgctcctctggttcaatgtaaaattttcctcaaaagttaatatattttaagttattattttaaagagagagggtcttgctgtgttacccaggctgcagcgcagtggctatccacagggctgatcacagcacacaatagccttaaactcctgggttcaagcaatcctaccgcctcagcctcccaagtattaatgactgggactataggtgtgtatcactgtgcctgcttttttttttttctctctctttctttaaaaactttttttctttttttttttttggggggtagagacagggtctcactgtgtcacccaggctggtctcaaactcctggcctctacctcccaaaatactgggattacaggcatgctccaccacacttggctattatattttaagggttactttctaaaccataggaaaattagctgggtgtggtggtgggcacctgtaatgccagctactggggaggctgaagcaggagaattgttgaacctgggaggcagaggttgcagtgagctgagactgtgccactgcactccagcctgggaaacaagagtgaaactccatctcaaaaacaaacaaacaaaacacacacacatacaccctgaaatctctaacactgataccgggcaggggtagtggtcacggtatagagaacagcatattctcaccatcaaaggtgaaatttcacaggccaattagggtactgatttaagatgataggaccagggtctcttttacatagatctgagcctggcctaggaaaaatcctagaaaaaacttacatgcttgtacctctgacacagactagatcatatcaatgggggttggggacaaaagccaactagcaaaggataaaacgattcctctgtctgatcttgtcttcagtatctatttctccctcatggtttatacaggaatggtggcagccatgagagataatgggttaagatttaagaactcaagtgtctgcggtcctggggcttagtaaaactctggttcaataaaaactaacatactagaagtactagaaggatggtagcattggcagcatagtttacaaatgtcccttaatccccacacaaaaacagattagagagtcaaagcaaattcctgctgacacacaacaaaattcagaaataaggcatctctacaaaccgcaaaatataagcaggttggaagggataaactaccatcagccataagatctctggatatgagcatctgcacgagagaaaacagaatcaatcaatgagatatgggatacagctaagatcaggaggaccgtaaaatagctaccaggcaatgaggaaggccaatgtgtgaagagcagctgaagcctggtggggttgcccatgccgacagcaggtcagaacccccagagaccttgcagggctaaaggggctgaagtcatctagacacttttgaactcttcaaaactggcccaccatagctccctgccggcacaaggagccaaggcaggggagaaactaccagtaatggaatataaattctgcaaaaaatacaaaataatttaaattaattaaataatttaaataaattaaagaaaaaagaagatccaaatgaaagtgaaggagaggaacagagtcagaaaatcacagcaagctgccatttttttaacactgcataaaaacaacagaagggggagctccgtaaagttaaaaattcaggaaaattaaattcgcataaaaacaagcaaaagcaaagtacattatacaaacctcatataatgttactattttaaaaagagaatacagaacagaataacacccctacagacaaggacagtacaacaactgggctcataaaaaacaaaaaactataatgtactacttcaaaacatgctaaagatattattaaataaattataccagatattagacagtaacaaaaatcagaaacaagaaaattcagaaatgaagtgacagacataaataatttcaaaaattaagactaaacccgaagcaatataaaagtgagtgaacacagctggcaatgtcttaagaaaaagagaagtcagaaagaaataaacatttaaaagtcaaaagaaataaaaaatatgaaaaggactaaggagaaagtaacaaatattaaaaataggcactgggcatggtgacttacacctgtaatcccaatgctttgggaggctcaggcaggaggacaggagttcgagaccagccttggcagcagagcaagaccctatctcaacgaaaaataaaaaaaaattatctgggcatgatggtgtaggcctgtagtcccagctactagggagtatgaggcaggaaaatcacataagcacaggaatttgaggttacagtgagctatgatcctgccacggtattccagcctgggtgacagaatgagaaaccctgtctcaaaggaatccattagagaacaaacttcagaccacaaacaaaaatgactacagagacagctacataaggactagtggtgaagatgaagtatatagtgacttgaagaactaagactaaatgagggttaaaaagactatagtgtgtaatctaaaaatgcagacattctattatcatttaacacacagaaggagaaaagggagagtgcaaacaaaaattttttattttactgtttccagaaatcataattggtggtgtcagtactagtattgttactctgaaactactgtataggtagatgagataaagaagtaattatgagtccaggcccagtggctcacccttgtaatcccagcacttaaggaggccaaggcgggtggatcactttagtcaggagtccaagaccagcttggccaacgtggtgaaaccccgtctctactcaaagtacaaaaaaattagccaggtgtggtggcatatgcctgtggtcccagctactgggaggctgaggtaggaggatcacttgaaccagggaggcaaggttgcagtgagccaagatcatgccactgcactccagcctgggcaacggagcaagactccatctcaaaaaaaaaaaaaaagaagtaattacgggatagtctaattctgtcaccccttgtgtccttgagaaccagaaatctgtctgaaagaaaagagatagagatggaaatagctgacgttaaataaaaactctgtaatcctggatttaaatgagacagcgtgttgtatcagtataaattgtaagacatcatatataatatttcccagctctgtccactccaattatagatattttaacatcattagtatataaatcaagaggcccagaaataataaacagcccagcagcaatgagactcaaatgttctagattatgctcttgcgataacatctctcactaaaagaaaccagggatttgagaagagatgctaattatgtgtctgctgcaagacatgtacaagatgaggatggaacaccttggcatagagatagtaaggaaactatcaaagattcccaggatcatgtcagaaggactcaggagccaataagaggttcctactaaccaaaaatgggacaatctggcttcaataaggattaggaattgcaattagctgaaatccatcaaataggtttaagaatactccaatgtattatttgaaaactgggtaaataaacggaagcaaccaaacctttattctgtctttcctatataaattgtgcaactgggtaacaagacagtagatgacagacaacactaccatataaaattattctagctaataaatgaaactgaaatcatataattaaaatcttacaattttgaaaatctcaaggaattaatggatacaggctaacaaaaatcagacattatacacttcctgataaaaatatcctacaccacctgtaatcttgcccaaatggaacagacctgagtctcatcaaacctctggatccagctactaatacacaagaaatgcaggggtcagaggcacatctttaactgtactacacaatcaataaaatccagattgcagtagattatctaggtcaaatgacttggaatcaacaacaaacaaaatttaggaaagtaaagcaacgcagcgagagatctgcagagtattttataatagattcagaagacatatcatatgcataactaaactatagtgtacagacatctacacctgggtgacaaaactataatggaatataattactgtatatcaagatagtgatgaattccttagggaaagaaggaattgtcattgcagaggacctcgaagatggctggccacgtcctgtttcttgacctgggaggtaattacacattataattcattaagctatacatatgttttgtgtggctgtatgtatctgtgttttattctacaatcaaaaggattttaaaaagaaaacactaatagcacagctcacctgtattctgcttagaaaaatgcatcaactaaagctatggcaaccacagaaagaaactcaggagaagggaagcgaatctaaaagacaagtcccatcaggataaaggtgaacttcctgactcagacagacttcagctggagaccagatgccacagatgcactatatgagcagataaaagatggattttaaccaatgctcacaaacttaaacattccataattatgtggtttctagctgaaagacaaaatagcatccaaaccaaaagaactaaattagaaaatgtatgttaagaaaatagaaacacaatatgagaaagcagctggaattgtcacaggatcccacaaaaggaagaatagctgcttaacacataatagataatcccttcccagtctggagtgatcagaatgacatccttggattaagaatgcagcccaggaaactaaaatttaagaataattcggaaatataaaaagcaaaaaacatttatgggagaacttgcattaactcataataaatgccacagacataaagcttctgatagaacaagccccttcccagcctctaggtctgaaaagccttaaaggagtcctcatttccctcctctttcacacatcaaacagcaagtcgaaaaccaggaagtcttcaattgtcctctatagaaaattacataggaaaagtttaagcacaggctttaaaattatggagacttgggttcgaaatctggctctcatactatgtgacattaggaaaattactgaacatctctgagcctctattcccaatctgcaaaaccagaatcatttccattgacccttacaagggaacactacaaggagttccttccagccccagtgcatctaataattacctcaaattattccactgaattctaactgttccctatctacaatacaaatcactgacagcaaagacacatttttgttgcaaagcagataaacactgcttgttaacttcacatccctcccctccaccactaactctaacagcattctgggtcagacccctcatacagttcatgtgaactgtctcagtagcttcccaatttgctctatctctaatctttcttaaagaggaattctgatcacatactcatctgctaaaacacgatcttggctccccagtgaccaacaaataaaatctagtttctcagctttcagagctcagcacacctttccagttctatcccccaccactctctttaccaaaccaagctggactccaacattcaacaaaaatattctgcctctattctttgtctaaaaagtttttctattctccagtcaaattctttccaaccttgtgagtcccaccttaaaagctcgtactttgactaagtccttccctcagaaaccactctcacacttccccaagctctgttctctgcagggtatgttgggaccctgaaagacatgtttcattagtgttactcgctttgaaacactctgcgtgcagatgccgtatcttactcatattcttacattcaacaaacacacattaagttcccactatgtgccatgcactgtaaagcctgaagccacagcagtaaacaaaacaagcagatgtctctcccttcatggagctggccattcttgataggcagactaattcatttcttttccctcctgcgcaatggactgttcttcatgcagtatttatttaataaatgctggctgaatttaataaaaacatttcaaaagaccaattaacacaatggggaaatttaaagtaaatcattgaaaactctcatttatattctaatctgcaaatttaacatattctagcaggccttctctttttcagaaacacgtctgactttttaaattcatcaaaagtccctcaaagtgcctgggctggagaagtcccaaggcctacccttcccaaacccctcatcgaagggtcgtcgcctcgtccagtctctctgggtggccatgcttggttttatgtaactctggcctagggcatcccactgactctatgaggagtgaccccctgacccaaaaggcagccaaatcttgagcagacaaaaacacatacattacaggataaaaagataagctggcccaaattctgtcagtaacttgaaataatggtaactaagtaatatcaggaaagaagaaataaggatgcaagatgccaaacaaaatctttatgaaatacttttgatcatgaacttatctgctaaatcatccctcaagtagaaacaggagcccagagcttctctcacagaacctccctttggacatcttccatagtgatcccccaaaatgtaccaccttaaaacatggcttaagaaactactgactgaggctgggcacagtggctcatgcctgtaatcccagcacttcaggaagccaaggcaggcagatcacttgaggtgaggagttcaagaccagcctggccaacatggtgaaaccccatctctactaaaaatacaaacatcagctgggtgtggtggcaggcacctgtaatcccagctacttgggaggatgaggcaggagaatcacttcaactggggaggcggaggttgcagtgagctgagatggtgccactacactccagcctgggcaactgagcaggactctgtcccaaaaaacaaacaaacaaacaaaaactactgacaaggccaggcgtggtggctcacacctgtaatctcagaactttggaaggctgaggtgggcagatcacctgaggtcaggagttctagaccagcctggccaacatggtgaaacctggtctctactaaaaataaaaaatgtattcaggtatggtggtgcatgcctgtaatcccagctacttgggaggctgaggcagaagaatcagttgaatctgggaggtggaggttgcagtgagtcaagatcaagccactgcactccagcatgggaaactgagtgagaccctgtctcaaaaacaaacaaacaaacactactgaccaagtaatagataaaaaccaaataatcagcttgctaaattccaagtatttactcacatttttatttattttttatgcattcatttggcgccctatttattgaatatctaactaagtgctaggtcctgtgatagtcacagaataagacagattaggtcttgctctcaaatttattttattggagaaaggcaaacaagagtttgccccctagttcctcccactttctttctttgtgctgagaaacacagggtgccttcacagttctgtgacctggacagctgcaagttttgccttgaaggcttgagcccaagctgagggcttagccattcccaggcactgctgaaatactgcaagaccaaatgtggcaaaactcacagaaactggttccgaccacgaatcgaattcctcaaaccctcatataaactctataacctgacccctcctcatagacacatctaggtagaacatctcttgtctcaatgtctatcgcaagtgtggtacagccctctgtgtgtaagttcccctaataaatgctttttttgccctgctgtttagtgcttctttctttggaatcctaatcagcaccacctcaggactaagtcagtcccttgcaggaacactcctaccaccattgcttttggggtaaatccatctgagagctggccagacagaacaagtaaacaaaccaacaaggtaatttcagatgataatcagtgccataaaaacaataaagatatgaaaactgagcagtatcttagaaaatgactaagaaggaaaaggggtggggcctgaataaaatggtaagaaaaacctcccagaataggtgccattcgaacacctgacaaaaaatgagtcaaccactcagggatacagcacaaagccatcaaatcaaaaagagtccacaatccacactcaacagtactatggaccacagagaatgtcagaaatgtttaaaactgttttctccctcaagaggcttaaattccatttggggaggtaaattaactcaggaaacaaattttatgaaactgcagagacttcagctgaaggccagagatgccctgggaacaaatggaaatgcagtgcggcccaccggtcatgttccctcaaaggccaagttagtgcctctggtattctcattctggtacctatgctgctggaaatagtatacaaactatgcctttaagctttccaaattggaacctgaaattttaaaaatcttaattagtccacacttacgaaatacgaaggcttccaggcacactgtctgtttgctgttctggaaaatctagtccttgaattgcatttccttcacttacctgtgaggttccttgacttcttcccactcttgcagccttctcagccacgctgattcacagctgctgcttccctctgagggaccacacgcctgctctcacccagaatcctctagcagtttctttttctagaaacagctgaagaactgctgagtagaaagagtctgcaaactatcccgactgcactgtattattccatcagtgtgtggagcaactgaaaagttacttggctatatcagatgttaagaactgagcacaagcttcccaaatgtgtgttcactataaagaggaaagccagcagacctcttccaactgagactctgaagagaaggctgcaagagatttctgtggcgctgacatcagatctactacatcatgtcccagcctccacggggcaacaagaaagtaaagatcaaaccacctgagctgccagataaggaacgcctttctctataaataacttactgatgtgaagaggcttttctgggataaaacaagtagaaaagttatatattgtacaaaaagaatggtcaagagaaagatggtgtaaaagcaagaaaaatcttgaccctcccagaagccactggctgtttttgaccacccattgacagtgaattgcaaatggccatcagcactctttttgctttaaaaaaaaaaaaaagaaaagaaaagccaatttatgccattagatgaaaatccaagtatcatcacctattttcaatgcaaaatgcaaactgtctatatagccacctaatgaaccctgccctaacatgttcccacaatccaaatccagttagtgactggaaattatccacaggacgacaactccaggaagcagttgcctcctggctaaaccaagaagacttaggagtactagtttctacacctagaatccacttttctctccttttcaaacctgtctaagccaactccaaattcactccaaattctcctccttagcattatcaactgacaggttccatcacgcatgcttccttcgcagttcacacttactatgccaaatgcactgctttcttgtgaaacacatctaacgtatgtcctgcccttcccacagaaatctgcacatgctgagggaaagaactcagatcctgtcttaaagatgctgctaccattcatttaatcccttcctctaaaggtgcctactataaaatgatacgtaaggtgagggtttaataaactttggcttaacacactgaaaggaaacaaagatttttatagaaggaaaaaacactgtaatgctaatgtgaagtagtaccttcacagtaaagacattttacagtacttccctcctcaatgaaaaggaacaaagaaatacaactgaaaacatcaacaatttaactaaatcacaggccatttcatgtttagcaacttgtctttaaaaccctccctactacacttccaccctaaatgcatttacatgcaagacataacaggctcctgcccttccaaaccagcaaaaggtactttttttttcttttttaaagacaccgtctctgtctgtcacccaggctggatggagtgcgatgctgtaatcttggctcactgcagtctcgacctccccaggctcaagcaatcctcctacctcttcctcccaagtatctgggactacaggtgcataccaccatgcccggctaatttttgtacttttttgtagagatcgggtttcaccacgttgcccaggcttatcttaaactcctgggctctagtgatccacccgcttcggcctcccaaagtgctgggattacaggcatgagccactgcatccagcctaaaaaaaaatcttttaaaagccatctttggctggtgcagtggttcacgccagtaattccagcactttgggaggcctaagtgagaagaatgcttgtggccaggaattcaagactagcctgggaaacatagtgagatcccatctcaaaagaaaaaagtcatctttgcgcagagttctacttttacaccctatcctaggagaatcaaacttaatcatatttgcgtggagataatccatgtttgtttaagaaaatgaacagaaattcaattcataaatttagttctaaatcattaaaatacaaatacatgtaaaacgtgttgaaactgttcttacctacaatcgccatgtaatctcttctatcattctactctgttttggtattcttcacatgtttttccatctgagatatgcaatagttctcctaatcccaagaaatggctacaaccttggggtcattactactcaggaactgggctgtttgtggatctcattctgtgctgaatggtgcgactggtttcagacatgtccaactgtggcagagagtgcttgttccccattcaacgtccattctccccattttccataataacagagcacctacgttactggagcacagtaaaccaaagttgttaggcacggctactggaaaagctctggaatgggcctaaaatagcttttgctgtgtgcccctctgataagggtcagctgtgtccccacccaaatctcatcttgaattgtagctcccataattcccatgtgttgtgggaaagagccagtgggaggtgactgaatcatgggggtgggtctttcgtgtgctgttcttgtgatagtgaatacgtctcatgagatctgattgttttataaaggggagttcccctgcacacgttctcttgcctgccaccatgtaaaacatgactttgctccttatttgcctccttatttgccatgattgtgaggcctccccagccatgtgcaactgtgagccaattaaacctctttcctttataaatgacccagtctcaggtatggctttattagcagcatgagaacagactaatacaccctccttcagctgcctggctgggatggaggaccagtgtcccccaatccactgcagagcagtgatttttacaatgttaaacggctagaaaagtttctaaacagatactttcagcttctctattcatctcctggtggactggtagcaaacagtcctattggtgagccaccatttgaatagcactggtctagagcatggactttaggggctgtggctccagccaccatctgggaccatggcgagaccttgagaagaaaaccatgcaccggggcagacaggaggagactagatacctgaggtttaggtcactctaccaacccggggcagcacaccctgaaaacacctcattttatatgagaacatagatgtttatcttaaacaactacgatttggggttatataataaacagccaatccgaacaacaactgacgctcccattttgcagaccactacaaaaatgtcacagcactacattatcgctttttattctcacatgagaataaccctatgaagcatgtagcatgggtattattttggtttgacagctatggaaactaatgtcctaaaaggttaaatagcttgtctaaagtaacacagccagcaagtatagacccgcaaacaaaagccagctaggtaccctttccaaaacaactcacctctccatgaagtgaaatcatctcatcacgactgtacataaaatacgctgtaaatgatcagaggtgtgtacttacaacaaactacataaaatgtgtatgccactgggtagaaagatacaacaaaaatgtcacagtcaactagttaatataaaatcagatttaatggctacagtgagaatgtactgcattttacagtggtaacaaagcatctgtgaaagtagacagaggcgcagaaaccacagacaatttttataataatttagccagcaatatagcaagtgaactatgagcaaatactacaatatagtctcaacatttgagcctctacatataacatatagtctcaactaatactagatgtaaatacaatatattaataaataataatgtttaagacagtttgaataataatgtcatggttaatagtaacatattatcctttagcataaataagacttctgagaatcactggcaatcagatgcgctctgaaccattcttttgatggtaaagaaggttggcagagagccatccccactcacttccaggaggccctgatgagcaaaagcatattattaaaaagctgcgggggccaggcacagtggctcacacctgttaatcccagtgccttgggaggccaaggcaggaggatcatttgaggccaggagcctgataccagcctgggcaacatagtgagacttcatctctacaaaacattacaaaattagccaggtgtggtggcatgtgcttgtgtggtcccagctactcaaaaggctgaggcaggaggatcgcttgagcccaggagcttaaggctgcagtgctctatgatcacaccactcattccagcctaggtgacagagcaagaccgtgtccaaaaaaaaaaaaaaaaagctgctggtttggatctaccatgttatctgtgactgtggactaacttttctttgggtaaaatttctttgcctatgtgggtatcaaccattttatttcatctgaaaaaaaaaatgctaaagcatttgtccatatccatacttaactgttaaatattaaacagaaaagttatatttatcattaaataccaataaaaacttttctgttgtcctgaatattttgttacaacattaaaaaaagtacacacacacaagaaaaattcagacaaactttaatgtattttattattaatgttttatttttatgtattattttaatgtatttatttttatgtatttatgtattttatgtatttattttaatgtattattttaattgtattttattatgtacatattttcctgtcatattttcccttcagaaacaaactgccaaagaaaaaagatgaaaaagcatgtttaagcaatatttaattgctcctagcatttaaacatgttataaaaatccttaaagatcattagtaaaaatgagttcttacaatacctatccactagtacactatacaaaaaacaattaatggaaggaggagtggttagagggatgtattggtagagatatagatatattttaaaaaaggatgcatcaactcaaataatataggaaagaagaaatgcaattcccactaactctgcaaatgaccctcaaaccttacacaggcacaaggctacaatgaagaaagcaagtaagttttggagtgactccttcagggcactaatccccaaaagtttataccagctcaggcttcagcaaactacaggcccacaggccatgtccagacaccacctggactctactgatccactagaaataaagtgattcagtaaaataaagtttcactgaaacacggctacacagtcatgctcatttgtttacaaattgtctatggctaagttgagtagttgccatacagaaaataaaactgaaaaaactatctggcccctaataggaaaagcttgctgtccctgagtacaaaaataaccaatagtaagaatgttcagaatcagctggctgagcagcagcaaaaaacaggatagctctcctctagaaactggtaggagcaagctttctgcctcataaacactttgctgtgtatacacatgtagtcttaattcatgagacataagatttgtcttttaaaaagctgacccaaatacaaaccatctccaatcagtttctcagacacaagtcagaatatgacattaaaatccagtgaattgcactgatattttctcttacagacaaacctagtctgtaggaaaataaattactctttctctctctcttttaatttaactaagggtcttgctctgttacccaggctggggtatagtagtacaatcataagctcactataacctggacctcctatgctcaagcaattctcttgtctgtggcctcccaagtagttgggactatagccacaagctaccatgtctggcttttttttttttttttctggtagagacaaggtcttgctaagttgccagggctggtctcaaactcctggcctcaagtgatcctcccatctccaactccccaaagtgctgggattataggtgtgagctaacacacctggccagaaaacaattttctctaatgaattaactgaaaagatttaccacacagcgtgtctatctttggaaacagcgctgccacaaggtacctggtggtgttcaagtacaaatccccctgacctgcaagaaatttcacctttaataatctttaagaaaggtcaaaagcattaacatgacagatgcccagggcacgagccaataaaaggaaaagttaactgggttatctctctcatatgtagttaaaacagcaaatgcttaatcatttaatttgtactgatgctgatttttttttttttttgagacagggacttcctttgtcacccaggccagagcgcagtggcgtgatcgtggctcactgcagcctcagcatcccaggttcaactgatccctctggcctcagcctcctaagcagctgggactagaggtgtgtgccaccatgcccagctaatttttatattatttatagtgacggggttttgccatgttgcccaggctggtctcgaactcctgaactcaagcaatccacccgctgcctcagcctcccaaagtgccaggattacaggtgtgagccactgtgcccagcccctgatgctaatttttaaatggacatttgaattctcaaagaaatttgtgttgcctcttgtcaaaccaggtcactgaaatgataacccacacaataagccaatgagaaggaaaaaatatatgggattggaaaacagaatgaaaatcaacattaaaattccataattaaaacacgcagatagaaaagaatttatctgacaacgtgctaagaaccccctgtcctgtgtttgctgtcatggggagggaagaatgtctgcagcacaggctttcccagtctgattcacagccctgttatatatgaatgtgcacactcgaaacaagatctgatctggacaatagtcaagtctctaaaagcaagggagttcaattaattttttaaataaacatttcactggattttttttttttaatgatcaatcctgttgacagttttcccgtccatcttccagaagaactcactactcaaccaactgcctggtattcagctgtgactgtgaggatggataactatatttccttaagaaatagcaggaaggtatctcatccaagcagaaaataagaccaacagttgtccaggtctcagtggttctgcatttcttcctaaaagagaaatatgtctctaaacatctctttcccgcctcatggggttgggggaagcaatatgctcagaaaaattttaactactccaggcagctgaataaaacaagctgaaaaccctagatgtgttctccacattactgtgacagaatgcaagtgtgtattcgaaagatttcctcgctggaattataaagcgtacagcaagccagcctgctgtactgccacctcgctcttgctcccagactccctcccatggactaagcaggaacgaacatacgagctgtgaatctggtaggggaaacaggaaacatccaaccaggaacacactggagagaagagaaaacagttaaccacctatgagaagatggcgctgattccagcaggtgacaggtgggacgtgaagggcattcccggccctccagcagaagcaacgtcacggagctgggtgctgggtgggttgcaccgttctgaggcagcacggttctctccaatgactctcacacaggaaccagacctgactctgtttcttccaggacggtcctccctcactccacagcctctcatggcagctggacacccaccagggctggattccacacacagaaaccacatccaatgctctgttactagaagtcgaccatctggatttcaaagacctctgtctctttctgtcctttgttaatcagtctcccttcccactcaaccctctcccctccatgccagagaaaaggatttttaaatctgatgagtttttcagggaagcagaaatgtgagattacactgttctttagcctcacctcatggttttgctacagagatcaacgtcttctaacacagctttgcccatactcttcctgaggctgaaccaaaaaatctttcatgaacagtactgtctccaccagcagaatgtaaatataccacagcactgacttcaaaacactgaagtagagagtcttaactctccttagacagaaggcagaaggctgcaaacatcccccagcagactgcaattgtgctgttccaactgacaagcccagtaagcactgcccatgacaggacctcctgcagaacttctcccagcctggcggacagcggggcaggggtcaccctcagaggctcgccttctctttgctccctagccatcacactacactgggatgagacacaacaagcacccaaatgacacagtgaccatttcttttggtcactgaggttcacgagatgggctgtttttctttttcaatcgaggagctgaaatcctaccagccacctaacaattaacaaccccaaccctgtccacggttaaaatcaacgaaaaaagcaaggccaacttcttgtataacttccttcatacgggaaaaacatcaagttcaacgtgtgttaatcaagtgtcaggtcaatgtaccacgcaaatatatttgatgttttttgctaaggccaatactaaactgttaaacacagagaatatgaggaaaaacaaggttaaaaaaagtgtatagatgtccaaccctcttttaataattccaaaaaaacacaaagctacttaggcaaaaataaatcacaaatctattcaggagcactgtaaaacggaagagaattatctaaagggattcaccggctactgactaattttaatatgaaatgcctcacaaatctccctgtgccaccaacaaatcaccagctgaggcaaatcccagataatgaaacattgtaagaagggctctttttaatagtttagcccatcaaggagtgagtattgattcttattttcagcagaaggagacagtcttatctccagccttacagctcagtgacaacatcagagaatttaatcacagagccttttctgccatgcaatccttaaactgtcacctaggattctgtgccattcctcatccatttgtagagaaactcctggtctcacagatgtgtctgcctacttaaaccacagtaaccatattatatggttggctgtgtcccacccaaatctgactttgaactgtaataatgcccacgtgccaaggacgggggctgggtggagataaatggatcacggcggcggtttccctcacactgttctcatggtagagaatacgtctcacaacatctgatggtttcataaatgggagtttccctgcacaaactctcttgtctgccaccatttaagatgtgcctttgcttctcctttgccttccaccatgattgtgaggcctacccagccacatggaactgtgagagtccattaaacctctttcctttataaaaatcacccagtctccgtatgtcttaattagtggcctgagaacagactaatacaccatagcagcacttcaagtcctacagattaaacacatctatctatcaattaccatttgccagctgtttttctttaagaattttttaacaattcatcagatatctttgtgcatttccaacttgtttgttaagaaatctgctcagtatcttaagagcagattgaaaatcataataatagctgtgccaattctctggacatctgtggatatttgtaatatatccaagacaatgccagtaacaaaagaaaaagccagggggaagtgatagcgaaatcagtcattatttccttatcctgacataggaagatcagaaagtcccccaccttccagagaaaattaaccaaatactaaagttagcagtaatattaattcaaaagtgtccctgcatctttaaatactaaaaaagtactcaaaacacagaaaaaattacactgaaaacaagccaatacttttttttttttttttttttttgagacagaatcttgctgtgtcacccaggctggagtgcagtggtgcaatctcggctcactgcaagctccgcctccagggttcacaccattctcctgcctcagcctcccgagtagctgggactacaggtgcccgccaccatgcccggctaattttttgtatttttagtagagacggggtttcaccgtgttagccaagatggtctctatctcctgaccttgtgatccgcctgcctcggtctcccaaacttttttttttttttttttttgagacagagtcttgctatgtcagccaggttggagtgcagtggtgtgatcttggcttgctgcaacctccaccttctgggttcaagcagttctcctgcctcagcctcccaagttgctgggattactagcgtgcgccaccatgcccggctgttttgtatttttagtagagatggggtttcaccatgtgggccaggctggtttccaactcctgacctccagtgacccaccctcctcagcctcccaaagtgctgggattacagggatgagccaccatgcctggccaagccaatactttttaattcaagtacaaatcaaactacatcactgagaggaatgttccccaatccagttacactaccctactatccattatcactgttgctgtgaataattagtacccccttccagggagtggggggtacagaccacgtgacagtgggtgtcactgtggtgacaagactgtttgagagtgggaggtgggagcaatcatttatgctggtaatttgccttaagatgttattcccaaacatccttccatgatcctttggattgagataccttaatcccaactgccttcatgtccaaggtcaccacacacacacacacacacacacacacacacacacacacacacacatcttccttccatgatcctttggattgagataccttaatcccaactgccatcatgtccaaggtcaacacacacacacacacacacacacacacacacacacacacaaacacacacacagacacacatcttctattagagagaaccgaaggcatttgacagctgcctttttaggtccttctgcctttccatccaaactatccatcgttaacaaggccctatggcagtgcagcagcgctctccattctaatcaggcatcgaagagaaacttcactgtctgtaggctgcaaccaagggcagcagcctcacaacaaaagtgcaccctttgtgtggcaatcatttacctgttgtaaaagcacagtacccttctctctaataaaaattcgaaaggccaaaaatcagcattacataatggccaaacataaagaaatgaaaagcagtctgggtgcggtggctcatgcctgtaatcccaacactttgggaggccgaagtgggtggattacaaggtcaagcgatcgagaccatcctggccaacatggtgaaaccccgtctctactaaaaatacaaaaaaatcagccaggcgtggtggcgggcgcctgtagtcccagctactcgggaggctgaggcaggagaatcacttgaacctgggaggtgaacgctgcagtgagctgagactgcgccactgcactccagcctggtgacaagagttagactccatctcaaaaaaaaaaaaaggaaaagaaaacataataaaacagcctcacgctatgttcactggaaaatttatatgcatgtatatgttttataagttatagaagcccataagaattccaatagttcaggggaaaaaaaaagaaaaaaaaaaaactaaacttgagctatataccgatgtctacccactaaaattactaaaactatagccaggaatacttgtttggtttcgtgcccctctcctttacaagggaggtagaaagcaaggtggagagacacccaacagtcacttccgttttaaaaaacaaaaacaaaaccaaaaaacttacacacagcagatttttctggctagtattggccaatctttctcttgacagtattaagtgctatcctttgtgttaacagtcccatgcatttaatttattggtttaaaagaaatatttcttcatctgattaaaaaaaaaatcaatctgacttttctgtcttgtaattaaaacaaactatcaatacaatggatagggggcaatttctctgaaccaggagctgttccagacactggggacaaaaaggtgaatgaaacacagccccttctcttaatctagctaagaggacagacacgtacagaggcatgatgtgagaatgatgctggctgacagtgcctctcaggcagaagcgagagatgactggaagtgggaggtggagaggagaggctcacttttatttttcatttcaatgtataccttaatatttttaacatccatttttggaattacatgttttacaacttcattaatagagttcagaggcacaagattttggctctaagtttacatataactaagtagtactaccataattatcacaagctggtaaataaacaagatggcctcaatgtgccaagggcacatttatgccaaacaaaggcaaagtcacttcatggcaagctgtatttacactgatggtttctgagtggcaataactgaaagaaaagcaacaggaaaaccgagtcattacaaggaatccagccgtctacacaaaccaggcaccatcccagcatccaagaacatgggccataaggaagcagtaacagttacatcacaagcggctacttatttcacaacatcatcgcccagtctattaaattaatgttggtagtcagaactttattggttttgtagtttggtttgaaattaatttataaactgccttttatagctgcattagggatataagcacacaaattatacctaatttgtgtattggggaagggaggaaattaagtaatatagaagaacacaaaaactatttttgaagtaaacatactcaagtttcaaaaacatgaaagaccctggaactgcatcagaagttccacatcctcaacgtaagcaacataaggaggagaccctgtctttacaaaaaattttaaaattagcagggcatggtggcccgtgcctgtagtcccagctactcaggaggttgagacagagaggccgaggctgtagtgagccctgaacatgccactgtactctaggtgggtgacaaagcgagaccctgtctcaaaaaaaaaaaaagaaaagaaaaaagaagaagttccacatgctgcaaaggacaagatcagatctacttttacactagttactggagttggggacaagccttcatttgctaatgctggccatccatcagaatctcctgagaagtgcttcaaaggagtatggattcctgggtttgactctggaacaaatgaatcagtattctcatcttacatgtgaagacagtgggactctgaaagattaagtcacctgatcgtacaactagtcaatgggtaaccaacatgattcaaaccgatactatgattttaacagtaaaaacgtgaggttttttaactacctccatgatctgggggaagggtatactgcagttccctgaactactctttcaacttctctgtaagtctgaaattattttcaaatagaaagttaaaaacaaaaactaaaaagaatagacagcaggctgagacgtgttaagaggtagaggtgggataggaaatggaaaaggatgaggcagaggcctctgaaaggagggcagaggcagagctccatctccacacagaggaggtcggctggttttcagttttgttttgttgtgggggaagaggaggtaccagtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtgggcaataaaggaacgatctttctgtatttctctacattacaaattcaaactagcatttacgaacttgccaaaaaaaaacctgtttatgtttatagagaaatgcattctgaagtccaaacaactgaccacacaacaatttctaaacccttccactactacataaaacatctgcttctgtgctaaacttttgtaaggcacagtttctgcttcaagaaaatctgtgatgcttggaattgaggtttatcttactgaagaaaaatctgaagaaaagtgtttgccacccatacagctgataattttttgtaatcctaatggatcagtgggaaattgtaccacgaaatctcttgtcagtcaatataacaatgtctctaactaatttcagtaaagtgaaatctacagttattcccttgaaaaacaggacaaatcaactctttcccaacttttttcttttttttcccgcaagacggagtctcgctctgtcgcccaggttggggtgcgatggcatgatctcactgcaacctccacctccctgattcaagcaattctcctgcttcagcctcccaagtagctgggactacaggcacatgccaccatgccctgctaattttttgtatttttagtagagatgaggtttcatcgtgttatccagtatggtctcaatctcctgaccttgtgatccacctgcctcagcctcccaaagtgctgggattacagatgtgagccactgagcctggccttcccaacttactttaagaggtaactaaaggacgggtgcggtggctcacccctgtaatcccagggtgattggattgggaggctgaggcgggtggatcacctgaggtcaggacttcgagaccaccctggccaatgtggtaaaaccccatctctacaaaaaatacaaaaattagccaggtgtggtggcacgtgactgtaatctcagctacttgggaagctgaggcaggagaatcacctgaatccgggaggcaggtgatcatgccaaaatcatgccattgcactccatcctgggcaacagagcaagaccccatctccaaaaaaaaaaaaaaaaaaaaaaaaaacccctaaaaaaagtgataatagattatctccattactggcagcagaaaacaaatttaagtgttaaataccaaactttttttttttttttttgagacagcgtctcactctgtcacccaggctggaatacagtggcatgattatagcacactgcagcctcagcctcctgggctcaaacaatcctcccacctcagccctaaaagtagcagataacttttgaattttttgtagaaacaaggtctttctttgttgcccaggctggtctcaaacccctaggttcaagcaatcctccagtcttggccgcccaaagtgttgagattacaggcatgggttaccacacccagccaataccaaagttttacattacataggtgaagctagtatccaactattttccaccaattaccatgtaatatggttgaaattacacgacctttcaaacttccagatacaggtgacaaagaacatttttaatataatttctattttcaagatttaaaaattctatctacttttaatgtctacctagctgtcacctcaaaaaattcaagacagattctaaattttaaaaattttccaatttatgttccaggaaatttaagtgaaagggaggaaagctataactaaaatttactaatggctagtagtactaatatacatactttaaaaaaaaattaccaaggaataaatatttaggatgctccagagaaaaattatatctgtaagcagtttcaatctcctcattttatgaatgttttggttacttcagctattaagttttaatcaagctaaaaaataggcctttttccttccatcttaagaatgtcaatgggatgaggagggaaaagccaaaaggtgggaggaatagagtaacaaacttttaatcagctagcatgatttaaaggacacacacttctgtcctttaacacagcatgtttcttgaaaataggttactagttcctaaaaaagaacacaaaagctatttacaggctgaaaatctaagattttctattctcaaattttcatttagagaatacattttgggacaagagggaaaaactacattcattttaaggggataggaaaagtacctgatacgatctaatcgtaaaacatgagatcaaagataagaactgaaaatgcaacttccaggcaccaggcataataatttatatagactctaaaaaaggattaactttaagtgtattacttcaacttcactccagtccttagaaacatttaatatccttgggaaagagtaccatctcttcttccattgaaggccttgatatttatagaagatattgccggccagacgcagtggctcacaattgtaaccctaaccctttcagagactgaggcaggtgaattctttgagcccaagagttcgagaccagcctgggcaatgtggcaaagccccgtctctaaaaaaatttaaaaattagctgggtatggtggcaggcgcctgtattcccggctactcaggaggctgaggtaggaggatcatctgcgactgggaggttgaggctgcagtgagccattatcaggccactgcactccagcctgggtgacacagggagataccctgtctccaaaaaaaaaaaaaaaagatattcccatcaaaaaatactacgatatcctaaaaacaaagttagaataagtaaaaccacaagcttacttccatggcctgaaatgtctttggcaattctattgctaaaaataaagcctaggagaagccccgcatatttgtttttatatatatttctttttttttttttttttttttttttttttgagacggagtctcgctctgtcgtcgaggctgcagtgcagtggtgtgatcttggctcactgtaaccttgaacttctgagttcaagtaatcctcctgcctcagcctcccaagtagctggtactagagcctggtactatcacagccacacaacaccatatctggcttttttttttttttttttgagatggagtctggctctgttgcccaggcttgagtgcagtggtgtgatctcggctcactggaacctcttcctcctgagttcaagcgattctcctgcctcaacttcctaagtagctgagattacaggcgcccgccaccacgcctggctaatttttgtatttttagtagagacaaggttttgccatgttggccaggttggcctcgaactcctgacttcaagtgatccacccacctcggcctcccaaagcgctgggattataggtgtgagccaccacacccagcctaacgtttttgtttttgttttttttactttctgtagagacagggtctggtcagagactggtctgaccagttcaacctggtcttgaactcctggcctcaagcactcctctctcctcagcctcccaaggtgctgggattataggcatgagccaccacacccagctgttcagatattttttcaatcaactagtacggaacaagggctgtgccaagtggctttgtaatcttagcactttggggtactgacacaggaggatcccttgagtccaggagttcaagaccagcctgggcaacatagggagaccctgtctctacaaaaatttaaaaaatttttaaattttaggtagcatacacctatagtcctagctacatgagaagctgagaaaggagaatcacctgagcccaggaggttggggctgcagtgagccagaatggtgccactacacccctgcctgggtgacagagtgagaccctgtctgtaaaatcaacaaaaaaaccccaaaacatgaaacaccccaagaaaggcagggctgaaagtcctaacagtgcctgtaagtaataaagagcaatgcactatccctgaaagaacaagaagctcaataaaacttgcaaaggatcattaaatctaatatatgcctatggaaacaaaaaggcatttaaatcgtaggcagttataaaagcataggtttattgatatttgtgatctaaaaatgcggcttgatgccccttttggaaaaaagatgatgaatatgatgaaaagacagtcttaagaataaattgactgggcacagtggctcacgcctgtaatcccaacactttgggaacccaaggcgggaagatcacttgaggtcagtttgagaccagcctggccaacatggtgaaaccctgtctctactaaaaatacaaaaattaggccaggcatggtggctcattcctgtaatcccagcactttgggaggccgaggcaggagatcacctgaggtcaggagttcaagatcagcctggccaacatggtgaaaccctatctctactaaaaatacaaaaattagccaggtgtggtggcacacgcctgtaatctcagctactcaggaggctgaggcaagagaactgcttgaacccgggaggcggaggctgcagtgagttgagactgcaccactgctctccagcctgggcaaaagagcaagaccctgtctcccaaaaaaaaaaaaaaaggaataaattaactgacaattagcttttatggggacaactgctccaggtgaaaggaacagagctgaaagcaggcccagccgggttctctgatgccagtagcagtcagccttggcattataggtcagctgggtgctttcagaactttcttaatttgttacattataagtcgacagctagtaatcatctttcatttagggtagctggattaatcccaacatttgtattagcaattcttctgaaaatccagccatcttaatatctttcactaaaatcaaatataaaaagcaatctctcatgatctttatcgatggttatttttggcatacttaatggggagtatgccaaagcagggaagccacagtaaataatgaaaaagcaatatagcctctctaaacttctgcaccactaaaaaagcaaccagattggagttctttctaagcaacaagtaggtaacaaacgtaatacaatcagcatttccaaaagagcattttataataaattttcttttttaattcttaaatggtactatggtatcaagcatggaaagcactaatgttagaagtgatacttactaatggtaagtgccttacttcagcaaaaataactctattaacaccggtttgactgagttcaatcgagcctcccacctcagcctcctgagtagctgcaactgcagacacatgccaccacacccagataatttttcattttttcgcagagatgggatttcaccatgttgtccaggccagtcttgaactcctgagctcaagtgaccgaaccgccccagcctcccaaactgctggggattacaggcgtgagccatcatgcccgggctgatttgaggttttaaatgacaaacagcagaaccttcgctgtttttaatcttaacttttaaattattttcaacacctaagcaatctactgattagcatccatagtcaaaaagtaaagatcctctttccagaaaaatgtacatatatagaagattttgccagcagtttcaggatgttcacagaccctctaaaactttcaagagactttatggatttcagattaagaatgacgagaatttgggccgggcacagtggctcacgcctgtaatcccagcactttgggaggccgaggcgggcagatcacaaggtcagcagttcgagaccagcctggccaacatagtgaaaccctatctctactaaaaatacaaaacttagccaggcatggtggtggacgcctgtaatcccagctactccagaggctgaggcaggagaatcgcttgaacccgggaggcagaggtgcaatgagccaagaccgcaccattgcactccagacgttgctctgggcgacagagcaagactccatctcaaaaaacaaataaataaaaaaagaatgaccagaatttgtataattcaagtcttacaggataatagacaatgcttattgtatgcttgctatatgctaagtatggtgctaagaaatttaatgaattattttatttaatttttgcaacaaccctttgtcatagatagtattattattatacccatactacaagtgagaaaactaagagttagaaaggttaattaacatatcctatgttaccaagaaacatgtcaaaagaaaaaaagttccctaatggaaaatgcaaaacaaaaataatgatttaaaaaaaaaaaaaccatacaccgggcacggtggctcacatgtgtaatcccagcactttgggaggcctaggtggggggatcatgaggtcaggcagtcaagatcataccggctaacacagtgaaaccccatctctactaaaaatacaaaaaaaattgccaggtgtggtggaatgcacctgtagtcccagctactcgggaagctgaggcaggagaattgcttgaacccgggaggcggaggttgcagtgagctgagatcatgccactgcactccagcctgggtgacggagcaagactctgtctcaaaaaacaacaacaacaaaacatacacagccaggtacagtggctcacacctgtaatcccaacactttgggaagccaagatgagaggatcacttgaggtcaggagttcaagaccagcctggccaataaggcaaaaaacactgtctactaaaagtacaacaactagccaggtgtggtagcccacacctgtaaccccagctactcaggaggctgaggcaggagaatcgcttaaacccaagaggtggaggttgcagtgagccgagatcatgccactgcactccagcctgcatgacagggtgagactctgtctcaaaacaaaaacaacaacaacaaaaaaacactactcaaataaaacagttcaaaccacccctacaatactgtcctactatgtgtgttaaccactcaaaagaggtcaaacacacaaaaagacatggctaaaagaattaaaatgctaactaactaatatcctcactagtccttgatcttctagtgaggaagaggatgggtgcagccaacatgagtcctctgctgcagagccacacccttgacaatggagataaatgtgcacgtatgtccccttgaaaggttgcacctttcctgctttggctagagcctctgtcatggtgccacgtggtttctatgtaaatcagctggcgggtagaatcatttctgaccagtttagggaggttctgggcaatgttatctttgccttcctacctccctcactactccctccccaccactgaacacagtactttttactagaaaacatccaagctaacagattctcagtacaagtaaaaatgttgcctctccagcagatagaaaaatgaacagataagttaaaacttacaaaattaaatctgatgtttattccatcattagtgtagaaacacagatcacatatacctgaatatgcaaagaaagttaaattatgatgcaatcaatgctatcctataaaaactaaattaacaaaaatagtctattagggaagacatctggtgtatcatggcaagaaatgttaatgatattgtctgcaaccctgtaatcaattttttctcccagcagctctctcattacactgtattagatctgtgtgccttgcaggatttatgagaactccacatatggggaagctttgccaactggatctgattcagatccagctcaaatgactttggcagcacaaagcatcattaaagaacaatcaatacagttagctttatgtagcatcatcttgactgaaagaagatttatcctttcactacagaatctcttacacctacatataatgtacccaagtgctccaccagtcatgaacttatttaaatcatcagtagacacaaatatttttattgctaaaaaataaatactaatcattaattctaatataaaaagtttacaaaaaaattaatgttattatggggaagacttaaaatccattcagcaattcctgttgagtattacagtaaataaaagtattaataatagcatccacattgattaagaaaatatcagcctgaaagtaaaacctactttttagatatatgtggaaataagacatatcggtaaataagacatattggtaattgctaaaggctgaagctttagaagtaggtagtcacattgggaatctactaatttgtcccgtaagatgtcagtctttctctgggaattaaaattagacttttatctatactacactgggttctgtcttccactgtaagacagagaattccaaggtttccataatgtgaaacccccatccctttttttggtatgacccttgagtaattacatcagcaaatatgtaaacgtgttatgctgttgcaacaattactcctgatttggttacaattatcaatatatcatctctactgtcttggtcctcttcatcttacccatgaatggcggccctagccttctacttggaattttcaccatctttccccgttccacactgcaaactgctacagtcaatcttcttaagcagtggcctgcaagatggcttgcctagagtaaaaaagcttacacaggctctctactgcctattacacaaaatcttaactttgctaactttgaagatcctctataatctagccccatttatatctccacatctgcctcccaaaatccactaacctgtgctcttcagtgacgtcctgcgggtcatcttctcacaactcccagactcgtcagcctcactgcctgcgttgcttataaggacaggctgccatgtacacctggaaggctcctacactctgcctatccacttcttattgatgtatgaaaaacatacccagctcctcaaaacctacccaccctcacagaacttccccaagtgccacagcccatctggagcactttcttttctacgacccaagatattaatattctacactgcagctgaacaactcaccatatattgacagtatcttgcattgtgtgtgtctaagtgtgagagagcttgctatcctcttgtattatttgctaattcagtatgaactggggcaccacagtcacttctttacactgacgtcaatgtaactgcaactacacttctttcatattaacccactagtcattcagaataataaatactcgactttcagaaaacactaccattaaatcctccattaagtcctaccattacaggaaaaaaaaggaagacaagtgtgaactttcctaaaaaaagggagatgtactaaacgataataacccctatgatcacccacatgggtccctgtgttttaagggataaagcactacagatacttcatcctgctgcctcttacacatccctcaggaccaccactagtaacagaggaataaccaagggatagccgttaagaagtatagctacagcccgacccaagcctcttgaagggcatattctgcatctagcactggagaaaagcctcgctatttctgagcaataccctacaaaatgtcacccgagaggacaacacccaaaatagtttagattggtgggccatgagtcccaatgagcctggggaaacgcacattccacacttgagctcaaacttacccccttttttccccatttcagttgccaacatccatactcgctgctgattgccagctcctgctccttgcagcagcccagcatgctctctgctggtgccaaaatacccttccaccaaaccccgctaacttctggaactgtcctagaggggtaaggcaagtcccgtattttgcttcctctgtgcatgtacttgttactcctttaaaaacacatataatacagcacattttaaaaggggctctggggagggaggtaatattcctattttataccctatgggatataaaatactgatagcttttaaaaacgggattctccttacccctacaggccctctcccggcttcagaaagatgctgtggtggctgtgatgccaccggcagagagcatgctggggggtcacacaaagcaggagttggagatctgcaacaggcctgggagttgtggacctaaaaaagaaaacagttttaagttaacgtgcccaacgccccatcatgccctggttattaggggcacgcagcacacaagtcggtatctgcaaaaactctttagcagatgacctctgaaacctcagataatttgttctaccactaaagttaacctttttgcattaatcaaagctgttaccttatttcagtgtgaacaaacgtatgacccttctggctccacactttaatccaggtcctatcataaagcagtatggtgtgtgcccctcaaaataaccaagttaagatgtgagatagtgccaaagcacagttaacagcaacatgctatgcttataataaaaacagaaatgcaatggtgtcagatacaaccgtaaaatgaatcacaagtggacaaactgagctttcagaagagtttctaatgacagaagctagagacataagacatgtacttaataaggaaatagggcatttgggtggccaaagaaaggccctgccattttctcaaagttcaagtttaactgtataaagctgaaggcaaagtaaatagacaaaggccccaaaacagagggaaaaagacaatattcacatgagttataattttctccaaacgcccacaaggtgagtataatgaataggcacagagcataaagttccagaaagacattacttatttttataggcaaaactagtttagtatgtatcacgtgtctttttaaaattaactttgaaaacatttaaaaaccaggaaaaaaaagactatagagcaacttctgaaagctagcacagtatacctcagataacagtttgagtatgttccttttcaaatattttagacagcacataacatttttaaaccaatttcatgtggttttgaatgaactaaaaaaaatccataaaatcccaatacttatataagaacctgtcttacggttgtctaaaaattacagatgaacaaccttttaatattagatcattattagggtgtcctgttacacataattccctttgaaaagcaaagagcaattaacaactttctgtaaacaaagattttaatatatttcattatctatttttgtaagtctcttaagctccctacacatagacacacacacacacacacaaaacaaaacaaataccaggaaaataagctaatgttcagaatgttttatcatgatcattttcttttctttttctaaagatgaccatctagagtacatcctgggatctacactaaaatttctgtgcagtcagtctctgattctcatggcctcagtgatagtatagctgacagagtgtcagtagccacaaccttctcaccacacaccttctccccaccatcaccaacactgcaaactccaaattaaagattcaattgtgcacttgaatgtacagcatattcaatattttttgccagaagcatcaaaataaaaatggacttctggataatctcttccactaggaatatgactgcccaaaccactcaaatccttacattcaaattaagggttttaaatcaaaaacacctggtaaagcatttccagacactttggcattattttaaacatgcaaatagttcaagtaattattaaaacattttatatattttaaagaggcattttttcaaaacaagtcattgttctcacatacgaaatgagaaaactttgacagtatctgtttccctaatttttttttagtacttctaacaggtttttcttggactattgagttggttcttaatgcaagcatccatatatacatacaaattacaaatttccaattgaaaagaattaagtttgaacaagactttaccaatattcttgcacagtagatggctgcaaatatcagattgtctcaacctttcttaagctcctttaaaattagaatacctagagttttctgcattgaaaaaaatttcacatatagataacaattttagtaaataacattttcagaaatatattttatggaaatatatataattaaacaaaactttttcaatagtttcttagagtcccttgacccaagtaaattagaagaaaatgaattacccaacctcacagtagtagttaaacactaaaacttaaaatcccaagtgcccaaccctgactggcagccacgagtgaagacaaattgctggcaagctcagaaaatggggccagcaaaatgctgggattatttattcccaaggcctcattttgatttccacttatgttaataccactctgtccactagaggttgacatcagtatcatgcaaaaaggatgtggtcgttcaaaaaactttcaacaccattactccataattgtggcgggaggggagtatagatatacaacctcctctgactcagtacaccaaactcagggctaaagaattccatcttgcttgatgcggtggttcatgcctgtaatcccaacactttgggaggccgaggcgggcggatcacaaggtcaggagttcaagaccagcctggccaatgtagtgaaaccccgtctctactaagaatacaaaaacatagccgggggtggtggcaggtgtctgtaattccagctacttgggaggctgaggcaggagaatcgcttgaacccagaggcggaggctggaaagagctgagatcgtgccattgcactccagcctgggtgacaagagtgaaactctgtctcaaaaaaaaaaaaaagaattccatcctacctcttaactcttaaagaattaaacaaaattagaaatcacaaatttgtatgtgaaaaggccacttggtccttggatataatagctgaaaatacttgataacgaactttaatgtaaagtttttacttcattatccaacactacacaacaagtcacaaaggtgtaactgggtgatactgacctttttatatggtacaagccaagaaagtaaagagaagaaggagctatagaaagaaatactcaattttgcaggcctaccttgaaggactgtcaaaaacaaaaacagaaacaactgatgtgtcacacaggaacaaatcatcatagcgtaaggcatttttcataacacatggccttttctgggaggttcacacgtatactaggccctcatttatctttgctgaaagtcagtcatatggaaaactcaaaacaatataatgatgcctaaaaaatgttatgactttggctacattcattcaaattcgtgaagaaaacaagaaactgaattttcttcaagtattttaaaagaaataaagttttattatttctatacattacacactgcaggctaaccaaaggtaattgagtagacttctttggcttgtttaagagaatgttaatttgtgttgatgtatgcactgtatcaaacaactactactaaagttttttaaaaatacttatccagtgaatttattccagttaaatgttacttcattcagtattcaataaatacttactgtggacattacagccagccaatgtgctaagcacacaatatatacatcagtgaataaaaagcataaacctaaggtaccaactaaacatcaacatcacaatcagtgtcattctatggggcactggacactttgtaagtctgaccttttaatctaaaaacaatctacttggcaaggtaggtactttatatcccaacttcacaggtaactaaagaaagttaagaggcttaagtgtatttcctaaggtcaggaaagatggcaactgatggatggagtatgtgaactcagacaacctgatgtcaaagtccgcgctctgaacctgggcaatctaccatccctcatctcaatcccagaataacagatcctaaattctgaattagccatgttcaaattatgtgcaccttcctgcccaccccccaaccaaaaaagggctctaatgcaagatttacctccttttaaacgaatgcccattccgtgaatgtccatacactacaccttctgtgctaagtggtaacagccaagctgggactaaagaaatgcagtcgataatgcgtaagtctgataattaagtcactgtgtgtacacttgaatgtgtgcacaaagagtatgtgtaattaagtcgctacctgatgatatctcccagcatcatctatggtcctaataagacataattactcatcctcagtaagtttttattacaaaggaggagaaatagcttcttgttacttttaatccatttttaagaaaataaatttggtggagggcgggcaatctcaatggcaagtggaacctaagatgaagttaatttctctgcagcccttctgctgttgtactgtcagggaaggcatgaataaagggtagtgagtagcaaacaacttatgagtacagaccaggcataagagagaaattccaagtgtttttcctccaactgctcacatttgacaatgaaacaacgagagggatatggtattaaacgataaataacttggcccccacattcacagcaataatggaaatgtgcattctccaaggtaactagtagtatgcatccttagctattccacattcagaaccagcatttagaaagtaggctgttagggacacaaatgatacagcggcattctcatctatgtggagccgtaacaatatgtcgagcccagctaaccatcacctgagacactttaacatccctaactatcacccccaactctaaggaatctctgtatctggcttaactttaaggacaattttccaagttttaataaaacagttaaggaaccaaaatgaatcaatatcattaacccaaaatagtacttatagctacatatactacctagaaactcatttggtataagtaacagctgaaacacctatgtaactttaggaaaccaaaagcatgttttcctctactgtatgaatgacagcaatgcaagaatccacactgaatttccatggagactattacaggactgagtttgcttacttatctgtgaataaagaaaggtagtaactgctacaaggaactacttactatacaaggaactcctcagtgctatactgaatgaaaattagtgtctccatgaccttgttagcattctcggactccatgattacttccagatggcaaattatttgtattatacttcttaatgcctgggtttctataaaaatatgattttattgtttttcgtaaacaaacaaatcatttcttttagaactaaagtgaatgcccttcttgtcaatcctattcagaatgttctccaaagaagactgacatccaataatgccacaagttgtctgtccacttagaatctaagatcactgagggaatgaacaatattttatacttcttcagtctccctttaggtgctgagttccataaagaacacaaagcaggtattcagtaaatgcctgtggaagtccctgattatagctcaaaacatttctatttgcactctgtgatataatgctcctcaatgatattgactcattcagaacaaaaccctaaaagtaagtaagtcacatggtgacctataaaagctatgggagggcagcagaagggttggagatattaatctaggctctttccattgcaattcatgaagagccactcaagctagccaggtgagagctctttactcagagcgaacaggataatctaagaatcctgtgggaagaacatcagtgcagtgggacccaggagagtcaaggaagagacggctgtgcacacacttcccttggcagtctgctgctcttcccacagcttgcctgtcctctgcttttcccagtttcctaccctagcaagtgagcttgcctatgccagccctaaccttgctcttgtcattcaggtaattcttttatttttaatttttacagatatattaggggtaattcttgaattatctattcacctttcccctctactaactgcctcagtctctcagtttctcaactctaaattctaaaaatgaaatttggctcaattaatcttttcatgccaggccacaaggatcacagactgtcattccgtattactagtccttcaaaaagctaaataaagactttgccagctattttactatttagttcagaaatctacagtgcgaagcgacctttttaatcaacaatacttctttctcctgcttctaagtacgtgctgtccctaattctaccctgcctcttctgcttgcctgagctcctgcttttgactacttcttccataaatactttggtcagcgcattcaaacaaaatcagacctctccatttgtaaataagcccaatcaaatgaatacttcctaagagaatgaaagcttcctaatagaatacataattcctacctttaaaacctcagctcagttaggaacttaattgcttgatactatcatagcctccacctaccctgtggaagtgtgggctcgaaatacacctaccagtgtaggacggtggtgtccctatgtgttttgatggttgaatattaataaagcagaagccatggatcttatccccataggcaagataaccacacaacctatcatccacactcaagacatttttgagagtgaaaggggaggctgtttaatagtctggcaggacaacagacagggatcaggacatagaggcagctgtgttctataccacagactcgattctaagggaatgcagcagcagagtagagaagacaacccaggtccccacataaaatacaaagacccttctccttatctcataaagagctatttcatgaaatgtgacccaaggcccttggttcaataaactgccattattctagcctcggtgactggcggtagatgtctcctcctccccacgcctcacctcattagcttttgttatctttaacatcgtaatcgtacctactaatgtgtatcataacgggcattcacccagttacttttacagtgcccaaacatcctttatacacaaaatttcaccacggcaaagggattctcatttatagtataaacaatgaaacacatctctcagttataaccccaaaccaactttttattttatgattattaaaaagataaaatacctaattactcaacatttcaaagccatcgggtttttgtttctttcattgctccactagtcatgttatttgctgggagcaaaatcaaattcaatttcttcttcttcttaaaatcttgcagagaaacaaagcttatttccttctgctcatcttttacccttatagcttcagtaaactgaaggagaaaaaaatcttgatcattctcatctgattatcttttaataagtacagagaagtaagaaaataagaaagtggaaataactatatttattcccagagcaaatatttcatcatctgttgttcttacacaacaactatgaggatgtgctgaatacagaacctcaaacaaaaacatgagaaacagcagtgtgtgatttagaaaaaggtatctaaacatactgcaccctacttcccacactgtttttgtagacagctttaatgtgttgtattagaccaatactgacaacagaagctttagcttttattgctgttaataccctgagcaattaccgtaactcagcaggaacctctgcccagaacagcaactatcacattgtaatcagcatttcataagagatgctgttcaaacaggaaggcacctgctaatgtgcaaaaactgtacaaagggggctcaagatctaataggtaaaataaaaatatttacaattttatttcacagctatatatttttcacggtgcactgatgtttggtttagtaaaaatcacacaaaaagacaatgggcaggaaaagggcagtagcagcagccactaccaaaacaaaactcttcaggaataaggctacacccgtatttcaggtgtcagtgctgtatctgtttaaaaaaaaaaaaaaaaaaaaaaaaacacactttggaaggaaagatataataagtagcaaagacctctaaaaatggtttttaaaaattcatatagacataaaaactggatagaaagcatttgatttacaagattaaactgcaaggccaccttgcaatgcaaccaggaaagttaaaagccgcttatcaagaatagatccatcttagaagtaaatagcacatttgacttcatcttaaaacagtaagcatgcaataacttaagcaataactttttaacaaagaaaaataaaatgtgattttttttttttcttactgaatatactactttggtacttgggccattaaaaatgataaaaaacaaaggagatgcagagaaagatcttttcaaactacatttctttagactgaaatatcacatacaacatatgtcagaacacaaatattgtcaaattacaaagggtgttggaaataagagcattcacagatagtgatacacatctctacaaagctaaggaattacgaattctctaggcctaagagcacagacagtggttcacaatcttcaaagtactaggatcccttgtaagatcaaaatgtttcaaaagattcccaaatgatactacttcagtagtatttcaaataccaattgtttgaggaaaataacaaacaaacagtggttcccggctggcatggtagctcacgtttgtaatcccagcactttgggaggccaaagcaggcaaatcacttgaggtcagaagttggagaccagcctggccaacatggtgaaaccctgttctctgctaaaaatacaaaaaaaatcagccggttgtactggcacgcacctgtaatcccagctactcgggaggctgaggcaggagaatcacttgtttccgggaggcagaggctgcggtgagccaagactgcaccactgcactccagcctgggtgacagagcaagactctgtttcaaacaacaacaatgacaaatagtggttcttaactgtgtattgcttttaaataagtgaaatttttaaaaatcataaaagcatactgaaaacaggctgaaaaatcgttgtccagacgtgtgagatcaatttatttacatcaagcttagcatgtttatttgcagacctctgccaaatctctgcagacatccagggatccaaagcctaaagtgtgagaaccactggccctaaaaaagcgatttcataatgaggaacatcaacacttatatattcaggaagaatttttaatgagaaagtacagtagctatgtccttacttctgcaacacatgcactaaaactggaaagaaagtataacaactttaccacgcccaagccagacttctttcaaccgctaccccgggaaacccccacaacaatttcaacatcatatactccacacctgccgaaatattgaaggaagtgacaggtttccactggaaactattctctgacccgtttatattatttcccctactcatcaatttactgaatttactttacttcaggctcttaacaatggctgagaagaaacaagctacttcagaaattcaagggactatctgaaattgtcaaaagttactaaagggataaaaacttcagaaatattgtttacaatataagcattatgagagtaagtgttacaaagctgaaaagatggaactagtaaccctcatttcagtgctactgccacgaggcagttagcactcaaaaggtgaactggtaaccacgtcaacagcgatggaggaacaataagagatagccaatggaactggaaaaagagagaatacagagcagagtgaacagcacattaaaaacgcttaccagtttgaagtcttgaatgctacagatgaaatacggtgtgtttggcctccgactctcgatatacacacagtctttaaaagaaaaagaaattttaaaacaatggcatttacctttaaggaacaaagacagggcccataaagccactgcataaataaataaatgacaaagcacatatcttttattgtaaattttttccaaaagatgatattaaattgcaaatatctttaggctaaaggaaaactgccctttggttctttctgattatttttctaataatttaaagaatctgatgaagcctaaattattttcttcagagtccctgaagaagaaggggaggagtccaagggattatccatattcagatgaagacatttagataaaagaaaccgcttgctcaagatcacacatcaagatgaaatcttgagtatcttattcagatacatgttcacatgtcttcgaaaaagagaaacggctttgccacgtgctactatatttgtaataaatattttgtgaggaaataaatgaaatacgcaaagatgactagcttgaacatgctattacaatgaccttttcaactaatcaaaaagagaaagaaaactaatctcttacagacaatttgccattacattgtaccctaaacacattttattttctaactgtaaacaaaaacaatgccactaatcagagatggaataaagtaaaccaaattgcattttcttcagggaagaagggtgctttcttaaattacatttgacatggcagtggttggaaaataatttttgatgctctcaatgactggagtgtaaagcgttgcttttgtttgtttgtttgtttgttttgttttgttttgttttggctggtctcctctccaactcctgggctcaagcaatcctcccacctcagccacccgaagtgtcaggattacaggcatgagccaccacgcttggccaaggttgctttttaaaatgccatgttaagacacttaaataaaaagcaatgattttaaggaaagcagtggctatagagagagttaacctcctcctacccccatatcacaacctaagatcatcataaagcttaggtcaggaaagtctacgtattatttactgaaaagtaaaggcacagtcaatgaaatctaggaatagtgaccacaatgcctcattcattcattcattttgcatagacagggcctcactatgttgcccaggctagtctcaaactcttgggctgaagctatccccctgcctcggcctcccaaagtgctgtgattacatgcataaaccaccatggccagcccataatgccattcattttatacttcctctggacccttcagaatgagtgtatcttacaataattcagatgcttgacaacactggcaacttcctctattgtctcatttgtcttatgtgttgagagcgaagaaaaagcacagaagtagcaattgggagtcatcacaaaccccaacagaccaactaagatgatcaggaagaaagtcctcacaaatgagtacattccaagaaactttctgcagaacatcaggatctttgtacctacccaaaaggcactctagaaaaagaagaaatctcaatgccaactatttaggcattcagaattccccaactgatttctctactcaaagatggactcaacagagatttaatccctgaatccacgtaaaacagtagctcaggaatgaactgttgactaagctttccctatcttgttccaaggtcccagatgctaaataactgtgcttcagcattcaggcaacatcaacttaacatgctaatcatcttaagggacaagcaagagaattcttcccaccacagtagatcattctttcatactcctaccttggtattcaagtaaaaacagaagaaactcaattccctagataaaaactgtagctccaaattacacaattttggaacaacccaaagttcttagtttcctgtgtttcagtccctgttatacccactgccagcatttcagatctctagttatcaattatttactcaccttactcaactcaacatgccctctcctttctgttgcttcctacataccacatttcatgacattaacaccatcatagcctagctactgacagagcaggagcatcaccatcttggacaagcaccaccattttcaagttccccttgatcaaaaactgcctaaatccaacccaaagggcatcagcctaatggctaatgacatcatgaccataaaccacaaatgacatctccaaccacaaacattccaatcctaagataaacccctctctgaccacagacatgccagcccagagataacgtcccctctggctggagagatgtcagccccaaaacattccaaccccacaataaacttctcctccacacagaaacattccaagcctgtgataagctctcctgccctaaatccttaagtaatactcttggtctgtaatagacagtgctcctgaccaaaatcagccagaagcccctctccggtttattctccaaaatgagcctgtctttgactgttaagccacttttcgcatttctttcctcattctttaactcttacagctactactcactggcttcagaactaataggtccctttctaattaattgcttctaccttcttaaggctcaagtgacaaacttactgcattcaatggtctggtctcactccacaccccatcttcccctaggctgcattcactacaagaaaccccaactctgctcccagtctgcaaaactcttcttctctccttctactagcccctgatcacaccaaccttagaattagttatcagttccatatggagtaactcctcatggctcctctgtaactaaatggcaacacctcccttcttttacataacattaacaatttacattccttgtcaagttatttggcagtaaggtggtctgcactgtccactaacaattactatcaatcttgtaggctcagagaaatgtactcaattctaccttccccgtactcaccaaggactaatgtctgccattagtgtgggggttaaaaaaaataaaaaataaaaaataaggccaagtcaggtggatcacctgaggtcagttcaagaccagcctgaccaacatggtgaaaccccaactacactaaaaatacaaaaattagctgggtgtggtggcacacacctgtaatcccagctactcaggacttagaggcaggaggattgcttgaacccaggaggcggagatagcagtgagccgagatcacgccactgcactccagcctgggtgacagtgaaactgtctcaaaaaaaaaaaaaaacctgaaataaatgggagacacttggaaagcaaagactacgcatgtttttctttttacacaaagaaaagctttatttatatatactttaaataatccataggatcattactacacaccatcttactgtgagatataaagctaacttacatacaaaaaagctttccagaaaaaggaaaaagaacctatgttctttcatttcccgctgcaaagttacattcaagaaaagtgcctgtaaatacactaggatatagctctgttagagaaggaaggaaaggaacatgccggtatgtcaagagcagccaagcacatctgtttgcctaaacacttctcagcagttgtactggagctgcctcacacacctggcctgagaaatgctgccatgagggataagcatgagagagatcctcaaccggacatacggaatgaccactgttacttttccttagattaaaagccacctctttttgtttaaaaaacgaccatggcaactcaaactgatccaaagctatgaattcatatcagacagtccaatacacaaggttaataatctgtaaaatgggtgagtgcatcaagtgagctctatcagtactttgaaacacatatatgaaaaagttagagaagctcactgcaaaattaagtgacaaaacttacagttttgtaagccactggagggtggctgttaaaaaaaaaaactttacatacatagtcatgaaacacagaatggctaagactggagtaataagaactaaaaatgtttcacactatgtaaaacttgccataggaatggggaaaaaaatacactgctttgacctgatttgtctaattcatttttaaaatcaaagcatgacgaactattgtacagtcaaacttttctttataaccctctgacaaatattaggatgacccaacaaaaaataaacacaatttagaattcaagtctcacagaaaaaaattctactttatattactcttaaaaatattcaaaacaaggttcaattaaagccaaattctcatataaaaagcatttccccttggctcattaatcaagcagctatttaagaaaataatttatataaatgtttatagcacaaaaataaagtgctttatttgaaaagggaaagataagaacgtagtcaagagcaatgttaaaatctcagttggaatatatgcccagtaatcttttaaagccaaaatgatttggcaagattttcatgcaatttatgagtgcatgggatgtctgaagctggttataaaattggttttagtcagtaggatcaatgattctcaatctgaaaatctcccacggcccccaagcactgcatatacttctttttttattagaaagctagcagttctgaaagaactgcacaaagctgatgtgatccaccaaatgcataatgcacatcttcagaatcacccatgtaaaaacacgtatttaccagaattgagcaaacggttttggcagggcaagtatatatattttttaaatcttcaaatcagcatgcctgtaatgggccagaaaaatgagtgaggctattaccatcaatatcaattagtccaaacaacacatgataactaatgtgtctttactagggatgtctagaaatgaaaccatgggtctaggttgagacctactctcttaacacctaacctctgtctgggaatggatcacaggattaagtgacctcaaatccttgtgaacagggagcaacaaaatccgtaatttgggcaatgatactgaacagaggtatttctggctgtttctcacaacctcagcatagcttcatgtccaaagatctattgtgccatctgtaaacaacagagcatttgctaagctggggaaggaagtcagccaaaacgtgaaggcagattctcaaggcaaagaaggccctctctgctttttcaaccctcagcaaatcagcaggtttatgtaaatatagcaaaagcacagtcccctcaagggtaaaaatctcagtctgaagcattaggcagtgtgtcattatgaaacacaaagaacctgtcagcatcttttctgacagcctcctacagagcagagtggacacttacctcacccactaatttagcaagcagtgccacacacgccagtactaaaactgtggtcacaacatatataggcaatgctcagccactgctccacctcataaagaattttcctttccatcaatgtgtctccgcctattaatctttgaaataccttctcatccctttgcaaagcatggcagtgccactctgatataatttccaatagaaaaccccattgtaaaaagcacgcatgaacaaagactttctcacaaagagatttctcagagaccaagctgggtggcacagcggtgaaatgggaagttgactctcaggactgcaccgctcttctgctttctgtttctcctctacatgactcctccaccctcaatgcttggaggtaacagtcaatgaggtacagtatgttggtctaatattgcagaataaaaaatccacaagtatctctctacagttaaaacagatgtcctccattttccaagacacacaaagagtgtatatgttatgtgtgtgtgcatgctggaaacaacgctgaaatcccggtacccaaattccaatccagagtctctggcatactgcatgtcctccaacaaaccctcccagttctagtctcccaaaccataaaacagccaaacccatcaccattcctcaactctataaacaatgcactgttcttcatagtaaacactcaaaaattatatgaggaacaaacaaactaaacagagacatggtttaaaaaaaaaagaagagagagatcctagcaagaaagttgctacgctctatcaatatgaacaaaacaaatgctgtattctaatacttctttaggaaataactcgattgccaggtaacctactttagtttcctgccagaatcttttgctgtgaggggtactcatattgactgtaacactggagaatttaaaagggaaaaggactgctgctcaggaagctcaggtgacagcatcactggagccctggagttcaaagctgcagtgagctatgatccagccactgtactccaatctaggtgacagagtgagaccctgtcactcagtcatacatacatacgtacatatatacacacatacatacatggaaaaggaaacaaaaattgggaaaagtgcacctccataaatgaagccttcccagtccttacccttactctgtttatcaactgttatcaaaatcagctgcatcatcttaaggattctaaacttggtgggaaaagatcccagataacatatatctttgttcccctcttttttaaacataataattacattccatgtattgaaatgtctatagattcccaagtagtgctacaaagaaagcctcactaaacacagaacactaaatatttctagcaaacattcatctgtctttatcctcattgctaacaaggacagttaaataatgagaacaaacaagttgaggggaacaggtcataataaactaaaagggattttgttgaaaattcctacatttctcttttctcctttaaaagtcaggaaatctcccaatgtattgaaaacttaaaaactgatctcagataattatcttcccaactttaaaaaataatgctgggccaggcatggtggcacatgcctgtaattccagcactttgggaggccgaggcagaggactgcctgtgccctggagtttgaggttacaatgagctatgactgtaccaccactacactccagcctgggtgacagcatgaaaccttgtctcttaaaaaaataaaaaataacagtgatgtggatgttttggactaactgctgcagcatgaagcatgacccccgcttcccaaatcaatcatatgctatacaaacttgcgaactctgtggaacaagaaaaagcaaaattatcctgccagtagcagaaatcttattagttatactgatatgctaaatattagccatggttggacacttatattacccaagcaaagaacactgtaagcactctcatctccttattttactctgaaaacgttccttaaatagcaccccttgtcagctgtgttggttgagtccctatcatgaaagtgagtttagccaatgtaacatccaagttccagttaactgatgtggatctctatactagtataaaacttgtgttcatatacagcttatgtgctgtaagagaataaaagtaatccaaggggggaaatctattttaaaattcagtgacagccatctacctattgaagtagtgcttgtggcaccacagacacaaaggaagagaacttccaggcttcactcactctttctgtccccttgatacttcagagtatctaatttcctaaagcttaaaaatgcaggtgacaattctatcctcaatttaacgactcatcccctcccccaaaaaaactatgctctgaaccctattaagtagaggatgattactaatggaaatgctgacagatccttaacttaatgatgagaactgatatatggctgaaataatgtacattcaagaaatcaatgcaaagagtccaaacacttctagaacattgtgcccagtatttataggaaaacatcatcagtgacaggtaggctgggtgaaaattcttctctccccgtatggctgacaacaaacaaattgctcgtctgatcttctggtgtcacatcctgcagcgcagatttcaagcaacactgcttgctccttttcagaaaacaatgcactaggagcctgggctttacaataaatgattcaaccaatttacagggctcactggaaatacacaggacaattcacaatgcgtgtgttataattcttatttggcaaatgattttattataaactagtaatccattttctttacaggttttctgctactgtttaatagactgtcagtataatttagatttcatctatttaaactcattcaagcctggctcctgattgtacagtaaatggaacatatttctattcaaagaaattaatgacagttaactgtagtctgcagttctcagttttgtaaatgcaactgttccacagtccaagcatcaagctacaaaatttcccacaccaattattttcctgtacttcacaggcatcttctatttcttggaagccttccttgttaagactaatgtacatattcatttaatattctttcccattcaaatatttacctccaactttctagaaagttaggacttaaatacaaccaaaatgtcagaaaataaaagtttaattgccattctggaaagatgttctactaatacggatttttttaagttagcaaaattcaagattaaaagacatttttaaaaacatactcttggatgattttcttatatatttcaaatcagttacaatgtcaacattaagtgaaatttattaaaagtaggctaaatatcctatatggatttaaatatacaaacaaggcacatggcatatattaatatatactgaattgcttctgagattgatattctgtttaagagaaatttacttatggccaagcttagtggctcacacttataatcccaacacattgggaggtggaggcaggaggatcacttcaggtcagaagttcgagaccagcctgagcaacatagcaagactccatctctacaaaaaaaatttttttaaatagctgggcacggtggcaggcacctgcagtcccagctgcttaggaggttgaggtgggaggatcacttaagcccaggaggttgaggctgcagtgagctataatagcaccactgcgtgccagcctggggaacaaagcaagatcctgtctcttaaacacgcacgtgcgcacgcacacacacagacacacacacacacacacacacaaaaatgtacttctgagtgttagttactagaaatcacaacaatcccgtgagtgatttttcttcttgagtgattactctttcatggaagaggaaacatccacacagctgtgtaagacatgcttaaagcagaaaaaagcatgcaaagatgcaccttaaaagaaacttattggctgcgcacggtggctcaggcctgtaatcccagcactttgggaagccgaggcaggtggatcgtgtgagcccaggagttcgagaccaacctgggcaacgtggcaaaactctgtctctacaaaaagaaaaaaaaaattacccaggtgtgatggcgtgcacctgtggtcccagctactgaggaggctgaggtgggaggattgcttgaccacaggaggcagaagctacagtgaacagagatggtgccactgcactccagcctgagcaacagagtgagactctgtcaaagaaagaaaagaggaagagaaatgaacttatcaaatcaacacccaaacagtaataaggtaaggacccagaatttgctgccccaaactataaccaccagggtcacacaatgacagatgagaagtaaaggaaaaacagagacacccttttcattcagcaagcaaagtctgctcacctggctttgtttctcctctcctatagacacattcaatcaagaccaagccatgcccatcctcacgctgctgctactacaaccgctcttcccaaccaggtcctatcacaatcctgctcaaccttcaggacccaaatgccaccaacttacaacctgttctattcagttatctgcccactcaatgcctattactaacgtatcacttccctaaatgagagcaatttctccccacaaaatgaaggatcaagggctaaaatcctttctactttttttatcttgcagtaccataccactataaaacatcttctacaaagttgcaggcacagaagactgtgctcttgttttattggctgattgttaaaatgctactaatactatagctgacatctaatacacttcattaaattctaccagcttacttgaaatctattacagtgtcagcaggcttcaaatttaattgtttgctttagtttatataaacttgaaagggcaaatgaaacctgttccctgactctcgaaatctacccatacctactccttctctcccttaaatcgttgttgttttcattcgggtttttgttgtcattgctgttgtttgggcaggtcttacttcttctaattgaagtcaaagaataaagatttacttatttatttagagacggagtcttgctctgtcacccaggctggagtgcagtggcgcgatctcggttcactgcaagctccgcctcccaggttcaagccattctcctacctcagcctcatgagtagctgggactacaggtgcccaccaccacgcccggctaattttttgtatttttagtagagatgaggtttcactgtgttagccaggatggtcttgatctcccgacctcgtgatccgcctgcctcagcctctcaaagtgctgggattagaggcgtgagccaccgcgcctggcctgaataaagatactttaagaataatttaaaacatcaagacactttcctatgacaataaatattgagacctcatttttcctttaaagatcttcagcccactgtgaattacaaatgtcattttacaactattcaacaggtattttgaaaaaacaattccacctacacagtaatttccaatcatctatctccttatgattgcaatcatccatctccttatgatacagtgattttgctttctgaaatatacaatatactcaggataaaaagaattctagggttgtaagggattttgtctggtaatctgctgtccacctgtcactttcataatcaaaattagcacagatttcagcaaggtcatagtatttaaagtatctaaatgcttcttgattcctaaaatgagacgagagcttctgtttattgttcaagccctaagaggctctggatgctttctatatgaaaccgtattcacaacagacttcgttcaacaaatgagtgcagctgctctaggccaatataacacttaatgagagtgttgctttagcatgctccttttgtaatctgtaccttggaaaaattacgttttgaacatctgcgaagacaaaatgtatgagaactttgggaggaaaaattaagacttccccattctaaacaaagtatatgaaagaccctttgtcttataggcaagtcttgtcaaggttacattaaaaataaagaatatgaaggattctataaggaaaagaatcataatctcataaaaacattcacacacaaactgactgggcaccactaatgtgccacgtaagtgctggagatgctaaggcgaaaaaaacactgtccttcccttgacaagttcacaatctaatataagaggtagacatggaaacaactgtatgtcttcaattattattttattttatcttatcttatcttatcttatcttatcttattttattttattttattttatttttaagactgagtttcactcttgttgcccaggctggagtgcaatggcgcgatctcagctcaccgcaacctccgcctcccaggttcaagtgattctcgtgcctcagtctcccaagtagctgggaatgcaggcatgcaccacaacacccggctaattttgtatttttagtagagacagggtttcaccttgttggtcaggcaggtcttgaactcccaacctcaggtgatctacccacctcggcctcccaaagtgctgggattacaggcgtaagccaccgcacccggccatcttcaataattttaatggttacttattttttttgtctctgaaacagggactgctagctgggcccaatatttattctccccttcttccttattaagaaggctgggcatggtggcacatgcttgtagtcccacatactcaggaggctgaggtgggaggatctcttgagcccaggagtatgagcctgcagtgaactatgatgaccactgcactccagcctgggcaacagtgtgaatcctcatctcagaaacaaagaagcaataataataataacaataataatattaaataaaatataaaaaaataaaaaacatctggtacacagttggacacatggcctctcagaataaagacacttcccagcctctctaacagctaactcggtcatgcaacaaagtcctagccataaaatataagcagacctataatatttcaacttctggaaactgaatcctgaaaagtggaagccttgctcttcttactcttcctagtagtctgaaggcaaatgtgtgggctggaggtggagcaggagatagagcatgggagaacaaagagaatggaggccacatacaatggagtaacagaagctttgcctgtagctcaagaaccaagccgagaatccacacctcctgattcacagttcagtattttcggccactttactcaaatatttttataaattatttttaaatcggcaaaatatttaaatttcatccattaaatttaaatttctagatgccctagtggcatccagaacacatattttggggaaaatattctaatttttttaaacagaaaaagctaggaacagatgatgcattaaaaagtagaacacagagctcttaatttagaatgatcaaaataggttgattcaactattaccttctcctaggattatgaatcaacccctagcagcagacaaagtcacaacttcctcccctaagagactttacagtgaagtcaagttcctagcacgactctactataaggttgcacaagtaggaataagtgatgttaacctctcctgcagactgcctggcattctttgtgagggcaggtggatggtgtctgctggcactactcagtctcccctctttcatactccacttctgtacaggtttgatcaggacttgagagagaatacatgactgttcttccacaaaaatatagggactaccgacaaacaaattttctagaacattgtattatttataagagttaaagctgaccaaaatcatactatcctaaattctcagattataatctatattttacttcatattagaaggacgatatcctctgtgataccacagctctacctcctttccacacccttaacccggggaccaaaagaagagcacaaaaatatgtctgatccactcatggtggcaaagatttacccttcaaagattatacaaagtctcctgttctattgacacaacatttctccaatttctcttttttgttgacattaaagttacataaggacatttcttcaatttcaaaactacaaattcagtcacttttataggccaaagccctacgatacactagggctggttagaaagaagtgtgaaacctttaaatgtccagacatactaactcagtaattccattccttaggaaagtgagctgaaataaatttatcgatattcatcactgctgtttagaacggagaatatttggaaaacatcaagtccaacaacacagaactagttaaactgtggcatatagccattagcgtgtgagcatgtcatatttttttgtgccatggatgactttagcattctatatacctgttcttaaataaattttttaatgtacgaaagcaacatatattgaaatacttatcataatataaaaaacttgtaatatagtaatatgtgtacttttttgttgattcattaaataacaggatttactagaggtcactccctgaataacctccatactttcaaagtaatgtggaatataaacattattttgagatgttttttccatgtgatgtgataggagaatacctataatttatactgatgtcataggcactgccagtattgctgtgcttatcacctagcttcataaatgaagtgaatgctgaatgtcatttgacatttgatgaactggtaaaaataaagatgcaattttttcctcacccaagttcacaatcccttaaatttgccttggttggccatataccccaggttatgaatctcagcatgaatggcatacaaagcagccagaacagttcagatttacaagtggtggcatggaaataaattcaggacatgttaagaaccacatcacaaaactgcgaatagcttaactccatatacgttcactaagaaaactgaccatacaacaaatgttaacagtggttaagtagcttctattttaacttttacttgtccacatttttcaattttattccttgaaaatgtattatttgttcaccaaaaagggaaaatgcagaaggaaactcatagacgaaaaaaaatttttttttttttttttttttttttgagatggagtctcgctgtcgcctaggctggagtgcagtggcgcgaagctccgcctcccgtgttcatgccattctcttgcctcagccttctgagtagctgggactacaggcacccgccaacacgcccggctaattgtttgcatttttagtagagacagggtttcaccatgttggccaggatggtctcgatctcctgatctcattatcctcccatctcggcctcccaaagtgctgggattacaggcgtgagccaccgcgcccagccaagaaaaatttttgaagtctatagccaaatattataaatgtactcaaagggcaaaagaagaagcagtaagtaaattcaggggagagaacataaaaatggaccacgcttaatcattacagaagctaagttagagaaacaacactgaaaagggtgctggaaatccgtacgttcatgtatcagatgccacagcacttagaatcctgacaactgggagataatagaagtaaaacatatgacaaaactgatggtctctacaacagccagcctccaccaatcctgacctaaatgccaactgcaatctttaaaaagcttgcgctccatgatgccaaatatctattttggggatagctgctgcagacttcaaaatcattctggtttataaccctgaaagatagctccgagtttttctccaaccaaatatcttccagccagtccagagaataaactggaaatcaagtctccattgtctagttagaaactgagttatataactccttgcaaggaagaaatatcatctccccaagtctgagtgctaacagagtaattaccagatgcaaacttcaaaaccttatgtgtatttctatgctgtgaaatagtggtaattaaactactacttttcagttaaactgttcctaaggatgtaaaaatacagcataccaggtgagacctttttgtgacatttcctttccctctactaaaaaggaaaaattataattatacacagtattactaacattgccacaatcaatttggtaactgcacagtagctatgttttataataccagcacaatgggatggccaggacaagtaaagtctaaaaactaaatactgtctaataataatgatagcctgctttagagccaagttatacagagctttacaaatagagcccaaattaaaatgttaatgaaaaaattaagaataaaaagcacagctaggcatggtgatatgcacctgtgatcccagctacttgagaggctgaagtggggaggactgcttgagcctgggaggtggagggtacagtgagccagagattgcaccattgcactccaacctgggtgacagagtaagaccctgtctcagaaaaaaaaagaataaaaaacaacatattgaaattatgctaaaaatctgtatcataaactcactccactttccctttctaaaagagaggtataactataatcaaagctcccctcccaacttttttttttaaactatatgaatctctattgatcagtctacagtgagacactaacactccatctgtcaagtatcaacatctgtccaacacaaagaaagccagaacaatgcctgcagccttcaaagggatataaaactgtacctttgccttttaaagtttggtttatcattttacacattacactatcactctgtacataactgaaaaggcattccttgcaaacataactgaatagggaaatctagagatgtaagtcagaaaacacatttaggggttaaatgagtgaacagtggtggagtatctttcatatgtaacatatactatgatgcctaattagcttgagtacatttttaatggtgaaataatgaaaaagacttaaaggtactggatatttaatgcatatataatgacaaatagtcattatgtatgaattcaatggacttggtaaagtgactagaaatttacccatttccaggcatttaagcattcacttaaaagaatgaagtgactaacttaccttctcccatctatctctggtacttacaatacgcattataaaactcagactaatactaaggaaggagtaaaatagtgaagcatttatcctcactttttctagtatttagggtattcacatagctccaaagtaaaattcatgcacagccatctattctgcagtatttaaaactttttaaaacaacaaatcactcttgtccacatacattttaaagtaatttaacaaacaaaatacactgctccatcttcatagacagtatttttaattttggaaagtctggttttctcagctggtgaagctgtcagaataaatagaaggcaatatctggaaagatgacaaacacatgggtcaatgtcaaatacaagccaatctctgtcaagaaaaagagccaaattcctgcatttccatttaaattacgttatccaactcaaataccaccatgccacttcaaatgaaaatagtttccctttaaacagagctttttacaaaactgatagagtataacagattaaacaactctttcagcaattttcttagctactacaaagtaaggcatctatgtataattataataaggggaacatttaacaattaattgagccagctaaagctaaatctccagagcttaggagttcaaatgcttgctcactaagaaaaaaggacagaggattttaatataactgcaggaaatctcagtccaattagattctaggtaaatataaatcttgttgcactgtgattggaactctgtcacagtcctccggactgattttagcatctggcttggagagtcaaaccaaagaactccttgccccactgtttctctccacacactactgaattaatcaagtacctccaggttctgtgctgaacaaagaaggtcttctgaaggctgtcagcttgcttttacaaccaaccaataagactcacagaacatatcatacaactgtgaggcagtaacatctctgaaaatattcatgatttaccctagtttatcatggcgacaccttaagtaattcactgtctttcctcattcagaattagatcacgtgaggccaggagccatccccttttggagttttgataatggagacttagcaactatctttcaaaccaaggaggattaaaaattaagtaatcaaattaactagggtggcagttcacttccttaacttaatatacatcttttatctctgtgaagatctagaaaagtgcagaaggatttaacagaatcaaaagtatcgtattaacattttgggggtcaaaaaatcaggatatattttatattttaaataattttatagttgaaagaatttggtctgttagaaactggccttgtaaccccaatctaaaaccccaatctaaaacagtaacacttaacaaggattttaatataggactggccctttctgagttccgcacctatgtgcttgtgtatatacttatttaatccccatcacaattctggaggtaggtactcttatccccattttattgatgaaaagacaaaggcacagaggctgtcctctactccacgttaacccaccagcagtggggtactagattatgctgtcctttctccctctgtgtaactgattcagatttgtggtcaagatgaaacctaaggaagtttatgcacaacactgaaacatctaagagaattttttagggctgtttcacttgtaagtctaattaacttataagaagagttaagtacttgaggtttgtgttaatagactttttaaaaatagaaaccaaatattaaattagtaaaggcaagcttaaatgttgaagatattaacgagtttataaacaagactaatttgtaattcaaaatcccttaaaagtgattaaaatgtttaatttataaatgagatttataagctgaattttttaaaaagtgtaacagtgtccttcaatttgcaactttaacaaattgaatatcaatttttttaaacctaggtaaaccttctggacagtcatttctgcatataaatatcaatcttaaggactcttcccaaaaagtcctcccatcaactgctctgtgcacatgtctcctactcaactgctaaaggaagaacagctgagacaatgctacccaagagaggcacctagggctaagcactcacatctagcagctaactctgcctgcgctaataggtatctagggaatgagtaagtgcctagaatgtgctagacacttttccaagtacctgggatacatcggggaaaaagatccctgtcctgctggaaccaaccagcatggaaaaagacacacaacagaaatggaaatggaagatgccatgggtgtgagtgactgtgaaaggtggggggatccaagaattgaaaatcctagtgggctcaaacaatttctggatcaattggccccaggaaggtggaaagttaagaggtagaagagtggaatccatgagtaggtcatcaccaggctgcattcctgaatctgatcattaattgctcataaaaataccttcaaagattgacctttcaacatgtttttgctcattattgagcccaatttttaaacagccacctaaagaacatttctgtttcctctggaacacagtttttgaacacactgtggttcactgcttcttatgtagatatttctgctataacacaatatatgttactgggaagaccacatattcagcaaaaatgttcactaaaaatgaaaggacttacgtaaaatacagggtaaaaagcagactactcaaaccctatgcaactctgaaatcagatggctattttgttaaaaatcaatacttaagaaataagaaacccaggcagttacccaagagtggctgcacgctgccaaaggtgatactgagaatacatgaaaacaacagatgctggcttgaaggcaccaaaacaatgcagtaatctgggggtttttgtgaaggtgagcacagcagacagggcaacctgccacagagcataatgttagcgtgtgcctctctggggagggaaccccaggggacaggtgttcatttttcatttcattttcaatagaaatgagaaagctcctgctgatgcaacagccagagtgaaagtttaaattctcacctatttttttcctttcctgctaaaatacaatcccacattataccattaaagtatatattataattctattccatctggtcacactcctcttgcctagcaaaagttgcacatgaaccagcataaagtgcacattctattgacctcactgttctatttacttacctatcacacacaaagcaaaacaaactattgctaaatatccatatgcaataacaaggtctcatggccagcccacatctatttcccctaccaaactgcttcccaagctcattgtggggaataactttagccccatcatgtgcaggcttgggaaagcaatcaatccaggtttctgtctttttttatacaagacatgtgcatgcaattcaaggtagacatactatatttactcttttggaactgtgaatcttgagctgagtgacagcaaggacaggaagatcctgaagggccctattccagttatagcatgtggttggaacggtcagtagttcccgccaaccaagtacctgaacgctctcgttccaagtaggttttggaggcttttttccagcttcccaaccattatgggggaagcctgtaattatgtgagccactctaacaacacattgccctttgtgttatgtgatcaatgtacaccaccttgcatcaaaaaacttttcatgcatacaacatgcttgctttttattagatcatagaaaaatgtgtatttctctttcagttacttagggttcaaaatccagtaatcaccattagcctatgtattcttgaacaatttactactcaccttctcagcttacttcccatagtttccttatggactatgttgcccaggctagcctcaaacttctgggctcaagtgatcctgccaactcagtctcctgaggagctgggactacagatgctcaccactgtgcctgactagacatacaatttttggcaacaggagagctataaataattttaggagtaaaaggagaaaagagaaaaagagcaaagtaattatatcacttgcattttcgaagaaatcagtctatctcttcttttttcttccacacaggttatttgttttttgtattctcttcagggttttatgcaaatgtccgttcattcttggctttaaccagttctcacaggcccataccattttacaaaccagctgtgtgactttggcctccatgtctttgtttcctcatctgtacagcagggaaacaatgtctaggttgtataggaattttctaaggactagaaattacacactcaaagcaaatccagtagatagaaggtgctttaaaactggttgtcacccatgttgtagctcccttactatttacagccaagttcacagtgccctttgcaatcaggcactttagaagatgcaaattattcccaataatttggccagaatgtaattctgcagccacctctgttcttcttgaactgcatgcatcatattttaacgtcaaaatctcaagccatgaaatcacatattttttctctaatttttgatctgcctaatttgtagtctgccacaggtaagtgacaagcatgctgggtactaatcctctcacctcatgcaatggactcattttatatctgcgttagcttgaaaaagactgggaagcactaatgagtgattagtgactctcaaatctaaacgtgtgtttaaatcacctggacatcttattatataaaacatggattttgattcagcagattgggggcggaatctgagattctgcatttctaaccaactcccatgggatgccaatctgtggccaatgcttggtgcagagaacaactacagtacaggtttcatgatacttaatgatcctttccctataaaatcaaaaaagatatgattaatttgtctcaaatatcacttcccatttctctaattagaataactttagtattttctctttcctctatcctcacgaagtaataagtttttatgtgctaaagaattgtctttcacatacgtggaatttgaataacttcctaatatacatgaaaaggcaatcaactaaaagatgaaataaaatttcaaaagaaacagaagaaattaaaagttaactaatgtaatccataactaaaagttcactataatgtgactgaaaataagaactacattttcccaactgttccaaagacatacaactaagagaactgaggagatgtcactcaaatgtgaaacacctgaacctgagtctacctaacaacaaagctctcaaatgtgaaacacctgaacctgagtctacctaacaacaaagctcttcctgcctgttacaggatgagtttgtccttcccaaaattcgtatgttgaagtctttactcccaatagctcagaatgtgaccttattaaagaacaggtaaggccaggcacagtggctcatgcccgtaatctcaacactttgagatgctgaggcaagactcctggcttgagtccaggagttcaagaccagcctagacaacaaaacaagatcccttctctaaaaaaaaattagaaactagctgggcacagtgccgtgcacctgtagttccagctacttgagaggctgaggcaggaggaccacttgagctcgggagttcaaggcttcagtaagccgtgttcatgtcactgcactgttgtctggacaacagagtgagacccttccccgccactcaaaaaaaaacaaacaaacaaaaaaaaaacagggtcatcattgccaatgtaactaaaataaggacacatgaaaatataattacactgtaggtgtgattagttaacattaagtaaggtgagccctaatccaatatgactggcatccttacaaaaaggaaaaatgtagatagacacagagatatgtacacaaagagaatgctatgaaagatcaccactacgctgccacaaagcagcaaactactgtaagcaaggacagaggcttgaaacagatccttccctggtgccttcagaggtaacatgaggctgggtggagtggctcatgcctgaaatcccagcactttgggaggccaaggtgggcggatagtgtgagccaaggagttcaagatcagcctgggcaacatggcaaaaccttgtctctacaaaaaatacaattagccaggcatggtaatgcatgcctatagtccctgctactcaggagattgaggctgcagtgagcaatgatcatgccatagcacaccatcctgggcgaccctgtctcaaaaagaaatgaaaaagaggtaacacgaccctgccaacaccttgctgttggatgtgtggcctccagaactgtaagacaacatacctctgttgtttaagccactccatttgttatacagccacagcatccctaacatactaacacacagccacattgtgtttcctcccaaataagattaacgttgattaaataacattaaagatgattgtgcagataggcaactaggtcacagagggtctacagtgccaggttctgggaacaaacctgctggtgaacagggaatacactgaaaagctttaagcagattaataataggtctaataagtgcaactgaatttgtcacatgtcggaaaaaaaacattaagctctgcctaaagatgcctttatgctatgttacacaaaaatattcttgccattatcaataaaactaccccaccacaaaatatgaatgtttcaagaagacaccttcatttgcatgtcacatctattaatacctaaaattcttctaaatattgagatgtagataaaaagttacagatcaaatgagcttctatttaaaatatgtatgtgtgtgtgtgtgtgtgtgtgtgtgtgtgtgtgtgtcccctggaacaccaaataccacatcttggttttgttttattttgggaaggaaatgtttgtctgagtaattaattgccttacagaagctttcgatgattcagagaactaaggatgtgacaccacttgcagcctccacagacctcagtgaagacgcagtagctaaatgttaggaccatttgttaaaatatcggggactccctccccactttaaacagtaacttgattgaatggaaattttccatttagaaaatagttgcatgttatctttactttttcttttaaggcaaacttttactgaagtgtaatacatatacagagaagtgcaaaatgcagtaaattttcacagaacaagtccatgtaaccagtaccataaaacgtaacatggccagaacctgggggtccccttaatgttctgttccctgtacccatagggcaatctctctcctgacttcaaacaccaaagattagttgtggctgttttaaaattttctataaaaggaattatacagtattatgctcttctgtgtccactcaacatcatgtttcatgttgaaatcatttacctgtttttgcgatggggtctcactctgtaacccaggctgcagtgcagtggtgcaatcactgctcactgcagcctcaaccttccatgcttaagggatcctcccacctcagcctcccaagtagctgggactacaggagcacaccaccaagcccggctaacttttgtattttgagtagagacaaggtttcgccatgttgcccaagctggtcttgaactcctgggctcaatctacctacctacctccacctcccaaagttctggaattacagacgtgagccactgcacctgacctatagtcatttactttaaataggttttagaaataacgtatattccatttttattcaaactagatcctcaggtttcattttgcctagtttgaattttttccagcttaaattccatttgcatcaaaagaaaataacacttaagtgatcaaagtaaacaattctagtttccagggcatttttcctcaaaattgtcaaataaaatggtcaaatattttgcatcacctaagatttcacaaaccacaaacttatatacataaatacatgttttgcactatgttcatgaaagtagaaggaacacatattctaggactatagggtaaataggacaatcaaacaaaattatcagttaatatgacaaaatgttaaaaaattaatacatacttttgaaaaaaaaaatacatttcattatccaaatagcaagcaataccaatatgccaaaataaaaaaaaaaatctcacaataatatgaagttagttttttaaccagttctacctacaccagaaataaaggaatcaaatttcctagaacctaactgaaaacagtagaaagaaattaatatgccacctacagcaaactccagaaatcaatatcctatgctaaagaagcccagaaggaaaatctggctgcacacagctgtgtaataaatcaatttgttaccgtgacagtcatctcaaaacaggagtaatggctgacagacaacaaagaagttagatctgactcaaggacaatatacaatagagccccacaaggtttttgttttggttttatttttaaacaagtctgttaaatcattcattgggaagtaatacaaaacagacttccagaagtcttattctaattttaacatcatcaatgagtcaataattttttttaatgtttctagaaatttctttattcaacaaatattatggaatacaggctgggcgcggtggctctcacctgtaatcccagcagtttgggaggccgaggtgggcagatcacttgaggtcaggagttcgagaccagcctggccaacatggtgaaaccctgactctactaaaaacacaaaaattagccgggcgtggtgtcacacgcctgtaatcccagctactctcgaagatgaggcaggagaatcacttgaacccaggaggcggaggttgcagtgagctgagattgcaccactgcactccagcctgcatgacagggcaagactccgtctcaaaaaaaaaaaaaaaaatgtatatatattatggaatacacactatgtgtacactattgtcagtagatggcaggaattcaatgatgagtgggggaaaataagaattgctgtttttttggagaagggagacttattaatcctaataaaattattactgttctaagtgctagaagaaaagatacaaaaaaggctataacagtatttattaaggaaatgtatttgactaacctgggagaaaggcagtgacactggggtggcagagcttaagaaaagataagaattaagtgtgttaccgagacgagaagagcaagtgcaaaggccccgaggcaggcgggaacatgggcagtgtaagtaacaaaatctattatgctgagctcctaaggacaaaattaaggtaatcccagagtttagcagcaaaggtgaaaaagacctggttgtgacaacgcatgagattaaaccgtagtgataaattctaaataatatttaatttctccataagatcacatgcttctaaacactaaacaatttaaatatagcttgggacagaaaagtatgattatatgaaagcctacctttatcctcaaagtatccctgctatgctcattctcagtgacatttcgagaggtccctataatttatacttattctgagtagtaaaaccaattcagagatgtagaaagcaataaatatttgaaaaatcttaatttgtgctttatatcccatagaaataaatgagtattaaagatctattcacttggaagcggtggttcacgtctgtaatcccagcactttgggaggccaaggtgggtggatcacctgaggtcaggagttcgagaccagcctagccaatgtggtaaaaccctgtctctacaaaaaatacaaaaattaggccaggagcagtggctcacgcctgtaatcccagcactttaggaggccggggcgggcagatcacaaagtcaggagatcgagaccatcctagccaacatggtgaaaccccgtctctactaaaaacacaaaaattagctgggcatggtggcacgcgcctgtaatcccagctacttatgaggctgaggcaggagaatcgcttgaacccaggaggcggaggttgcagtgagccgagatcgcaccactgccctccagcctggcgacagagtgagactccatctcaaaaaaaaataaaaattaaattaaattaaataaataaataaataaaaataaattagctgggtgtagtgccacgtgcctgtaatcccagctactcaggaggctgaggcaggagaattgcttgaacccaggaggcagaggttgcagtgagttgagatctcacaactgcatcaagcctgggcaacaggctgagactacgtctcaaaaaaaaaaatctaccatttaaaaactagtaatttggccagatgcagtggctcatacctataaccccaagactttgggagatggaggcaggaggatcacttgaggccaggagttcaagaccagcctgaataacatagcaagaccccatctctacaaaaaaattgttaataggccaggtgtaagcacacctgtagtcctagctactcaagaggctgaggcaggagaagcaattgagcccaggagttcgaggatgtggttaactatgatcacgccactaccctccagtctgagcgacagagtgagactctctgtttttttttaagctagtaatccattgaagatatcctttacaacattctccacagatcctaagcttttaagatacaactaagcacacaggatctctgcaagtgggtgaggataatggtttttcatcactaacaaaggatgttattgtagtagtttatatcaagaaagtaaaagaccaggtgcagtggcttaggcctataatcccagcactttgggaagccaaggcaggaggatgacttgagcctgggaggtcaaggctgcagtgagctgtgatcataccactgacagcctggatgacagagcaataccctgtctcaaaagaaaaaaaaaaaaaatcaggaaacaaaacaaaggaaagaaaaaactcaacccccatctgggaatctaatcacagtactctgctggtttttttggttttgttttttgttttttaagagacagtcttgctctgtcacccaggctgtaatataatggcatgtagttcactgcagccttaaactcctggcctcaagtgatcctcccacctgagactctcaaagtgctgggattacaggtgtgagccaccttgcccagcccagcaccctacttctgattcttcagtttaagtaaccctaaagaacagacaatatttaacaaatactcatttagagaaaaagctgtttggagaaggcagctaactcagcttcaaatccatcaccaaaacgaaaggaaaccactgagaaggtcaaagacagtctccttaccaaatagacatccactggacctggcaggatgcaaaggcacagcccccactcaagcaaaagggtgcctcacatggagctgtcttgctctgggtgccacggaaatcttccaaaccatgtgtggcctttatagatccttcataatacacttagctttcagagacagcatacctttctcacatgtcacaaaggttttcagattcactgaaacactaccagcctccacaaatacatagttcttgcccaagcactttaagaaccattctgtaaataagtccttagcaatctcccttcacatattcttccagactcaagaagggaggtgtattagtccattctcacgctgctataaagaactgcctcagactgggttatttataaaggacagaggtttaattgatccacaattccacagggctggggaggccttaggaagcttacaattatggtggaaagagaaacaaacacatccttctcatatgacagtaagagagagaagggctgagcaaaggtggaaaggccccttataaaaccatcatatcctgtgagaactcactcactatcataagaacatgatggcggaaactgcccccatgattcatttatctccacctagtcccgaccttgacacgtggggattattacaattcaaggtgacatttgggtgaggacacacagccaaatcattatcaggaggacttcctataatcatagttcaccacgcccagctaatttgtaaaaatttcactacaatcatagagcactgcaaccttgacctcctgtgctcaagagatcctcccacttcagtctcacaagtagccgagactaaaagcacacgccactgtgcccagatccaagactgtttgtggtttgttggtttatttctatttttagggagatactcagcagaaacagggtgccacagtcccataaatgggaaaaatagccggtgtttttcatgttaaagaggtttccttaactgtcgggcttcttggagtcactaattctgactctctcatgagggagactgtacaggcagcattttccacacatatttgactactatttttggtgaaatgtccccactgacaccagaataacgttccatattataaatgctgagaaaggttagcattcaatactgcacaaggcagcttgccttttgacagtgatccaaactgtattaccacattaaattgttatcaagagaaaggataataaaaaagtaaatctttccttatactgaagttatcataatgtaatctatatctaaaagagttggccaggcgcgatggctcacgcctgtaatcccagcactttgggaggccgaggcgggtagatcacgaggtcaggagatcgagaccacggtgaaaccccgtctctactaaaaatacaaaatattagctgggcgcagtggtgggcgcctgtagtcccagctactggggaggctgaggcaggagaatggcgtgaacccgggaggcggagcttgcagtgagccaagatcgcgccactgcactccagcctaagcaacagagcgagactccacctcaaaaaaaaaaaaaaaaaaaaaagggttaacatgttttgttcctttcccatgatttagatgtgcgtacgccctaaacaagcaatctgtggtaactctgagagattcttcagtcactaagaaattcttactgcccaatagctgagtctacatcaaagataaatacagacagtactgtaacctacacacatcatttaatcgttacagcagatttctaactgctctaaaacctccactctgatcaatttatatcacacaaataccttctcagttaatctccaaccaagaaattgtagctgtgaatgcaaatttgtctgtattaagttctagcactgactttttttttttttgcgggggggaggggtggagacagggttttgctctgctgcacaggctgcagtgctatgatgtgaacggggcttactgcagccttgccctcctgagctcaagggattcttctacctcagcctcctgagtagctgggactgcagtctcatcacactcccagctaattttttactgttttgcagagatacggtctcactatgttgcccaggctggtctccacactactcaagcaatcctcccgccgcctcagcctctcaaagtgctgggattacagtcatgagccaccgtgcccagccccactgacatcttttgaaatttaaaaaactcctgtgtgggagaatgaaaatctggaacttgacgtgaagttcataacagtaacagcattcctcagtaaaatgattgttccagattatggacataacacagtgaagtattttaatctccttctcagaaaaacataaaaatgggcagctttaatctgctaattacatctcatacaaaattcatgtcactcttcaacagtaaaagtaactcaaacaaaatgatttcacctaggttttactggcttctgtaagaaaggatcttgttttgtttttttttgtttttttttttgagacagggtcttgctctgttgcccaggctagaaagcagtggtgcaatcatgcttcactacagcctcgacctcccagactcaagtgatgctcctgcctcagcctcctgaatagctgggactacaggtgtgtgccaccaggcccagctaatttgtaaaaattttttgtaaagatgggggtctcactacgttgcccaggctggtcttgaactcctgagctcaagcaatccttctgtctccgcctcccaaagtgctgggattacactgtgcccagcctaaaaaaggtgtcttaatacacacaatacatcaaatgaaaaggaaaggctttgctagtgttcaacaggttttgactcacttgtttccctgatctcatctaaaagttgagtctgtctttttttgagcaatgctataagccacaatatactggtgtgaccataatacattttctggaaaaccaagcaggttagatgactacttctattattgttgattagagagcctgaagctcaaatttttggaaaaggaagttagcaggagcaatacatctctgatcttcagggcttttttttttttctgagacggagactcgctctgttgcccaggctggagtgcagtggtgtgatctcggctgactgcaacctccacctcctgggttcaagcaattctcccgtctcagcctcccaagtagctgggattagaggtgcacaccaccgagcccagctaatttttgtatttttagtagagacagggtttcatcatgttggtcaggctggtctcgaactcctgacctcaggtcaccacccgcctcagcctcccaaagtgctagaattgcaggcgtgagccaccatgcctggcctaaaggccatttttaaaaagtacctctctagagtctggtcgatcctgtcccaaggtaaaatttcctgtttccaagaatcttaaggtttacttgtctccaccaagcagtcaattctgcagggtcaccacagtctcatttatgattgaagattaaaaagcaagcatgaattcaaaagacaaaaaaatactaagcagatggtccagttagagaacaagcagcacaggaaaataagaaaagaactcatgaatgcataaaccaggacacaagagcaaattaaggcagacacaagcaagaagtgggtgaacctaactgaccaaaagtgggtcacatgtttaccaaattaagtttcctactcttctagattccaagccttccttaaagtgtacaaagcgtatttatttcaccataatgccaagatcattcccccactgtaaacattggcaagacccaaacgtaaggctccttacctcctggtctgtagaccacatcatcttcagtgatgtaggatgttatctcaccggtatctgtcctttcataacgagacttttttttcggtggtttcttcttattcttcttcgtggactcctctgcggtggcactattgttgtcattgtcctcgtcttcactgtgatcactctcagcataatttttggctcctccttccaaggtacagctccggcgtggccttgaattctcactctctcttgctttgtctcttttctctctctctcggtcccggtctcggtcccggtccttctctttgtctttgtctttgtctttgtccgctgtcatgattcgccacgtgccttcttctgtcctctcacggctaggcctccgtgaaaggtagacagtaagcctgggcttcagtcttctgaatttctcactcaattccagggaaaatccaaccactccaacaaccccaacgtttcaaaaatgctaggagagaaaaaagaatggttttaacgctttttcatatttgtttcctaaaataatgttttgttaaatgaatctcttacttattcatgctttacacctaaaaacttcgcacaagccacaggagaaaaattaagtgttaaaatttaaaaactacagtttttggtctcagcaaatggtttggggttttttatgacaccaataataaaaactgtctgaatgcctaagagtaaactacacttcctccaccttacatgttttctcctttttaaagaaaaagcaaaccaataccctggtagacaacatataatgggtattattatacaaaaggagcttcataactcataatattaatttaaagaggaaagaatctgtagtaaaaattatttccaggccaggcactgcggctcatgccttgtaatcccagcattttgagaggccaagccagaaggaccacttgaagccaggagttcaagaccaaccctggcaacaaagcgagatcccatctccaacataaaataaaatatttctacctgaaaaaatagtaatagtttgcagcactgtcaaaaatgtctcaggataggccgggcgcggtggctcacgcctgtaatcccagcgctttgggaggccgaggaagatggatcacggggtcaggagatcaagatcatccttgctaatgtggtaaaaccctgtctctactaaaaaatacaacaaaaattagctgggtgtggtggcgggcgcctgtagtcccggctactcaggagtctgaggcaggagaatggcgtgaacccaggagacggagcttgtagtgagccgagattgtgccactgcacttcagcctgggcgacagagcgagagactccgtctcaaaaaaaaaaaaaaaagaagaagaaaagaaaaaaaagtctcaggatatcgcatagagcactatattctaaagatattttctggctacttctacaaactcccagaacttccttcaagaataaaaataatatttaactcaaacgaaagtgagagcttcagagcaagatttttccaccttcagttacattttacacatcttttcatcctaccattttcagttatgttccaaggaaaatgatctctctaaagatgtattactggccaggcgtggtggctcacacctgtaatcacagcactttgggaggccaaggcagggggatcacgtgaggtcagaagttcgagaccagcctggccaacgtggtgaaactctgtctctactaaacacacaaaaagtagctgggcacagtggcacacgcctatagtcccagctacttgggaggctgaggcaggagaatcgcttgaacctaggaggcagaggttacagtgagccgagatcacaccactgcactccagtctgggcaaaagactccatctcaataaagaaaagaaaatgtattgtctctgccttaacaaaacataacagcttccagaaacaagcttccatctttcgggaatattaagtggtttttacagtcttccagatttctactataaatggtatccctaataaagtactccccaaaaagaaacccaacaagaaaagtcttgaggtttttaagcgtctgcaatgggaaaagtgaatcccaaactccaagctaacacagttcttacagatattttatagcaggaaaaaattttgtctttctaagtcagttttggaatagacctaacaataaatttataaataaataatttatcttttgtttttcttatgatcttccccaataccctatctcacttattcaacaaatctttactaaatactatgtgccaagtgttagaactaaaaccacaatggaggagaaaactcatggtccttgttctcaatgctcaaatgcaacaaaaggaggcaaccgatcaatctaagaagcttctgtttctcatgcaactagggtgagaaaggaaacagtgcatataaacaaacaaaagattggtcctctttacttgacaaccacaaacaaatcagtttgcagttacatgcttcagatgcagagaaaattctctttggtcagccaggcatggtggctcatacctgtaatcccagcactttgggaggccgaggtgggcagatcacgaggtcaggaggtcgagaccatcctggctaacacggtgaaaccccatctctactaaaaatacaaaaaattagccgagcgtggtggtggacacctgtagtcccagctactcgggaggctgagttaggagaaccgcttgaacccaggtggcagaggttgcagtgagctgagatcgtgccactgcactccagcctgggcaacgagagagactccatctcaaaaaaaaaaaagaaagaaagaaagaaagaaaaaagaaaattctctttggtcatgctaaaaccataacaattaccatatattctctgcagcgctcttaggtcaaacctcttaccagaaaagacctcctcataagcatctcaaatatccttagacattcagcaaaatagaaagtatttagtctttggaagataggtgatgaaggagcaatcatgcatcataagctacattagaagaaggaacgcatgtagcacaaaactagattacttccttctatgtaagaaacatgctgtttcaaacaggatttccattttctaaacatatttcaagaaaaggaaaaattatcactgcctacaaaagttttgcccagatgaaccgtctgctaaacagatagtcataaactcccaagtcctggtaggctactagtgctagcaactgaaaatacagagacctactacttcctcgacaagtcttaagtttagagcatgaacgagccaatcatgaaagaaagaaaactatcaggccaggggcggtggctcatgcctgtcatcccagcactttgggaggctgaagcgggcggatcacctgaggtcaggcgttcgaagccatcctggccaagatggcgaaaccctgtctctactaaaaatacaaaaattagctgggtgcagtgatgggtgcctgtaatcccacctactcgggaggctgaggcaggagaatcgtatgaacccaggaagcggaggttgcaatgagccaagattgtgccatggcactccagcctgggagacaaagcgagactccgtctcaaaataaaaaacaaacaaaaaacgatcagctaacaccattgttaaaatgttcctctttgaccctgaaaactcatcagtgtctactaggagtccaaaaagaatgaaaagcttgggctgaaaacctctccactgcaactgcagtttcagacagaaacacttctgataactttaagaaaaaaaatcattctccctggggttaacaagataactgctccagaaaactgtgtagaaaacattttttcagcactcaaagagaaaaaatagtaagtccaaattgtacattcaacactactcactacaaaatcatacactgtttctatttacaaagaaaatagagttgtttctgccaaaagtgagcaagaaagttaaaaattcaagaaacaataaagatgtctataaaacaaaatccagtatatgtgtatatttataaaatcaatgttctgatttatctgaaagttggctctatttatatattacataatctgcatgttatattaatatattaaattatatgaataattaataccatatcatttatatattaatgacatatttatataaccaactttcagataagtatgaacattaataatctaagcaaaagtcaatccaattaccatttacatttggctctaaaatacagctcaatgggaatatatttttttcctctatgtttagcatatgaattataattcttctgcgccttagtgtacagtgatcaacacataccaatgatgtgacagataaagaaagggacccagagaggaaccagatggcactgagaaggagagttgtcacttcaatttgctagaaatgatctacaaagtagacgatacaacaacagcatctttattatagcaccatgaggtttacagagcaagtccctcatttgattcttccaactcatgaagtgaactggacagaagttgtcatcctcgctttacagtctacagaactcagaagagatcatctgcacaaggccacgcagccaatgggcacgaagtaggattccagtgcagctgtctcagagctcaaccctatctggcttgcacaggaactcctgctgcctgtgctgccaggatctccagctcttcacaggcaccaacttctcctacattcatccatgctgatgattcacgcagacagatttaagaaacacactcactctgcccccaaagctatttttctccagtcggaaagccaaaaacattgaaaatatctgtgtcaatcactacccaacccagtgaaacaggaaacacattataacatgctttaaataagaaaaggaagaaaatctaatgtagaatacatttcagatttacaacaagcttcagctactcagtgaacaaatgtcaagtgaatgcctattatgtgctatttacagctccaggtgttggtaaacagcagaaaactcaacataaaacccctgcccttatcttgagcttatgtgctcagcagtggagagagaccaccaacaaaaggcaccatacctaatgagaagatcttacatgggaaatctaagggggacacagtgttgcaggactgcaattttaaacaagatgttcagggaaggcctctctgagggggctttgaccctgagtaggagcattagagagaaagccaaggacacatgaagggaggtgattcctgaagaggggaaaaagtgcaaggtccagaagcaggaatgagccaggcccactcaagacacaggagaccagaggggcaggaatagcacaaaaagggggagagaggtcagagatgagttcagaggttgaaggggcagggggaggaggacctggatcctggcaggcctcatgggccagggaaaggactctggcttttactcaagtgaaatgaagttactcgaatgacactttagcagggatgtgagtagcaaagaaaggcatgatctgacttctgtttaccggagatcactctggccgctgataaaacctcaaggagcgcagtggggcacgatcaccccgggaagacaagcagcagctgggaagggctggggtagtagcaacagagaatggggaaagtctcatgtttgtatgttttaaaggtaagagtcaaataaataggatgtgctgataaacttgagaggtgagagagagagggaaaaaagaaaaaggacatctggcctggatggatgaagctgctgtttgagtttcatggggagaccaggaatttggctttgaatgtgttaagcttgatcaagaagcctagaaaatcacagagtcgaagttggcagaggtccaggctggagataataatttagtttttaaagccatgagactgaatgagatcacccaggaagtgagtacaactttttgacaaaacttttaaaactcatgagaacatttattgctcacgcttgagtgcagaggatattcaaaatagacttatgagttacacatttccaaaggcagtacccttaggactccttttaagtatattcctctcaatcatttcctgattagaagattatacatcatcatttcatcttaagtaagaatatgtgggcagttgccaaagctcaaaaaatggcagcttcacctatttagctgaaggccagattcctcacagttttttgatcctattagattccccacttaatctaggggaaagaatcaaagctttcagcagagccaatatacagaattactcttcattttaggttacttcagcctctacaaacaccatcttacctcttcaaaatgaagccaacaccacccccaaacatctcacactacttctcaaaaccaattcagacaaagcacaaaaatttcagtcatactcatggtccaaatctcatttaagagaaccacttcctggctggatacagcggctcatgcctataatcccagcactgtgggataacaaagtggagaaatcatttgaggcaaggaggcaatcatttgagaccaacctgggaaacacagcaagaccccatctttacaaaagaaaaataaatttaaaaattagctatgcgtggtggtgcagacctgtagtcctagctacttgggaggctgaggtgggaggtgggaggattgtttgaggccaagagttcaaggctacaatgggctgtgatcaccaccactgcactccagcctagggaacagagtgagaccctgtctcttaaaaaacaaaaaaagaaaaccacttcctgtcagtacttaagcttaaggaaggggcccaggacagaactggggatactggactgagaagccaagatccaagttcttagcactgccgcttgctgcactgccttgggcaaatcactctacctgtctgagtcgcagtttcattgctgtaaaaggggacaagacctacctatttcacaatgctgctgttgagaattacacaagtatactatatgtaaattgtacttatagattgcaaagtgctttacaaatgtaaaatatcaataatatgtatttatttcagtcatgatttacatctactatggtagataataagctatggaagatataaaggtagccaaaacacccctatcctcaagaaacttaactatttgggcgggggtaaaatctatccagttccatgattaagaaacaaatcatggagaattaactacaaatgaagaaaaaaattaaaaatatttcctcttgggtcatgtaaaattcacttatccatggaaatctgcccctccctcctgagttcccaatcctcaagctctactcatctccattgctcaagccaggctatttgttaggatgtttgacttttgactaaatacagtgagcgaagtcctccagttaattcttcctcactcaaccacagtaagacatacttatatttttcaaatgcctgaccatactctaggcatttttgcttagcacttagtctaccagacacatcctgaacacctctgtaatggacccactgctccaactgaatcttagcttacctacttcaagccatcatcatccctcatgcagatgaatacaactgctttctaacagatctttgtgactacaaaacattgtttgccttagccttcctcccatctgtcctccagtgcagccagccagccagcatatctgacgtcccaccactttttttcataatagctcaattcagatataattcacgttccatatgaatcaccatttaaagcatacaattcatttaaagcatacaatgcccactattccttttcaaagattatggggctgccccttcacctctccagcctcacctctcccctactgcttccacctccacccctcctgcatgctcctcctgctgcctcaagacactccttcagtccctagaacccaactgctgggaatactgttccccgcccctttgtctgtgtaccttctactgaccctcagagtctccagtgtttctgctctccaattccaggaggcctcccagacctacccagagtccagccttctctttgccccccaatcctgcctgtaaaatggccctcattgatcccactagtgttatcagttgttaacttacatcacttccccactaactgcaaagtccacaaaggcaaggaccatgtctaccatgtcatattccgtgaagcaactcccactcaagcaatttcctctctgcagcaaattcaggagagcattttcctcatcattatttgattattcagtagcagctgacaggggctggccacacaccctcctggaaggcctcttttcctttcactttctagacacgatcctctccagggcctatctaactgctccctccacttcttatactaggccaaccagtgtagaagttctgttggggcactccctcttttctcatcctctactttctacctggccaatctcatatataatgcgttcatcaccaatcagataccaggacacacaggaggatccacacaagtacatgtctaccagatctccccttcagcttcagacacatgtgaaaactgttcacctggggtctcttcttggatatctcaaaggtacctcaacatgcccaaaccaaaggcatactctgcgtgcaccaccatgcctggctaatttttaaaattttttgtagagacagggtctcattttgttgcccaggctagtcttgaactcctgggctcaagcaatcctcctgtctcctctctttaatccctacatcccatcatcaacaaattatctcattgttaccttataaatttctctcaaacttatacctccaaacacctccaacatcacaaatcttagttcaatctactagtatggctttcctggaccacttgaatcaggttcttgattagtctcttcaaatccactcctctgaactcctacaattattttactgtactgcagccagggtgttcctttaaaaaggctaatgacattatgtcaatccccactttacaatacgtcagtgactcttcactttggtacattaaaaatccaaatccttatcatgatctgcaaggtgcttatccttttttcgcttcatctctcagcactgtctttcagtctacacccagccacactatccctccctcagttcccagaacacaccacactccttcctacccagagtcctttgctaaggttcttcctaccctttgtaatgctcttcgtctggcctaggtgcctcctacccttccttcaagtcatagctcaacagcaacgtcctgaggatagctttcttgttcaaaacaggttaaattcccttcatagcattttccacaactgtaactttacatttacttgtgtgatttggttagcttctatctccacctcccagctagaagttccttgagggactgacccttgactgttttttgccctttgctgtatttccaattccttaactcactgcctggcacagaaagaggaataataaattatttcttcttccttcccaccctctcacacatacgttggatcagtaaagagggcattatgatgagacttgtgttggggaaagaaaatatttcatgaataaataactgaagaggtacttgatttggttcataaaccatgagtaggataaggagacgcaaagagaaggcgaaagacagtccaggtgggaggaacttcacttaagagagtgttcagttaaatagcagctacaggggaaaaagagcagtacaaagtaaatttaagtagagcaggtggaagggataatggaatgcccccaaaataataaagcagccaacactcactgggcacttaatatgcactaagcactttacacatgttaactcatttaatcttcactataacaaaggtgacaatgtaatttatgatccaaactggatacatctgagagagaaaaaagacacaacaaataaccatgcaggaaaaacatatgaaagccaggtcatatatcctagctatacccttattcagtcagtactactgttatgtatatcttatcaatgcaaaagtaagcactgagaggctgagcaagttgaccaaactcacacaactatgtgtgagacctaggatatgaacccaagcagctgactccagagcctatatgcttaaccacaaagccatcctgccttaaatgacatggccttaaaagccgagttatccaatacagtaggttaagtgaaaaaggtgctgccaggctactgagatgaaaagagcagtctaggaacattcatcttatctggcagtaggagatgttttccaccaagagttgttagtgtcggccaaacaaacttactttcaaatccatattctctgagagcctaagtaaggaaccgaggtacctcaagtacttttgcctgtgccatttctgcatttattgtgtatccaaaaaatgtgttagcatcctcctttaggaacacaaggcaaggagacagtccacgtgtggaagacctacatgaacatcttactctgctagccctgcctccaagagaagcagctgcagccagcatgcagcagaaaaccaaacaggcaccctacagctgggcgacttgcttccaaagggaaatcaattttcctttcctgttgcctttcatatcaacatgcctgggaaagaagacgtaatggcttttgctctggaaagggaaatgtcactctaacacttgtattcactgaataagaagtaaggcattctcataaacagtaacctgatgtagagaatacttcaaaatatgccagagaattgcagatgaagctgcaagatatcactgaaatatgaagtcagcagatctgcaaactcagacagaaataaaacagctttttatctgaaagttatgtggtattgagagtttttccatgttttaaagttcttccacctgacccaaaccaaccacataagcaaagagctacatatacccctgcacgattctctacctctgaggttaatgagtaaactcaatcaatcctgctaagagtttatatactcattctcagaatatacggcttatttaaggaacctaaataactgcaatgggatgcccaggtcaaattcaaagagcagcctttgtggtatcagagcagaaggcagcaaaaaataaaccctttaatgaggactgggtttaatgctgatagtagcacttcctcatctcctttgagctttggggaaacaactgagagaactaagattaaaagactctaataaataaggcttctcaatttcttccaaaaagacatactaataacaaaacacaagaccactgcagagggtgcaaaagtacccaaaacagcaaaactcaaggctacaattaacaacccaattaaaaccaagtaagaaacgatatataatctttattatttgaagcaaaaattcccaaagatgaggtgccccaggaggtttccaataaaaatttaaaatcctgtctttctttaaaaaacacacaaactcggctaggtgtggtggctcatgcctgtaatcccagcatgttcggggggccgaggcaggaggatcacctgaggtcaagaatttgagacgagcctggcccacatggcgaaatcccatctctactaaaaatacaaaaaattagctgggcatggtggcacgtgcctgtaattccagctacttgggaggctgaggcaggagaattgcttgaacctgagaggcagaggttgcagtgagccaagatggcgccactgcactccagcctgggcaacagagcaagactccgtctcaaaaaacaacaacaacaacaacaaaacccacacaaactcattcatacaaataactgctttcatatacttttaaatgtgaagcttttccaattatatacagttagcttgtacactgccaacagttgtgtctcttctactcagcaggttaagggaaatacactgctcactctaaacagggcttctcaactgaactacaattaacatttggggacagataattttttgttgtggggggctatcctgtgcattgtaggatatttcgcagcattcctggcctcaacccatacagattctaacaacgcaacccactgctccagtgagaactacaaaaatatctccagatactgccacatatcccctggggagcaaatatgcccacagttgagaactactgctttaaacaaattatttgcctattgcagagatttcaaagggttaagcatctgtgttgcttcatgcaaaattatgcttcactaatatgcaatccataaaacaccattacgaaaactatagtctgccatgttctttgttctctgaaataaactagacaaattcaaagtattgcttgaaacagtaattccacagatgtttgagggtgaattaggagaacataatcaaatatcctgaaaattctgttgtttactggcaagtcctgaagcttgctaggaacagaattactcataggtgacctgctctggtcatggggtcaagtggaagcttccgctgtcacacaactaaagagaaaacctggtgtccacaaatgccaagggcaagggaagccaaatgccgatgaaaccaaatccctgatcttgaaaggggaaaagaatccctaaactcactttcccaaagcatggctgtaaacagaaaaccaagtggaaaagataaatgcaaaacacaagcagatgggtaaataaagtgtagtatacatacacacaataaaatatccagcaataagaaatgaggtacagatatatgttacaacatgggtgaaccttgaaaacattatgctaaatgaaaagagccagtcacaaaagattagatactatatgattccacttgtaataaatgtacagaaaagacagatccatagggacagagagcagattacttgttgcctagggttgcaagggtaaatacagagtaactgctatggttatggggctgcttctgggaatgatgaaaatgccctaaaattgattgtggtgatagttgccagtatctgtgaatattctaaaatgcactaaactctgtgtgtgtgtgtgtgtgtgtgtgtgtgtgtgtgtgtgttgtgtttttaagacagggtctcactctgtcttctgtgaatattctaaaatgcactcaactctgtgtgtgtgtgtgtgtgtgtgtgtgtgtgtgtgtgtgtgtgtgtgtgtgtgttgtgtttttaagacagggtctcactctgtcacccaggctggagtgcagtggcatgcgtgatcacggctcactgcagccttgacctaccgggctcaagcaataccccccccaactcggcctctccagtagctgggattataggtgtatgccaccacacccggctaatttttttgtattctgcaaagatggggtttcactgtgttgcccaggctggtttcaaattcctgggctcaagcaatctgcttgccttgccctccagcaatccgcccgccttggcctccaaaatgctgggattacaggcataagccaccatgcccagccaattgtacactttaaataggtaaattatatgacatgtgaattatatctcaacaaagctgttttaaaaacaaacacacagcagcagcagcaactgaattacaaactaacaagaaaaagctcaggcttcactacagccaaacaaaggtgcatctggctacgaaattcacaaggatgagctttacctctgcaactgagaaaaaccaccttttaaagctgtaaaaacacagtcaattaaactagtagagttttatttcacgtaatgctgagaatgaaagagagccttctttggaccacggtaatctttaatatacaggaattcttggtcaggcttactatctctgtatagcatgttcaaaagtagattaagttggacagggtttctttcagtttgcaaagctctaagattcaaagtaatttgcaaccatggcacataagctctcagcgtgtgatgaaaggaaatgacagggtgaattttatatttaacttaatacaattacacttcacacctatagaaaaaaatcaaaagcattcaaaatgcacttctaatccacaggtacaaattatatcaaaggaaaaatggaaccacaaaactcatcggagcagctcttttaaacacttagaatctctaagtctaagataaaaggcaaactggctctgactaaaaacacaagtctcagtcaaaattcaatttgctgttttctatgtctgagccattctaactgggtgtgattctaggttgaccaaatgtattaaccctgctctctctgttaacctgatgtcattcaaaaagaaaagcagaagagccactagaacaactcaattaagatgccagcaactagtaactaaccagggagggcaggagaagtcccaggacctagaacataacacttaaatgtagttataacactgatcatcaaataaacatcaatctccagaggagattctgtcagttcccccattatttcagcaaatgtttactgagttcatactaggtggcctaggagctatgtccagaacacacacaatctctaacctcagagagattacaatctagtgggggagagagcagacaataaacaaacaagtagattactacagacacagtctgtaagttggccataagatgtgctatagaaaaaaaataaagctgggcaatggccatggagaggtcatcaatttaaggtaatcactggcaagggatcactggacctaaacgaagcaaggtgcaagttacatggttaaagtgggggaaagcattctgggcagagagaaaagcaagcacaaagttctgactcaggcagaagcatgcctggcatgtccaggcaacagcaaagggacatggtggctgaagcagtgagcgcaagaagaattggagatggagagatagctcagtacttactcaaataagggaaaagccatggtggagttttgcatagagaagtaacaatccgaggtacattttaacagactccctctggctccttaggaaacaactcaggcaaggtcgtagcagtgaaggtgttaagcagtggtcagattctagccctcagaagtggctaacagagcgcacgtggtgtgagaaaaaaggaggccaaggaagacaataaggtttaaatccaagcaactacagtcatttactgacatgcaaagagaacaaaaactgggaattctgttggaatgtattaagatgtatgtgttgagtggtcagaaagctctgggctagacctaaatctaggagtcctcagtgcacaagtactaataaccatggggctggatggtatcaaaacaaactactagggatgaaatattcaagatggcaaagaatgctttgcaatgaatattatggacaggccaaaaacgttctgtaaactgccaatgaagttgaaatggtagaatgatggaaagactacatgacgatgctctgaaaagaatacacttttttattcacagagaagccgtctacataggaaacgggtgcctatggacaacttctgtattaatgatgttaccaaatactgcatttaataaaatccaaaccgctgaagtccttcctggctgatttccacgctagaagacacataggatggaaacacctccccctgctgtttcacagggaaatacaccagctgtccaaatgacttttgccaggtccttctgggctaacgaattaaggaaggaaaaactatttgaaagattcttgccttgtaaattaattctaaaaagagttgtcagatttaaaaattagctttgttaacatttctgagggcctaaattaaaatttttaatgtccatgtgaaaagagaaaaagaaaacatgtagtgactaattatatgaatttaaaacaaagttcaactctagaaaaaatgaaatttaatgggttcgctagtgatatttagctggtaccacaatttgaatccgaaataattcaaatagagcaacatttatatgtctcaggaaggcacactgttttaaagtaagtgatatgaaaaggtaaaactggatccaaaatctgtgagcattatcatgagaaatatatgattacatctgtaagagaaaggggaaagctgctagatttagaaaaaacatctcagccgggcgtggtggctcatccctaaaattctatctagcactttgggaggctgaggcaggaggatcatcactacaggccaggagtttgagaccagcgtgggcaacatagcaagctcccatatctccacaaaaaataaataataatttttaaaaagaaaaaaagaataatctcactccggaaatatattttttgtttgtttttttgagtcagcgtctccctctgtcacccaggctgcgatgccaaggcatgatcatggctcactgcagcctccatgtcctaggctcaagcaatcctcccacctttacctccagagtagctgggactacaggtacgtatcaccacacctggctaagtttccttaatttctgtagagaagggatcttgctaggtttcccaggctagtctcaaactcctgagctcaagcagtcctcacaccatggcctcccaaaatcctgggctacaggtgtgagccaccatgctcagcctggaaatctaatttaaagagatcaaattatcaaattctggctaatgacagggaagatgtttccagcaacgagagaaaatgcagtattattccatcactttctatctactcctgtgcaaacacatttcttcactgcaagtggaaaaaggaaactatgaaaaagcaaagaatggcgcataccttcaaaaatgtcacttaaaattactactgcaggtgtcaacaataacctttatggttattcagcctcagatatacttggcttctggactcaatcaatatgtcaatcttattgtaacttcacactttacagtgtctccatgcagcaacagcaacaacaaaaaaaaactcaagaatatgccagcatccttgtatcagatgtttactaccaaacaaacaaacaaaatctttaatactatttgctcagggtaaaataccaattctatctgcaaaacaaacaaacaaagctctttaaatatttaatcagcagtaattagaatcggaggacagaatgactagaatcagatggagggaagaaaaggttttcatttctaccctcctgataaggaaaacagccatacattcaagaataaaataacttttatcatttagaggagcctaattcatttatttatttatttattttgagacagagtttcactctcgtcacccaggcagttcaatggcacgatctcagctcactgcaacctccacctcccaggttaaagcaattctcctgcctcagcctatcaagtagctgggattacaggtgcccgccaccacacccggctaatttttgtatttttagtacagacagggtttcaccacgttggccaggctggtctcgaactcctgacctcaggtgatccacctgcctcggcctcccaaagtgctgggattacaggcgtgagccactgtgcccagccaggagcttaatttattacaacaagctctcaaggatgatataatgaccccatatcacagacaatacactccagtcctgtttaccatgtaacatattctctaataaaaattcataccccctgacaatgcctacctgggaataaaaaagagaatgtcttcaagtctatgtcatgggttttcaacataaatatgattcccctctaaagcaagcatctgtcaagatcttggaaagaaggtcattactgagaaaagcatttatttgtgaaataaacaaagggctccaaaacagaagtgccaaaataagaaaaagtcaagtatcatgtttctgtaaaaaatggagtgaaaaagcttaaggctataatattttttggctggcgcagtggctcatgcctgtaatcgcagcactttgggagccaaggcaggtagatcactcgagcccaggagtttgagatcatggccaaatcccatctctacaaaaactacacaaattagctgggcacctggtggcaaaggcttataatcccagctactctagaggctgaggtgggtggctcacttgagcctgggaggttgaggcaacagtgagccataattgcaccactgcactccagcctgggcaacagaataagacctatctcaaaaataaatattttcatattaaaaatattcaaattattaaaattgtaatatttattctttggtattatttagctcccatttataacaaaacatacccaaattaaatctatagcaaatgtaaaatgcaagctttcattaaataatatgtgcaaagttgcagctttttccatagatcaatggcctaagagaggcctcatcttgacatttataaattattaacacaggcctgttaaatatcacaaggctaaaagagagcctttgatttatggacctggacattatcatcagaaggaaagtaatacatacttctttttcaggattaaaaaaacaaaaaaacagctacgtcttcagaggtttaccaaataagttttcttaaatatgaaaataactgaataggatcacacatacaaacaataactgtgataacaccaagcaggactgaaggaggcagagactccatttcttccgcaagccagcggatctcccaacaacacttgtactggtcttgtgttggcaaggcttaatcaataccacacagctatttctttctaagcttccatctcatatagtgtaaaataaagacagtagagcaactgctagattaaataaggtctgtattccaactgtttaaagtcaagtgccccaatgttgacttgacaaacttcctcaattttgttgtcaaggaaaaatacgcatttcatactccattttacatactcatacttcattttacaagcaaagtaatcatttcatactccacaaccacaaaaatatcagaagctcagtttggtgcccaacgtaagcatatactgaagaactctagtctctagtgacccttcagctcacctggaaaaaaggcaatatacactaccagagaacataaatcccaaaagcaactgacaaatgcaacctgggaggctgaaatgtaaatggagcacacagttaaaacagcattctccagagaaatcccctttctcacttcagcaaacagaggtcttctcaaaagctttcagtggaaaaactgccacttctgattaaagttaatttgatcaaatccatggggccctgggggaatgcacagatccctcttttctctcctccctgctttaccttgcacattctaaagtgactaacaatatgactaactgcctagagacgtgccattttcagcaactggtaaattacagtgtttttttaaatcagctggttatgatatgtgctgctttcttccctatatataggcctgtcactttcgatatagttttaaataaacaaatgacatgatatgatacagataaaaagcatttttagaatatcagagagtatcagaattgtgcagaaaaggcccagaatggtggctcatgcctgtaatcccaaacactttgggaggccaaagttggcagattgcttaagcccaggagttcaagaccaacctgggcaacgtcgcaaaaccccatctctacaaaaaaaaaaaaaaaaaaaaatacaaaaattagacaggcgtggtggcaagcacctgtggttccagctactcgggaggattagccaggtgtgttggtgggcacctgtaatcccagctacttgggaagctgaggaaggagaatcacttgaacttgggaggcagaggttgcagcgaactgagatcacaccactgcactccagcctgggcgacaagagcgaaactccgactcaaaatacatacatatatacatacatacatacatacatacatacatacatacatacatacatacaggttgagtatcccttatttgaaatgcttgggaccagagcagtttcaaattttaggtattttcagattttggaatacttgtattatacttactggttgagcatctcaaatcagaaaatctgaaatggtccaatgagcatttcttttgagcatcatcttagcacccaaaaagttttgaattttgaagcatttcagatatcgtatttttggatttgagatcctcaacttggactcttaaggtttacactatatattaccatataaagggtctatgaagtctatatgtaagaaaactgttcaacaagttagtaatcaacaaaattaaatacccacagtaaatttcccagtgtaattcatctccacattacaaaacttataaatgatcaatgccaagtctcttccttagaatagaatgtgagtcacagattagaataacacaaatcttacaatttaactgcacttaactatcttaggagttctcagtgggaatctgacatctgtcacatcaatatgtgccttatctactgatggggtttcagaaaagtaatccaaaaaagcccaactgacctttcttttcaccttagagactcagctcacatgaagaaccatgtaaagaatgattctgtcacaaaacattcttaaatggcaagctgaaggactaaagtaagtcacatatttttttacactaaaaaaaaaagaagaacctgacagcaatgagagaggtgtcacctcccaagtgtgacattaaatcaaaatgttcataaactaaactaccaagaaggaataccagaaactcaaggaaaaagagactcttaatgcctaaaaccaccttagggtcccaaggcaaaagtatctctgccctcaatgagccctcatcacaacccaggctccaaactagggacaaaggcagaatccctctgtggtccccagggagttccaaccacccacagggatgagtaccaaatagggcagttattgctggtcactaacttgaactggaggaaaacgtctgaggcagttctgtgaatctttttctccattcaaagcgccctcatttgtcctagacctcagttcctgctctctgcaaatgccacctacatttgtctcagtttttaatatcttcattcaaaaacttacaaagaaaaatcatgtcaggcccaatttcctccttcaagaaaccactcctccagtcctccctaaacagcctcccccttgactctccaatacaagccttctctacagatcccctgtgcttgagctcaccctttcacctttgctcatgcgtccttgccactagcccaagaggggtttttgataaatgcacaccattcacatccacttcaagtgtcagaaaagtaatttggctgggcatggtggctcccatctgtaatcccagcactatgggaggccaaggcaggtggatcccctgagatcaggagttcgagaccagcctggccaacatggtaaaaccctgtctctattaaaaatacaaaattagccaggcgtggtggcacgtgcctgtaatcccagctacttgggaggctgaggcagaactgcttaaacccgggaggcagaggttgcagtgagccgagatcacgccactgcactccagcctgggcgacagagtgagtctccgtctcaaaaaaaaaaaaaaagaaagaaagaaaagaaaaaaaaaaaaaaagaaattgttgatgcttccaacccatgccatgccattccttaattccttttgtaatcacacggtcagtatttcacaggttagcgttctaacataagaataacgtaaaaaccttattattcactaattcatatgtttcatgtaccatctcccctcacccttctctgtagggctccactgacagaacatacccttgtccttgctagttttgtaaacatgagctagtcaatttctctgtctagacttcagtttcttcactgacaaaatgaagataataatatgacgtatctcatggagttgtgaggaataagcaaaataatccatgcaaacttaccaatccacacaatgctagcagatacaagatgctcaataaacctcaacactgctgatgacaaaccatgttattcacatctttagaattccacagcacagaggcaagcaataaacattttgcagaaaacagtatctaaaacacatcaatctggtcccagaaaaactatttgtttgtattgcttaacaggaagagttgtttgttctactcaagaagcctgccttgactcctcatatccctccaaagggcctgcagccctccggaagcctggtttcccaagccaacccttctcaggctgcagaagcatggtctcctggttgctgttcagatccacgagaacaggaactgtgccacatttacctctgaaagtaatgaaatatttggtcatgaataaaatcaatttattagatttcatttttcattattcactaacaagctttcctcttttataatcaaagggcacagattcttaagtaaaaacaatatggttttcattaacgtttttcttaaatacttaaaaaaaacaggcgacttttgggtcttttgttttaaaaattaaattatggggccagacacagtagctcacgcctataatcctagcattttgggaggccaaggcgggcaatcccgaggtcaggagatcaaaaccatcctggctaacatggtgaaaccccatctctactaaaaatacaaaaaaaaaaaaaattagccaggcatggtggcacgcgcctgtagtccctactcgggaagctgaggcaggagaatcaggaaccgaatcgattgaacctgggaggcggaggttgcagggaggcggaggttgcagggaggcggaggttgcagtgagccgagatcgtaccactgcactctagcctgggcgacagagcgagactccatctccaaaaaaataaaaataaaaatacaaaaagtaaattataactctccaactcacatgctaatagtctttacattcccctttccattccaactttctctaaagaaaaaatgtagaaataatcatgtgtccacaaaaccacaaaatgtctagacataagagaatgctctcagatattattcctcttacagccatatgacccacttaagaactttaatctagggccatgctgtccagtatagtagtcactatctacatggctatttaaataaatttcaattaaataaaatttttaaaatgtactttctaggtcacactagccacatttcaggtgcttactagctacatgtggctagcagctaccacactggacagcacagacacagaacatttccattgccactgaaagttctattccacagtgctgatctaaagctaaatgtatggtaagtacaaatattaagattctcatttcctcaataagccactctcttttaatcaactctaatagcctcaagtacaagaatatgcataaacatgaacccaggggactttatctttgactctcacaaaggcaacagattacaattcttcttaggaaagacagtgagacagtcccatagcaatctaaggctttattcttccatttcttcagcaatttacacaacgtgacccgaggaaaaaagagcaagaaaccatttttttccactacctttatctatcatagtcacatctgccaagttttagaatcacaggttccattatcttacaccgtcagcactcttcctttataaattcccctctccacactgatcttctctgactcactcaacatattataccatcactctgaaatcagggcctagagtctctggcagacaggctatatgtaatgacagcctgggtacaatcttaagtctaccctccctcagaggatttcccaaccctatgcaattgtcatgtgggtaggcagaaggctgcacatttttcttcataataaaaacaaagcttcaatttctgtaaaatcaataaattacctccgtatttataatacaggatgatggcagagttctgttttctacaaaactagagcttttaggagcacatgttttcaatcacttatttttcaagaatgattgaaatatctccaagcgctccctgagaacttcactggtgtgatctgccactcaagttaattatcacaggctgcttatacacaggaagagaggaagcgggaaagaactcatgaccttgcacagggatgttttataaaattctctaaaatttaaactacacacgtttttccataatgcaacactatggtactgccttcaaaataatcatcatggaatagctgttttcttagtgatgtatggggaaggtggtagcgggtaggggtgcaagagattctgtacacataagaaaggcagtcacgtgacaccaatgtccttttcctatacacctggtggaaaatggagaaagccagaaaaacctgttcagtgattatcattctgattttttggttattacttcactaaaagaaaaaaaaatacatctgagtatatgcataagttgcatttctctggagtacttccttctgccctctgagtccaggtaccaatgatctctgaggggaaaggtcagccatctgccatgagaagaggccaaaatgtgggcaactattcctttctaaccaaagcacttctgaatctgagaaagcaagcaaacgtagtgtggtgtataaagcaaattctcgcccggaattctagcttgaatggagaggattccatagaaaatgtttccagaaggactctgacaacagaaagaagcaattcaagaacaaggacgtaatgccatatggatgggggaaagaaaggaaaagaaggaagacagaggaggagtctgagaaaatcttagttcttaagcatgagaatcagaactgtgggcttcagggtaaaaaggaaagagagactgaaaagtaacatctatgtttaaatgggtcctttagagaaaagaaagcactcagctaggattaaaggaaaagaattgtacctcctcaactccgtttcagagtataataaaccttaccaatttagaagctacacaccctttcacagttcacattcagctcagactgggagtcggaaattgaaaaacactatagcccgggagaaagagacaggtaaacatacaaaggactgagacaactgcttaccactaatatgggtcaatctcgcaggaatacttgcaaaaataaaaattaccaagtgccctctacgaatgctaaatacaggtcaaaatttccaatggctcaaccacctgagtggagagccggagaatgggagtcagaaagcatgtaaaaccatcgaggtcccgggaaacaaatttcctaggcttttaaaaccattcgtcttttctaacttacagaaaacgcaaactgaaaccattcagaaataaaacaaacggggcagggggcaggagagaaacggccaacaataagctactattctcctaccactttctcactggtgcaggcatctccaaaccaaaccactcagaaattttatatacaaggaataaatcataaggatctcatataggactattcatatactaaattatgtataataaccggggagtctttctcttaatatttttgtcaggagctctgaaaatgaggttttagaagccacagcatacctattcatcttaaaaggtaagatggcttgctttcagtttagctaagctttcatttctatcgtaaatatttgactttagaacactgaacaccatggcaaaaggcaaatatttacttagcttaattattccatatatactgttctacttcccctgtaaatacaaaatatgagttgaaacctcaaatcattaatacctaaatttggccacagattaaagtgtgctattaaacatctcaacaaattgagattaggtaacactttaagttctatatcacaagtcttaaactaaatcaaaaaaagtaaatgaaatttatctataatactagagatcaacaaagaaattaaactgaaataggtactaacgcaatcaccacagatttccacagatcccagtagaaataaagaagtttaatctttagttgaaattttaagagtagccattaaataagtaggacaggaatggaaggcgaaattgattcttttatatcctaatattcatattgagagatctgggcaaatatagtaagtcaacttggttctgggtttgagaaataagcacttaagtacaataaactccacaccagaaatatttttgtatattctactctcatttcaacataaccatgcaaagccctaatcagactaagggcttattttgatcataatctcctttactctgaaccctacctaccctgttttggctaagtgacagattttggccttcctctacccaggcttaccacccccaacctgtactgaagctctgtcgtatcatgagatgaagtctgcttagtaataggtgaaatgggacttgttcccttctttatattataggctgtctataacaaagtcaggctctatattcttcataatttcatgactaataatttcaactaaatcctatctcatttctttccatgatacaataaattcttcacatttcaatataaatctctttatcaataccacagcctttgaatttgcttaagccacacaaccaattcctgttctgaggtactatgaaaatattatgtggcttgttttattgtttaaatggaactttcctgtgggcactgttgttgttgtatgacattaattatctgtccagttcagttttacccaccataaactttctcaaaatgattgggaccatgtcttgttttatgagtgtatttcttgatttctttgacatttcagtgtccactagggactggtaataagccttccaatgtataggtggtaaaaattgttacctacacaataaaaataactatactaattcacgaacttctctatacctagaaatgtgaagcatgtaataatgtttaacaagaaatgccggctctagtactataatgcagaataaaaattaggcaagtgatgactcatacttcacaggtatgccagcctcaatcaggttttcaacccagtctttattagaaatgacaagtgattctttcgcatgccttaatttaatccaaagagcaatcaaggatctgagtgtgaaggtaacagattcaatgatgggaaatacaactactactcaatgctatacttcggtaaaataaacactggtatagcccaaagaccccaatcagaagttagactccataatttaccaactctgcctcactgtctttaccaaaaaaaaaaaaaaaaaaaaaaaagaatggaactcaaaaattctattagtataatcatcaagcttcaaaaaccaaatataacaaatgttacaaattatccatattttagatgccaaatgcctgaagaattaataacatcaaaaatggaatattcaaaggggagaggatgcaggcccagcctcacgccaagccatcctcctaggaatcctacaagtctataccacacatgtaccttcacccttttgttttccttttaatcccactcctccctccagacttgttccttcatcttttccccaattctctgcttgagaatggcataaaagggcaccacttagtagaatctaatcattctacttaaagactaaagaaatgaaatggctggaccctgctaaagagaaaagacggggagggatgggacacctttccaaaaacctcttcagagacacacagaaattctacaacccatccactgtagactgtctaagggaaaactgttccccacagttactggtgctgcttttaacagaataccaataaaggtataaaacacagaaaatattcatttatggcagagattaaaaacaaaatatatgcatttatatgactttatttttaaaaaataaattgaccaggcgcagtggctcaggtctgtaaacccagcactttgggaggccaaggcgggcggatcacctgaggtcaggagtttgaaaccaatctcaccaacatggcaaaaccccatctctactaaaaatacaaaataagccgggcagggtggggcatgcctgtaatctcagctactcaggagactgaggcaggagaattgcttgaacctgggaggtggaggttgcactgagccaaaatggcaccactgcactccagcccaggcaacaagggagaaactccatctcaaatcaatcaatcaatcaatcaagcacagctaccaactccttggggatattacaacctaatcttaattaaaaaataaattcacatcacaggttttccttcaaagccaggttaacaatactacttcacaggttaaatgccagtttttttggtttttaccactggccttaaatgattgcattaaaacacaccaaaaggatcttagtaattaaagatagatactaaacaaaatttccacttaaagtcatgctaaagcaggacaaatttttcatggttcaaggtgtgcaaaaagccttcattttaaagaatgcttcaatgaccaaatacattttcaatgaatcaatgtaccaaataataattaggtatattaaaatatccactttaattacaggaaattttgttagaaaagctagtatcatgaagccactgtcataaaagaagaaataatttatcattaaaaaaaatcctgggcataaacaaaaaaccccgccctcctctcatatgatggaatcaatgctgaaacacggaagcttataaaatcattttaccaactgttacagaagcactaagtatcagacacaggaaaagggggcttaaaaccaacatatttcaactagagatttaaaaacaaacaagaatgattaattaagcaataatcaagttcaaaagtatttggtgaaatagtaagtatagctcctacaaaggataatcaaacccaagcacaatctgatgcctgttaatccacctctccctatgagctgttaacccacctctccctatgagaagccttcctgtcaccaccatctttgcctcctgcaattgcaataaacaggaaacactaattggtcacctccagaagctaaataccagcaatgggtgggaaatccctttactcattcatccattcattcattcattcattcattccattcatttgagacaggatctcactctgtgatccaggctggagtgcagtgcacgatcatggctcactacagcctcaacctcctgggctcaagcaatcctcctgcttcagtcttccaagtaactgggaccacagacacgtgccaccacagccagctaatttttcaattttttgtagagacaaggtctcactatgttactcagggtggtctcaaactcctgggctcaagcaatcctctcttctaggctgcccaaagcactgggattataggagtgacataccacacccagcccaaatttggattttaaagaactaatttgatgcttccatagagaggaacttttaaactacacatttcctgattcaacagtttacctactacacacagaaaggctttccaggaagcattttatatttgctaaataacggtaagtaaaatattttaaagtcatccaagtttcaataacaattatcattacttccttactttgaaagctacaaccatatttccaagtattaaaacaacaaaatacaaataatcctaagaaatccacaataaagatttatctattaaggccgggcgcggtggctcacgcctgtaatcccagcactttaggaggccgaggtgggtggatcgcgaggtcaggagatctagaccatcctggctaacacggtgaaaccctgtctctactaaaaacacacacacaaaaaaacaaaaaaaatcagccgggtgtggtggcacgcccctgtagtcccagctactctactgtttagaatcgttttcaatgtccaaaaatgtgactgctttagagatgccaaataagactaatttaaataacctaagattgctccaattaccgctggtttttcaggtggtacaatgtataaaccaaagaaaagaagctggtgcataaaactcagctggctgaagaagttaaaaataaaactccacaatgatatgtggtttggggaaaaacatcagagttccatttagacatgttaagtgttaggtgcttactggacatgtgagtggagctatatcttctgagtggagatacaaggaaggcagctaagtaggtctggactaaagataacattttaaactctttaggtaatttttttttttttttttggaaacaaggtctcacatccatcacccaggctggagagcagtagcacgatctcagctcactgcagcctcgacttcccaagctcaggcaatcctcccacctcagactcccaagtagctgggactacagatgcacatcaccatgcctggctaatttattgtatttttagtagagacggggttttgccatgttgcccaggatggtcttgaactcctgggatcaagcaatccgctcgtcttggcctctcacggtgctaggattacaggtgtaagccactgtgtctagcctgcatttaggtaatttttaaagccatgcatcctagggaattacgtagaaattcaacaaatatttatcagacacctattatgtgctggagatagagcagtaaaccaaagagtcaaaattctctgtcattcaggactttacattctggtggaagaaacaagacaataagcaataaaaataaagatgtagccgggcacggtggctcatgcctgtaatcccagcactttgggaggccaaggcgggtggatcacctgaggtcaggagttcaagaccagcctggccaacatggtgaaaccccatctccactaaaaatacaaaaattagctgggtgtggtggtgggtgcctgtaatctcagctacttgggaggctgaggcagcaggatcacttgaacccgggaggtggcggttgcagtaaactgagattacgccattgtactgcagcctaggcgacaagagcgaaactcagtctcaaaaaaaaaataaaggtgtagtttgtgatgaagacaagtactctaggggaaaacagagcagagtaaggacaaagtagagccgagactgagggtcaaggtaggcctctcactgagactcgaaagcgggacggtgagctacagatatttggagaaacatatcccaggcagaaggaacagtcagtgcagaggccttagtgatcatcacaagggcagtttccctggagcaacaacggatggatttaagaggaaaggagaactggagatctgggtacagaaaactcttgttgagaagtttttctgcaaaggaagcagagaaatcagcaatagctggcagagtaagtgggatccaaatacgggagtttgtatctgttttaagattggagaaaagcggcatgtttgtatgctgctgggaaagatccagcagagaatgaaacatcaacattatgagagacaggaaattactatgtgagagggcacgggtggcgcctcagagagttccctgaacagctggtctatacacaagcagtggggaaagcacaggatgccctggaaggtggcaagatgtggtaggagtctgcagaagggctcttaagactgttctgattttctcatgcaagtaggaagcccaccatgaggccaaggaggaagtataaaaggacaatgtatgaaacaggcatctaagaaactgcataagtgaatggacttgcccaggagccttaaagctccatttgacgtttattaaccaattgggaattaacactgagaaactcaccaaatctgagacataaaggctgactctgactttctactataaataaaaaattctctaacaaactgctgaaaatggtcagtgtctaacatatttgaatatacaatacttggggagagtcgtaatttctccaaataatgtgttgaaagagattacatcccattttcacaccatattcataattgcttcgtcatacataacttgaagggagtcatcagtcattgaaggatttaataaccttaagctgaagttaactcccttatgtcagaccacagtaaacaaaagcagggttttaatgccttaagccaattatatattgcaaagtaaaacatcttatattcttattcacagaagtacaaatttagttttagtttagttatattcttattcacagaagtacaaatttacacaaaaagattatctaacagcattcaattaatcaccaagaactgccatataaaaatctatttctaataatatggtcctggttgcacaactctatgaacacagatggtccccaacttaagagggtctaacatacgattttttcaaattaacaacagtccaaaagtgatacgcattcagtggaaaacatactctaggtaaccacacaactattccatttttcactttcagttcagggcacagcgactaacgcctataatctcaacactttggaaggccaagtcaggaggatcgcttgaaccaacgagtttgagaggagcctggagaacatgagacccctatctctacaaaaaatttaaggccaggcatggtggctcatgcctgtaatcccaacactttgggaggcaaaggcggatgacctgaactcaggagtcgaagaccagcctgggtaacatggtgaaaccccgtctctactaaaaatacaaaaatcagctgggcgcagcacctgctattgtaatcctagctacttgggaggctgaggcagaagaatcccttgaacccaggaggtggaggttgcagtgagccaaaattgtaccactgcactccagcctgggcaaaagagtaagactccatctcaaaaaaaaaaaaattaaaattaaaattaaaaaattagccaggcatagtggcacacacctgtagcctcccagctactccagaagctaaggtgggaggataacttgagcatgggagctatgatcgtgccactgggcaaaacatctatctgtctgtccatttgtccatccattcatccactcatacatatataccatgagatatccaacactttcttatataataggatttatgttagatgattttgcccaactgtaggctaatgcaagtgttctgagcatgtgtaacatcggctaagctaagctatggattttggtagattaggtgaattaaattcattttcgacatgtattttcaacttaggatgggtttcctgggacacaactccatcttaagtcaaggaacagctatatactggaaaccattgatttgtatactttttaaatgagtgagctatctcgtataggaattttctctcaataaagcttttttaaaaatctattccaagcttttaatctaaagaaatagttttatcaagtaaaaatttgattttttttttagtttctttgttgaaatttcaatggaaaatggagcaaattaagtatgttctgacagcttatgaatataaactttgtagagactcagaattctttcagaatgaagggcagaattaaggatggagtttttggcctttggtttggttgtttttcttctttagttgactaaagtttatagtttctggcattcctgctttatccctttgatgaagacatactcaaatcactttgactaaaataaacagcaattttctggttgtagatagccacaaataactcctctatcctattacagacattcatcagcaagactgagtaacaaaccaatacctgtataaaaatgaaaggatacaatatcacaagtactaattcaggtaatatcacatttcttagagttatgacacttcaaagaaattttatacttcaaatctaaacagcaggccaaggaattcatattttttccctgagacaggaaagataattcaataatttccccactgaagtttcagttcccatgccagaatgtgagaagtgagagagttcttcaccttgaaaatcaaatcaccacagggactaaaaataaaggttatattcttctaagcaaagcgattataagactgacaaattaaggtgcccatcgaaggagcaatggatacaggaaaaaaaaaaaaaaaactactaacaggcttagttagccacttccaaaatgtaaactgtaaatgtgggaaactcaatgaactgccctacacttgcatctcattttgtgtaacctgagaggctaacatctgttctgcctccttcagaaggcagctgtaaggatggaactagaggccagtaaaggctgttcagtaggtctaaagtcttctgccaagagaagtataatcctcatttcgttctcaaaaagctcagtctctgtagtaacatactgatcatcttctgcaggtataaaatttatgctctgtattagtccgccataacagaataccacagactgggtggcttaaacagcaaaaatttatcgcttgcagtttcggagtctcagaagtccaagatcaaggtgccagcagattcactttctcaatgagggctctcttcctagcttgcaaatggccaccttctggggctgtgtccttacatgtcagagtgagcactggtcatctctggtctctcttcctcttcttataaggacactaatcacatcatgaggagccccaccctcaggatctcatctaaacctaactgccttccaaaggctccacctccaaatactatagcacttggggaacggaaagctaaggcttgaacataggaattttgaggcaatacaattcagtccacggcactcgcctacacaatttctttactgattgtctctaggcagaaattaaatctttgtatcgagagagaaagatagtttgaaaggatggctttaaagggggctgaaggtagcttactgagatttagacaatgtaaaataaaatttaagaacagatgagggtatttggtggagaataatagctaagaagtattaagtatttacctttgtggatagtttccttaggtcacacacctagtttcacgggtcacacaggctacaaagcctttacttttaattatacaatatttgcttctcttttccttggaacaaaggaaaaaatagaagaggaggagaatctaaaagatgaaaccatgaatgagctgctacataaaagtatgtattcatgttcattttgtaccttttgttagatgtggccaaaattttagtttattttttatttttatttatttatttatttatttttgagacggtgtctcgctctgtcaccaggctggaatgcagtggtgcaatctcggcttattgcaacctctgcctcccaggttcaagcagttctcctgcctcagcctcctgagtagctgggactataggcgcgcaccaccacgcccagctaatctttgtatttttagtacagacggggttttaccatgttggccaggatggtctcgatctcttgaccttgtgatctgcccgcctccacctcccaaagtgctgggattacaggcatgagccaccgtgcccggccggccaaaattttacaagcaaatggctcaaaggaaacttgatgagttacaggattctaaatctgtaagttagaaaacaaaccacatgctcagaaggtctggttttttttggtactaagagctaagaaaagtttatctctatgtcctcataaagaaagcagtttaatacggtcaacagcagccttgggaacccctttataaaccattcagtacacacaaacactgttccacaagtgttcgcacaagtcaatggcctcaaatcaatataagtaaagcaaacctgccaaaaataagaaatgcaaagccttcctagtcattcaaacatagatctagggctcaccagaataggagttcttaatgagagggttcatggataggcttcaaaggctacataaaccatctgcaatttatgtactcaaacagtcacaaattatgttctgggagaaagatcatatattacaccaatactcaaagaagtccctgataaaaataaagttaaggacctgtaacaagaattaatgaactacataaccatcaggagagcctatccaaatcatcttaacaaccaaggcactgggtacttatatgccacaattaggctgatgttaaattccaacaagtagctagtactggataaatgcagagtcaaacgctctaacttagcttaccctggaagtagttctaacctcctctaagaagtgcacagtacctgttgcatagtaagcccctgaatatgcactgctgcaattattactggatatattacaagctccaaggacaggaccaaatcttctgcatttctgagttccttgatcattaaaataaatggtcctcaataaagaaagaaaataatacaaacatttaactctacatagatctagcaaataaggaccttagcagaatgggtttatttctaaaaactgaaaagcatccctttgttttataaaatgaaatgttttggaaaacgaagaacacagggaaactgaggggaaataacacttacatggaaccactaacaaattcatactacggtcatccctcggtatccaaggggaactggttccagaacctccacagataccaatatccagacactcgtatataaaacggtatagtatctgcatataacctactcacattctcccatatactttttttttttctttttttttgagatggagtctcactgtgtcacccaggctggagtgcagtggtgtgatctcagctcactgcaacttctgcctcccatttcaagcgattcttccgccccagactcccgagtagctgcgactagaggcgcctaccaccacatctggctaatatttttgtatttttagtagagacagggtttcactataatggccaggctggtctctaactcctgatctcaagtgatctgcccgtctaggcctcccaaagtgctgggattacaggcatgagccaccgtattcggcccggtatactttaaaaagaatctctagattacgtataatacctaatataatataaacgctatattttttaatttgtgcttttttctaaacatttttgccccacagttgattaaatccgtggacacagaagccaagaatacaaagggcttagtgtagcatattttacatgaaccctaacctatcactctaccagaattatgcccatttaaaaatctaattagattgtattattcctttttacatctaaagtttatgctttccgcttacaagacagagtatgaggcacatgtaatgcataagatttatggtcctcgtttctcctgctccatgacaaatagtagagaaaaataaaaactgtaacagagctggcatcggaaatgagcagttatatgaaaaaaaaaatttaataactaagaagggctaaaatccactacactgacaacaccaaatggtagcaagtatgtggagcaacagaaactctcattcattgcttgtgggaatgcaaaatgctagagacacctcgcaagacagcatggccgtttcttacaaaactaaacatactcttaccatgggacacagaaatcacacaccttcatatttactcaaaggagctgaaaacttatctcaccacaaaaaactgcacacagatgcttaaagcagctttattcatcattgccaaaacctggaagcaatccagatgtccttcggtaggtaagcagataaataaacttcagcacagctacatgatggaatattatcagtgataaaaagtagtgagctatcatgctcacagagacatggagaaaccttaagtacattttgctaagagaaataaaccaatctgaaaagactacatactgtatgagtccagttatatgacatctggaaagcaaacctatggagatattaaaaaagatcagtggtggccaggggcttgggggcagagagggagggatgaatagggagaacatagggcatgtttagagcagtaaagactcttctatatgatattgtaatggtagatgcatgttatgaaacatttcaaaacccatggaatgtataacaccaagagtgaaccttaacatacactatagactttagttataaataatgtatcaatattggctcatcaacaataacaatgtaccaaactaattcaagatgttaataggggaaactgggagttaggggggatgcgggaactctgtactttctactcaatttatctgcaaacccaaaaccattctaaaaactagtctactgatttaatgttttaaaattttttaatgttttaatctaccatataaaataaaatgctacttatctaaatgcttaaatgttaggcctgttagcaaaactgaacaacaccaattttctttcccaaaaaaaaaaaaaaaaaaggccagattgctttaatccttacattttccgcacttttagttctccttttccattcaaagagccaggaagtgctagccagagcaatcaggcaacagaaagaaataaaaggcatccaaacaggaaaagaagaagtcaagctactgctctttgctggcaatatgattctatacctagaaaaccctgaagacgccatcaaaagactcctggtacaataaacaacttcagtaaaagtttcaggatacaaagtcaatgtacaaaactcagcagtatgtctatacaccaataatgttgaagctgagagccaatccagaatgcaatcctatttataatagccataaagaaagaaaataactaggaatacacctaaccaaggagggggaaaatctctgcaaagagaactaaaacacactgctagaagaaatgacaggtgggctgggcggggtggctcacgcttgtaatccaagcactttgggaggttgaggcgggcagatcacaaggtcaggaattcaagaccagcctgatcaatatggtgaaaccccatctctactaaaaatacaaaaattagccgggcgtggtggcacatgcctgtagttccagctactcgggagactgaggcaggagaatcatttaaacccgggaggcagaggttgaaatgagccaagatcatacctctgcattcacggctgggtgacaaagcgagactctatctcaaaaaaaaaagaaatgacagatgacacaaatggaaaaacatttgatgctcatagattggaagaatcattaaaatgaccacactttcctaagcaatctacagatttaatgctattcctatcaaactactaatgtcatttttcacagaattaaacaaagtaattctaaaattcatatgaaaccaaaaaaagtacccaaagagccaaagaaatcctaaggggggggggggaatgctggcagcatcacattatccaacttcaagctatactataaggctacggtaatcaaaacaggagggtacaggtacaaaaacagacacatagaccaatgaaacagaatagagaacctacaaataaagtcataaacctacagccatctgatctttgacaatgctgacaaaaacaagcaatgggtaaaggactgcctattcaaaaaatggtgctgggatagctagctagccatatgcagaactggaccgctaccttttcccatatataaacatcaactcaaggtggattaaatatttaaatgcaagaccacaaactgtaaaaatcccagaagaaaacctaaaaaacaccattccgacccttggctttaggaaataatttatgactaagtcctcaaaagcaactgcaacaaaaacaaaaattgacaactgggacctaattaaactaaagagcttctgcacagcaaaagaaactatcaacaaagggccaggcatggtagctcatgcctataatcccagcattttgggaggcccaggggggcggatcacctgaggtcagcagtttgagatctgcctgaacaacatggtgaagctccatttctactaaaaaaaaaaaaaaaaaaaaaaaaaaagccaggcatggtagtgagcgcctgtaatcccagctacttgggaggctgaggcagagaatcacttgaacctgggaggtggaggttgcagcgagctgagatcacgccactgcactccagtctgggtaacagggtgagactccaactcaaaaaaacaaaactgtcaacaaagtaaacagacaacctacaaaatagcagaaaatatttaaatatcatgcatctgacaaaggtctaatacccagaatctataaggaactttaacaatacaacaagcagaaaacaaataaccccattacaaactaagcaaaaggcattaacagacattcctcaaaagaagacatacaagtggccaacaaatatgataaaatgtttaacatcattcatcatcagagagatgcaaatcaaaaccacaatgaaatatcgtctcacgccagtcagaatggctattattaaaaagccaaaaaacaacagacactggtgaggctgtggataaaagggaacagttatacactgttggtgggaacataaattggttcagccactgtggaaagcagtttggagatttcccattaccaggtatacatgcaaaagaaattaaatcgttctaccaaaaatacacatgcactcgtatgttcatcacagcgctatacacaataccaaagacatggaatcaacctaggaacccaccaatgatggactgataaagaaaatgtggtacaggctgggtacggtagctcgcgtctgtaatcccagcactatgggaggcagaggtgagcagatcacccgagctcaagagttgggagactagccagggcaacatggtaaaaccccatctctactaaaaagataaaaattagccaggtgtggtggcacacatctgtagtcccagctactcaggaggctgaggcaaaagaatcgcttgcacccgcaaggtggaggttgcaatgagctgagattgtgccactgaactcctgcctaggcaacagagtgagacactctcacaaataaacgaacaaggctgggcgcggtggttcacgcctgtaatcccagcactttgggaggctgaggcgagtggattacctgaggtcaggagttcgagaccagcctggccaacacggtgaaaccccatctctactaaaaatacaaaaattagcagggcatggtggcaggcgcctgtagtcccagctactcaggaggctgaggcaggagtatagcttgaacccaggaggcagagattatagagagctgagattgcgccactgcactccagcctcggcaacagagcaagactccatctcaaaaataaaaaataaaataaaaacagttgaaattatcaaaaaaaaaaagtaaataaaatgtaatggaggtactagtgaaaaaaataataagatccaaactcaaattgctcctgcacccaacacacttaagagtaaatactgttaagagtcctttccatgaacatctaacatattgagaaaggtgaatatttcattactgaacatttactctaacctatgttaagaattatgatctgtggaaagagcacaggctaaggaagctgcctaggtaaatagccaaaaaacatacacataagatgaaaacttgtctgcgtcattttcctaccactcaaaaaagaaggtaacagtaagaaataaacagcaaaaacaaaaagaaaaaattgttcaaatgttcaatctagatataggtttttctgtataatttaatcaattaataaataaatacacatgtatctttcttcccccaaccacaccccccccacacaacttttttttttttttgagacggagtctcactctgtcccccaggctggagtgcagtggcgtgatctcagctcactgcaagctccgcctcccaggttcacgtcattctcctgcctccgcctaccgagtagctgggactacaggcacccgccaacacacccggctaattttttgtatttttacaaaatgtttttcaccatgttagccaggacggtctcgatctcctgacctcgtgatccgccgcctcggcctcccaaagtgctgggattacaggcgcgagccaccacacccaacctaccacacacaactttctaaagttcctggataatgttctaaactctttttctatgttttacatgtaacttatgcaagccattcactttactaagcaaatgaacagtagtgtctgtggccaaaaataataagacttaaaattttgagtccttccaaaagaacttgtattaaatctttggaatagaaaaaaaaagttcatattagggagtagatctgggtattgaaaggcctgtctttttttgttggtaatgccaaagaatgtcatcacacaagactcaccttataatattatttatgtataagttatcaattacatatatttaacattttaagtgaaagcaagtttattaagaaagcaaaggaataaagaacggctattccttaggcagagtagcctatatttaacattttttaaatgtttaaaattataaagctggtgagtaaaacaaaaacatctttgagtgatacagatcggcagaatttccccagcctcattcctgagagaccaccacataaaaataacttggttatctgcttctgtatgtaaactcaggttgtttgtgcaaaacataaactgccccaactaagaaatcctgaagaacatgcaaaaggaggtactttcactgtcattttattaaaaggcacacaagtcactactgctgaatataccactgtttctacccagctattttaaaattattggtagataatgtggtgagctactggtaaatacagctgtgaacacagcagcacacaccatctggaggcttttgacttaagcgatttttcaaatgcacagtatatttacactcttttgttcctttgaagcccaccagtcacatataaatggaccctttcttaaaactacaactacaaaagctcattcatcttgtggaaaacaagatatgagaaacaaatctaattgttcagctttagaacaagtgattatttcaaatcattaacagcataaatactttactttttctatttttattttttttaatagatagagacagggtctcgctatgttgccaaggctagtcttgaacttctggactccagagatcgagatcttcccaatagggcctctcaaaatgctaggattacagacgtgagccactgcacctggccccaacactttacttttataatgatctcccatacttacccattatattcttattatcttaacaagaagcttctgattaatactctaaaattaaatgttttcttcttttttgtttttcaatgagacagggtcttgccctgtcactctggctggagtgcagtggtgcaatcatggctcactaacctgctcagaaattatgtttgtaagtttcacgaatcatcatgctcatttttatttgttttgtcctcctccactggaaaataaatgctatgagaacagagacttcatcttttttgtatcttcagcaactaaaacagtacctagtacataattagtgctcactatgttaactattcactgttttcccatgctaagcatggtcctaaagcatttcgtaaaccctctaggtagactcattattttctggtatgagaaaacagtcacagaggttaaataacttaccccaggtatcacagtgagtaagtggtaaactaagaatagaactcaaactcagacagcctaactatttaccactacgctgtactgaataaattaatgaattacaccagagttcaatgataacattaaaaattgagtaaaattatgctaattttcctattgactaagcatcaacattattctgttttattacaaatatttaagtatgtcaactatttcatggattaattagattttagagggaaagtctaagaccccaatcatcattaatatgtggaattggataacaacctggaaaaagacttacaaatgaacttgtgatataacctgtttgaattggatgtaggatacctacttccctccattattccttggattcagcagtctgttgccaatctgaatgttttaacttcttttaattagagaaaacattttctatataagttacaatgaaattatcacgttttctagaaaatactgcactctactgcttcattccaggttgtctgaagatggaccaatttctccaatgaattaaaaagtatcttagtctaagacaagctctctttctacccagccacccccacgagatcccactccgccccaacaaccctcagcccccatcttctatcagcaaactgggcctctgacacaaaggtaccacatttataatatcagctttagtcataaacagatttcaatcaagtttgtttctacgacttttgctcctttttaaaaatgcaatggatagcccaggcgcagtggctcatgcctgtaataccagcactttgggaggccgaggcgagtggatcacaaggtcaggagttcgagaccaacctcgccaacatagtgaaaccccatctctactaaaaatacaaaaattagccaggcgtggtggcacacgcttgtagtcccagctactcaggaggctgaggctggagaatcacttgaacccgggagacggaggctgcagtgagccgagaccatgccattgcactccagcctgggtgacagagtgagactccaactcaaaaaaaataaaaataaaaataaatgcagtagataataacagctctggacagtagtatctactcaacaggaaagcagacagtaaagagaccagaccactgagaacccatgtcagtcacattacaatctatgttacagcctgaaaagcctgaaaagactcaaatctactcataaatactttctaataacttgaaacaataacactataaaatatcaagttggccacacatgcccctgagcagacacgtctaaaagcttctatgtgccacccagcccatggccaaactgctgttggtcaatgggttgctcaagtccttttgtacaatgtaacgagaggtaagagacaagggggaaacattctagccaccttatctccaatgatgccaacatttatttctgcttgagttttacaaactaatcctagactagttaacaaagaacccatttttcattgttgatttttacacaaaatattggcttcctatgtcattataaaatggatggctccatcggcttctcagcctacacaatagcaagcaaaaccctttggccttggaaaagcatggtaaatataatacctactaataagttacatggtttaccaatttcctcaaaatcaaaaataaatctctcacaagtcaactattaaataagtaaacaaaagcttgtcttgttctatcacttgcttaaaagcaagcacggtggcatgggagagggattaagaaacacaaccagtcaagtccataaaaccttcagtgtaagataaaactaccctgtaggagcagccaatgcattctgacctaacagctgtacacagttgcactagttaaaatgaaaagctagtctgcatcacacacaggcaattcactgagccttactgatacgttgatggggtttaccatcacagtcttccctcccctaacctacaatgtaaaaaatgaattgccatatagctgaaggcaccgggatgggggtgaggggaatacacacacacacacacacacacacacacacacacacgcacacactccctccctccctctctcaggcatttcaaaaataatcacaaccatgtagattgtaacatatcctatacgctataaaaacacacacacaaaggaagtggtacagctacattacgtcagctcttgcctcaattcataaatgcaaaaaccacaaaacaagacaaaaatctaaacggcctttttctggaaatcttagagtgaatgaatgtgggttaagtctttaaatatgttattgaacacttctcgcagatgcattgctttcatcagccacggggagggaaaaagtgtaatcttggtcaattctatcatgcaaccagatcaaataacatttcaagtgcagcctgccaagcgccagcgcctgccggagtacaatgagcgctcaactgctctggactgaaaaaccatctttcactggtcccagggatctttataaaatagtttaaacactactaaattacagagttagaaaaaaaaaatacaagctcaactctgctgcccccacactattgtgaagctgctgttaagcatctaaaaatctgccttgtgtaatttactaggcaatgtaaatattcagaaaggcaactgcctctcagagcccaagtctaacacatgcataaaaatgtagagttggttgtgcttctggaaataattgcccacagatcaacgtgcttacatgggatattgttcccatctgtaaggtttcaaatcatgtctactttaaatttggagtttccagaaagaggaaaaaaaaaaaaaagccagaactcaaaacagtaattttggcacagaattgtgaggactttgttaaatctgttctcaacttttactcagtgtctcaatcttaaaacacagaggcacaaagggaaaatggaatttctctgtagacacccgtgttcattcacagaccattttttagattttccgtgtggctgagaggcctccagccaaacaatgcccacagagcgcggggcacatgtgcgccagggacgcttaagggctgcaagtaaaacaaagtaacctattacaggagtttccttctcagcaaacaaaaagtggtcaagcaggtctccctacagtttcagaaaacaagagttgagtaaacaagagaggagaaacaaggaagacagcatcccacactaaaaaattcttttaacaatttaaacgtaaaacaatcgtcaagagtacctccgcattttagctactctggcaaaataacagtagttcggtccaagaagaaaatttcatttgtcacttaagtagcctcaaatcaagtccatcaaattcattttatttttaaacttgtttattccacagtaaagcaatgaagtttctgatcaaagagcgacttctgcattatactcggcttcaaaagcactttcctttcagaagaaaaaaataaaaatatatacatatacatgtatttttaaatagtgttttctctcccccctcaaaaaaatgttttctgttcgatttaattaactgagatttcaagagtttggggctacttaaaaactagtgagcccaacagaaatgcaatgggacacggcaaatactgactccccgttcctggaaagccatcatcattcttaggaacacccgagttccatctttctagggtcggctggaacactccgtgcacccaccccgagccccccgcccgcacttgtccaactttctggcccgagattcgcgtccccctcgacgcacgaggccgccggccacttgcctgcggcccgctggcggcgagagctgagcccgcgggcctggtcctcctcctccggcgcagggccccgccaactccggacccgcggaaaggggcggcgcaggcgggcaggtgggggcccggggagtgaagtgcacttgctaaaacaaaaggaggcctgagcggccgcagggcaccgcggcgcgggcgcaggtcccggcggcttggcggctccgggaggcggtggccgcgcggggccccgcccgcggctagggaggcggccgccctggcccgagcctgctgcccacggccgcggcactcagctcgcactccttcagcccgggaggccgggccagcactgccacatgccggtgacccagacgccgggagagaaagagcagactccccgcgacggcggcggccggcaaaacccgggctggagcccagcccgctccgcgcgcacccctgctggccgccgccgcgggcgcgcgcacacacaatgccagctgcaattttatctccttcgttgcttggccagcctccacccgctccaatcctccctcccctccgacagccggaactgggagcctgcgtgattgatggcagctcttaatagcgtggtcagctagaaaatgcatctgcaagcaagatattaaagaggcagcgcatccctgtgagtgatcagcatttcacacatcctagagctgcctctgcttctgccaggaatattaatgccaaccacctctgacgtctaataaatgcagatgaaacaaccaacaatcacagacaagctaaacatttatttcaaagatgcaccgggagaaagcagcattgtttcgtgtcaaagaacacttctgaccccagttttccttacacattaagaattctctgcaagccatttgtttaaaaatctcaccaatcccttttccacaagtaaataaagatccatctgttagacaagacatagcttaaattgtgcatgattgaaattcatctaataaggaagcaaaataagtgcacattccttaccatgtggctttaaataaacatataacctaccagctaccagattccaaactccctcattaattcaatttttatgtgaatcttaacagattaccaactgttaatttcaaactaatttcttacccacccacaattaattctggtaaaaaatatatatatcaacttgctaaattttattaaaattaaagtacatttaaagcatgtattctctagtggtgatagccaagatcattttgtcctcccaaagacattgtataggaattttttaaatgtattcctataaaatacaaattctaactattaagttcactcagtgtcaacccaaattagaaaggtacaagctgaaaatttaaatgattacttctggtatcttcactattacacctttccccttccaggcaagtttcatggaactctcaaatagcttcataaatgttaattagactttccaaggccctataaagtggctgcattatcaggtactctctttccaataaacagagaaatttagacagattaaagtgatttgcctatagtctctcaacaagatgggggtggggccaggctgaatagaacccaggggtcctgctttgttgccacagacagccaaacagacatgcacatgcatgtttgctatttaaagataactctgctggtctctctttaaagacaaatcaagttattctacaggacatagaaatatctgtctcaaactcctaacacagcacatgtactgagagcaagagctgatgaggcataatgtctttgcccccctgaaaggtggctgtgatcaatacaaatcagagatggtctgtagtgcaaatctagctctgctataagctccactaaacaccattcctcagtgaaaccatcctgagggggacctgtgacttgaaaatctgcttcatatccaagtggctatgagattactccatatatgtcagagatgaaattgatcctaaagccttgctacaaagctactcctgtacttggacacacttccaattttctaaccagctatatccagacacatggcacaggctgaaaagaatttcttttttcttttctacagaccattttaaaagtgccagtttatagtgagttggaaaaggctggtgagaagaagcaaaccgctctattctgaattcatactgtacctagtctctcagggattctaaatgctttgacagcattttatgccactcaaattcttttgtgctcatcttgcacctgctgctaatccaacctgcacccagccccccactttgcagttacaccagtttttccacttcccccaggtatagggatttctaccacaggccagcaggcttcttcccaccagagcaggaataatctccttgcagccccaaacagccactcacagaccgtttaaagcctccttcagatctcaggtcaaacatcactttttcagagaagcttcccctgagatcccattctaggtcaagttcctttgttataagttctcatagaactgtgttcctccttcacagcattgatctccgtttgtaagtcatgggtgtgattttttttaacactcatagccccttctaaacagttccatagagttctatagagaaggttctatatgtttgctcatcatgtagatttatgtcaggtacacaaatctgttgaatgaataaatgaactgaggtcaacaacactgctttactcactccatatattctctgcacatttcttggcacaaagaagcctatctcaaataagtaacatctatgcaaataagaatatcttctattggccggatgcggtggctcacgcctataatcccagcactttgggaggccgaggtgggcagatcatgaggtcaggagatcgagaccatcctggctaacatggtgaaaccctgtctttactaaaaatacaaaaaattagccgggcgtggtggcggccacctgtagtcccagctactagggaggctaaggcaggagaatggtgtgaacccaggaggtggagcttgccgtgagctgatattgccatgcactccaggctgggtgacagagcaagactccgtctccaaaaaaaaaaaaaaaaaaaaaaaaagaatgtcttctattaacctttaaaagcctagtaagccaagagtggtggttcacgcctgtagtcccagccgctcaggaggctgagacaggaggatcctttgagcctaggagtttgagtccagcaacataacaagactcagtctctaaaaaaaaatttagaaaaataaaaagtctagtaaaaaggaggatttttatccccattttatgaagatataaaataattgtgcctggggttactcaaaaacacagagatcctaactagtgtcctatttccaagctacactttttaagagttaatgaagtatagaagccatcgctagtttattcaagccaagttcttcctattacccagcccttaagggatatgcaaacagccacaggtaaactggacagaggactaaatcttgtatacacacagagcaatataaacagaatataaaacttagaaagtactttgtacactagtttgtcttcaaagcttctcagaatgcaaaagcactaccaaattctgctgtgaatgaggggagttcattcttacctcccttttacactgaacttactttattttcaggtttttttctctaagtaacagacctgacatggaagccttcgaaagagctctttccacctaggaactcaatggtgggtgtactcctcaaagtgaaacatttgttttaaccctcattagtatgagtttgtaaattactttgtgaagaggaaaaatcaaagttattacaacaaaaactataatttttcaggtgttttgcacatgaccacatgaaaaagtaataggaagaataattatgtaagataaatgaaaaatattagatataccacatccctcccaaattaatactcattatgactgtcagcattccacaagggattccttggttcccatgttatctccctggcctggtctgcaccattgcttctttttgtcctaagctccattccacacaaattccagctctccgtttccataacacccgtcatttatcaaaacaaccctgtcaagttgagtaccattaacagataatgagaggagacaacagatgtggctggaagcaaagcactctatattctacaggcctcagcatgcagccaagtgagctgacatctgactttatcctaacagttataattaaatcgaaagtctagttaaactaacattaaagctatgaccagaaacatcacacaggggaaatgtgaaggggaaccttagcaatagctgaacaggacccacattattccagacccttaacctggagcaaccaccctgcatggactctctccaccactccgctctgtcacagcaaaggaagaatcataaccatatcttctgaagatggcaactttgggccactttccaagaccaccgaggcagcaaggaaactgcatttttacatgaaagtttaaacagtagcactcatttaataacactaataagtgtcaaaattctaactatcaagttacctgagacaatcaacattctttcctatagcattatccagtacaaccattcagaccaagtaatttagctcacccatgtcaaaatgtcaaaagtacaccccaacgtcatccagcaaacagtgactgaatccaggattgtattagtaccagttagctatgtccgcataggatgctagggtggagaggatttgatttgtaacacagtactccacttttatccacagtttcgctttccaaggcttcagttaccctgagtcaactacagttcaaaaataggtgactaaggtacagtaagatactttgagaggccacattcatataattttcattacaatgtattgttataattgttcttattattgataatttaatttcccttataaatcaaattttatcataggtaggtatgtgtaggaaaatagtaaaaacagggttcagtattatccagtttcaggaacccacgggggccttggaacacattcccaagggtaagaggaaactactgtcctatacagaatacggagggatatggtttggctctttgtccgcatccaaatctcatcttgtagctcccataattcccacatgttgtgggaaggacccggttggagataactgaatcatgggggcaggtctttcccatgctgttttcgtcatagtggataagtctcacaacatctgatggttgcttttttgtttttgtttttgtttttgttttgaggcggagtctcactctgacccccaggctggagtgcagtggcatgatctcagctcaccgcaacctctgctcaccacaacctccacctcccaggttcaagcaatgctcctgtctcagcctcccaagtagctggggactacaggtgtgtgccaccacacccagttaattttctatttttagtagagatagggtttcaccatgttggccagctggtctggaactcctgacctcactgaatccacccacctcagtctccgaaagtgctggaattacaggcatgaaccactgaacccggccaatctgacggttttaaaaatgggagtctccctgcacaacctctccatctctttgcctgctgtcatccatagaagatgtgacttgctcttctttgccttccgcctccccagccacgtggaactgtgagtccactaaacctcttttcttcccagtctctggtatgtctttatcagcagcatgaaaatatactaatacatggagttacaattttaagcaaactatctacttcttttgcttttccaactcaccaaaatgtcactagacaacaaaaactctggagtttttttttttttttttttttttttgagacagagtctcactctgtcgcccaggttggagtgcagtggtgcaatctcggctcactgcaagctccatctcctgggttcacgccattcttctgcctcagcctcccgagtagctggaactacaggtgcccgccaccacacccagctaatttattttttttgtatttttttagtagagacggcgtttcaccgtgttagccaggatggtctcgatctcctgacctcatgatctgcccgccttggcttcccaaagtgctgggattacaggcgtgagccaccgtgcccggcaactctagagtttttaaaagaaaaaagaaaaatataaaattcttgaagctcttttagattttttaatttttttttttcttatattgagacagggtctcagtatgttgcccacgttggtcatgaactcctgagctcaagcaatccacccacctcggcctcccaaagtgctaagattacgggtgagccacggcacccagctcccttgtagattttttttagagtatatggtcctacggaaaatccaagcaattccacttaacaggctgaaggtttaccaggctcttctctagaacataggtacaaaagcatgcacatatacataaaaacatatgtattcatttgtctgagggttcacttgttgattttttgtcacaaagatgaaatcccactatttatgttatacagcaagtcacttctctcactttacagaagaccattaacatcccattcttgtttattactgcaaagaactgaacagtgtgggagtcccataattattatataacaagccccttattgagtctttttcacattttttactcttataaacagtgctacaacaaacttctttgtgcatacatgtatttctacactgaaggaatccctagttcaatgaatatacactctttcagagagagtcaaacagccatccaaaagctgtacaacttatactcttaccagcagtgggtcctggtcctgttcccatactcttattctggtttttgttggtttggttttggattaggcactctcttggatctcctacctttctggcgattctctctttctttccatgactcctcctaaatacaagtagtccctgtcaagcctccttttatcacattcggccatctcacatcagtgaaaagatccactctcaagctgtttctgtgtttgtgattccaaaatttgatttttccagctgagcttgcttcttagcaagaggcccacatatgcaaatgccctatgggttccaccataatggcattccacagacactctcaatcccaaaccaaatcaaaatgttcttccccctaagtcctggggggactgttgcaatctacgtaatatactcttgaatatactgttgcagtctacgtaatatactcttgaaaaataactagaaataacatcagattataaaaagaaaacaaaaagcccaagacagactggcctttagtaaaactctgaatagcacactttaaagtgaaataacataggtacaacattaaggttgggcattagttacaaccttccttcatgttttactttccaacatagtcccaaacatagatatttgtttgtttgtttgttttttgagacggagtctcgctgtgtcacccaggctgatgtgcagtagcatgatctcggctcattgcaagctccgcctcccaggttgatgccattctcctgcctcagcctccctagtagctgggactacaggtgcccaccacgcccggctaattttttgtatttttagtagagacggggtttcaccgtgttagccaggacggtctcaatctcctgacctcttgatccgcctgcctcagcctcccaaagtgctgggattacaggcgtgagccaccgtgcctggccatagtcccaaacatatttaagagtgataggccaggcggagtagcttacacctgtaaactactgggattacagtagcaaagtgctgtaatcccagcactttgggaggccaaggcgggtggatcacttaaggccaggagttcaaaaccagcctgaccaacatggcaacaccccatctccattaaaattacaaaaattagctgggcatggtggcgcatgcctataatcccagctactcgggaggctgaggcaggagaatcacttgaacctgggaggcggaggctgctgtgagcccagatcgagccactgcactccagcctgggtgacagagtgtgactctgtctccaaaaaaaaaaaaaaaaaaaaaaaaaaaaaagggagtgataaactgctaataagtatttaaagtattatatcatgaaatacattatcagcattataaaaatatactccagaaaacaaaaaatacaactttccactaggctcccgggggcatcacagcaaactgttatgacattagtcatcaatcgaaggtcaggcctggaggttttagtttttggaagtgtgcagccgtctcatggatgtagccctaaaccaacttcagacagagagcaagacctcttagatagcacatgctttaaatatgtttaaggacattttcatttttatttcaaaactcactagagatctcagactgtgcagatcaaattattaaattccaatagagcgatacgttgaaaagccaaagcagggttaagaagagaaatttctcgtttggaaaagggttttacagatttaaaaacaaacagttttgtggaagaaagagctcagggatgcagggcctcaatgggatgtttaaaatgaggcccctcgtgtattttgaactgatgatatatgataaaatcagtgtggagatccagccaaatgtactggaagtaatcttaaggataactcaaaaccacaactgaaatcaatatcctaagaattcaaaatattaaccagacagataattgtatgacttattaaaataatgtacacaaattcaaaatataattttgccctttattattattaggacatgttttctctagtattatgccgccaataaatgaaaatactttaaaataaaattacacacgtgtatttcagaaaaaaatacatacatttaaatgtttcaaaaaattaaatgagtaccatttgccagtctcagcatcagaggtagcattacagatccaggaactgcctgcctaaaagccaataactgctctctagaaaatgccagaagactccagttaaaaatatacactcaaacattatataatacattggctaaaacaaaaatcaaaagccacagattcgagaatgtttgatctgcacaacacagggtggtttcttgtgttttcttctgaagggattagaagtgagtgagactgtcataaagacaaatgctgaacatacattctggagtttaattttaactaaaagagcaaatacttgggctgcaggaaacaacaactgagtgagtacaaaggaaggcatgggctaacttctaacgtttacatcatctgattaattccaacaataaaatctaaacactgatcatcccctccaatcttcagagcaagctgactctacagtgaagaatacgagagccctatcagctgactctggtatgtttaaacgattataatgtaaagcatgttcattctcttaagtgaaaggaaatgactgccaaatgcttccttcacaatctctccagaatagggcaggtcctttaatgtgagattttcctgacattccaattgtagcagacattgaacaaacagagacgcattaaaagccgacctggttctattatcttttattgaaggcctagcaaagatcagacatgagccctgtgctatttacattttttggtgcattaatcacttttatactcaagggctttagaaaaattcaatggatttttttttttaatgaaaaacaaaataaaaaaaaaacacaggatgtaaccacagctatattggtctttttctcaggaaggtcagaaaagctttaaaaacaggaagtctgtgctataaggttgagaaatgtttgttttaacagcctaaggcgtcatggttgcagtttgcagtcagctgctatggaggactatagtttattcttcccagccaaggattaatgtccctagggaaaaggccaaaaaggtactcatataactagaaaagcacattatcctaaaataagacttgttataaaatctgaatcataaatcttacaagatacctttcaacattaaataggaactaatttagtaactggaggaggaacagtttgtcttttgtggtaatttataaaggctaaggaaaaaccatagtaaccaatgctaagacaacctcctagaaacaattagcagtgggttaagaattggtgcttgccatttgatacaagttttctattgattacctctattttaatcattatactaatattaattattaaaatcaaatgtaaaaatgacactcttgcttgaatgcaaattcttgcaaaaaaggcagattaactttaaaaatgttttatccctaacaaaatggttggtctctgcttttaagaaaaaaattttttttaattaaaaactttggccaggcacagtggctcacatctataatcctagcactttgggaggctgaggtgggcggatcacctgaggtcaggagttcaagaccagcctcgccaacacggtgaaaccccatctctactaaaaatacaaaaattagctgggcgtgatggcaggcacctgtagtcccagctacttgggaggctgaggcagaagaaccacttgaacccgggaggcagagcctgtagggagccgagattgtaccactgcactccagcctgggcaacaagagcaaaactccatctcaaaaataatgatgatgataataataataatagtaattgcaaacttcaactacagtgctaaacagtcttaacatacctaacattaaaggtattttatttcaaaaattacaattttctgattccattctttatacttagcttacacaggcaatcaaaatgaggctttttcatggtggactccattttaaatggaattaaacgttatattatgaaaactttaagccaaaaatatccaaatattaatattaaaatacacatagcacatgaatttaaaattcatttggcttttaaagggtagtgattggaaaaatcctatcatgataaagtgctttaaaatacaaacataaatggctaataccacaaagtttgccattcaccccaagaagtaattttctatttgatagttatagctatctttaaatttttaaatatttatttctacaatatctctagagaggattgaactactgccatttaacagatgggagtaaaatgaaattctctcaactttatcttttcccttatggttcagaagacatcactctaataactttatctttccaaggggcatcattcaagtaacaactcatcctaaaaggcccatactggctttcagttgagtgtattctgtattatgctctggcgtctttcctgaaaattggaagacaatagagtaacgccttcaaatttttgaggaaaatagtctccaacctacagttctatacccggccaaactgtgagataatcaaggatgagcataaaataaagacattttcagacacacacagcctcaaaacatttacttcccatgtacccttctcaggaaaatacttcacaaacaacagagggaaccccaaccaagaagccatgaaaaatgatctgagagtcatatgaaagggaagtcttcttccaacaactcagtggcagatctagacaccaaaatgaggcaatgggttccaggaggatagcaccaaggctgatctatagattaatattttccattacactgattttccaatagttctgttggaaaatttaagggtgatttagagacggggcatacaaaacaaaacaaagaatcaaaagagagacaattattaattccaggaaagaagttgtacaagaaatgtaattcaatcataccacaatttttttttttaagacggagtctcactctgtcgccaagccggaatgcagtggagcgatcctggctcactgcaacctccgcctcctgggttcaagtgattctcctgcctcagcctcccgaatagctgggactacaggcgtgcgctaccacgcctggctaatttttgtatttttagtagggatggggtttcaccatgttcgccaggatgctctcaatctcttgaccttatgatctgcccgtcctggcctcccaaagtgccgggattacagtcgtgagccaccacgcccagcccacaatatttgttttaagctataacaatatatacatgcctataataatataaacattcggctgggtgcggtggctcacacctgtaatcccagcactttgggaggccgaggcgggcagatcacctgaggtcaggagttcgagaccagcctgaccaacatggtgaaaccccgtctctactaaaaacacaaaattagccaggcgtggtggcaggcgcctgtaatccgtgctactggggaggctgaggcaggagaatcgcttgaacccaggaggcggaggttttggtaagccgagattgcaccattgcattccagcctgggcaacaagagcgaaactccgtcttaataataataataatataaacattcaatactgatttaaccacaaatggtgatattaccacaatgagaaggaagaggaagaggagaaagtagaagatatataaaaggtgacgggctggcaaggaggctcacatctgtaatcctagcactttgggaggccacagcaggcagattgcttgagctcaagagttcaggaccagtctggaaaacatgacaaaaccttgtctctacaaaaaatacaaaaattagccaggtgtagtggtgcgtgcctataatcccagctactcaggagactaaggcaggaggattgttgagcccagaaagtagaagttgcagtgagccatgatcatgccactggattccagcctggatgacagagcaagaccctgtctggggcgggacgggcggggaagagatttaaatggctaaatttaaattactcattgggtaaactcagcaagtgatgtctaaaatagaaaataaaaacaggtcaggcacagtggctcacacctgtggtctcagctacttgggagactgaggcgggaggatcccttcagccatggagggcgaagctgcagtgaacagtgatcaagccactgcactccttcctgggcaacaaagtaaggccccatctcgagggaaaaaaaaaagacaaaaagaaaagataaagaagccaggcatggtggctcatgcctataattctaacactttgagaggccaaggtggcaggatcacttgagctcaggagttcaagtccggcctaggcaacactgcaagatctcatctctacaaaaaaaaaaaaaaaaaaattaaaaaattagccaagtgttagggcacacacctgtggtcccagctatttgagagcctgaaggatcacttgagcctgggaggtcaaggctgcagtgacccaagactgcaccactgcactccagcctgggcaacagagcaagactctgtctcaaaaaataaaaataaaacataaaacataagcatgtcctttagcaatattgagataagtgacaaaataaatggttttaaaagttcaaacagtttgcctctgagaagtgaaactcaaggatgggaggaactactaaaataaacaaacaaaaaaaaataaacagtacaccaccacttgattaagtacgtgcacatatattacctagaaaaaaaaatcatatgaaattaaaaattaacacaaatgttcccagaagatctttgctacctttttttaaaaaaaattcactaacccatgtgctttgatcacctggtgaagaaagtaataaaatttcagaatggaaaaaaagaaaaggaataaaaaaaaacctagccaaagaagcaatcaatctttttaagacgtaggcatcggactgaaatttatttttcttcagagggcaggctgtactacattttgcaacctgctagtaagactcctgaaatttggcccctcgataataataatcttataccaaaaagaaaggaaaaagacacaatcacaattttaaaaaataaatgatataacaactcaatcactataattttagtatgtataaatgagaaatacatcactaactaaagtaacagcttttaaaagaagcagtaggtgaaagtacaaatagatcatccagcttcaaaaaacttaatgaatttttaaaatcatttttagcattttacccatttgtttattcacaattatgttccatagtcagctaatggtttttgaaaaagagagtaagaataagatggataagggaaaggaaaatcaagcatgttctaaattgcaagttaatcattaggtcaacagtggtagttttcagtatttctcaaacacaataacgccttgtcatcgattgagaatactgaattttaatgccattgttttgtcaataaaaagtgcttatgtacacttcacgagttcattaataatcctctaagaagacctaaattaaagcttggcaagcagtttctcatgaaacaaaatttgctttagttctggtttgttagaactaaatgcaccaagtggcaaattaagatgtagaaacataccttaaaggttatgctttgaaagtattcaatgactcaaacagaggcatcattaggcagtagcaaaataaatactaagattcctatttcatttgcaatctgttaagtttcagacagataattttacaatgaccaccaatagctatcaggataaacttcgaaaggagatagacatacattccctaaatttcatcagaggactggaaggtaaccaggatagatcccattttcagcattaaaagtgatcaaaagagtccaataattcacatagaagatgccattgtgctgtctatactgtgtgtatttaatgtccatgggaatgctgacatgtgcactccaagtggtgattgaagagtcaactaagtagggggaaagggcttggagcaaaaatttcaactaaaaataatccagttacaggagaatagtaccaggcaagctggaaaaactataatcaaagtctgtatttccagtttcaatagtaaacacagttgttaagagtggttaacacacaagaccataagtgcatgcaatttcaagtcagaaacatctgttttaccaatagtatccctgttatgtcctccatttctttactaaagcagaatgtgagagtaagaacaagagcaagcacaatgtatgaaagaaagtaagcagtcaatttaccttagaaaacattaggactttcatataagttcctaaaatcataaattctaaagccgttagatttctagaacttgacaagatttctttaaaaaacagggtcagataagaattttgcctttcctcctattagtttttagtccccaccagctgaagcagggtgcccgtttctacaccaaagagcggcaaaatgaagaaaatcaagcaaattacacagcaaaggcagaaatgccttctatttcatgagaaaagagaaatggtgcaagccaatggatcaccaacctcaatgcactgaacagctgaatttttttgtttagttctgagaataaagctgtggtttaatttcatcaatagtgaagtttagtcctacctattttgctgggtgattttaaatggtaggtgactctcttcatctggtactctaagagcaggcagcaacatttcatccttagttctgactgagcttcccagtcttcagcaaatttagcctagtggtaaaggtctctagctctggagtcagatggccagggttctcctaatctaagattttctaactgcataaccttgggaaagtctccatatgcccatctatacaatgtggttaataacagtacccactgcacaaggttatcatggagatgaaatgaaataattcaagcaaggccttggatggagtgcacagcacacaggaaatgctcagtgaatgccagacaccattaaccgtgtcatcttggactctgtcatcgacttattgtaaaaacctgattaaaacaattaaaggagggcctaaatcaccccaacagtgagggtggtaattcattatttgtctgtgaagtacatcaccccactaaaaaaaagaaacaggcagggggcagcaaaatcagcattttgcttttcatccttgttactatcactgctacattatttatgtgaactgggaaggagtgtgtccggacagatgctcagctgggttctgcaagcagagcatccatcacaaaaggtagtgcctgtctcaggagcaagcccctttcctgcctcctctctccccttcatcagtcaccactagggagagcacagtggagccacacagcagctgggcaatgtcaaaacattattgtccaagcactctgttcaatgattttgatgaaataaagtaatccacccctaaatgactcattttgtcccaaattagcatccttaaggtaattattaaatatccaaaaggatccagggtgtattagaaacaaaggagggggtgaggaacattgatatactaccaacaggcaccctactataaatttactaaaacaggaatcatgaaatgattgaaatgacaccaaattatacaacataaacatagaggaacaaatgacagagatttgccctctgcttaattcagcttacatagatgtctatcaaagacaagtttctacagagtcacaagcacactgtattcaaataatcttcatttccattttctctggacaagcgaaagtaagcctaccacaacagttaatgggttaaaaactgtcacattttcaaaacatttacattatttaaatgcttatgtgtctaccaccacccccagagaattaatcacctccttattactgtcacctctctaccctccatataattctactgctgcgtttctcacagacttaaaattattttcatataaattggtctttgctgctatatgaagcaactcagggcatggagcacgtttgattcatttttgtattcccaaatcttcctgaataatttactcactcattaatggaacttacaagccctaatatgtgccagatgctttggggcggctgaggcgggcaaatcatgatttcaagagatcgagaccatcctggccaacatggtgaaaccctgcctctactaaaaatacaaaaaaaaaaaaatttagctgggcatggtggtgcacgcctgtagtgccagctactcaggaggctgaggcaggagaatcgcttgaacccaggaggcagaggttgcaatgagccgagatcgcgccacagcactccagcctggcggcagcaagactccatctcaaaaaaaaaaaaaacagcacaagcacttagaatacatctatgaacaaagtagaaagacactcctgacctcaaggggtttacattctgcagggagaaacaaacaataaccaacagatttttttgtattctataaatttcacacaatattcaaaggcagtaagtgctaagaaaaaaaagtagagcaagaaggattaaacatatgcagagggtaggtaccagctggagagagaagagagacagacagacagagtcagagagagagcaagagagagagagagaacaagaacgagcaagagagagcaagcgagccggcaggactagaacacaactgagggtggagggtgccggcaacggacgagtcgagtccaaggtcagggtaggcctcataggccactgtaggggagttcttataattgtataaccccaagagtagacaagaagcacacatcccaaaatacgttacttgtacatgaaacatccaggctccattaaaattaaaaatctagccgggcacagtggctcacgcctgtaatcccaacactttgggaggctgaagagggcggattacttgaggtcaggagtttgagaccagcctgaccaacacggtgcaaccccgtctctactaaaattacaaaaattagccagacatggtgatgcacacctgcaatcccagttactcaggaggctgaggcaagagaactgcttgaacccaggaggcggaggttgcagtgagccgagatcaccaccacacaccagcctgggtgacagagcgagactctatctcaaaaaaaaaagttgttttagtatttctcaggtacccgataggtcatcttagaaggagcccaccttgaagacactgccctaggctggtaaaacttggacagttaacactgcattcctcagacaactgggagcactgcagaggtctgcttccccaagcccctgaacgacagcctgggacttccctgcaggcctgaacacaagatctcaggaaatggaagagttgaaccgaaagagtttttgtatttttccactcaagacttttttattattatttttttagaaggagtctcgctctgttgcccaggctggagtgcagtggcccaacctcggctcactgtaacctccgtctcctaggttcaagcagttctcctgcctcagcctcccgagtagctgagactgaaggtgcccactaccacacccagctaatttttttctatttttaatagagagagggtttcaccatgttggccaggccattctcaaactcctgacctcaggggatctgcctgcctcagcctcccaaaatgccgggattacagatgtgagccaccgtgcctggcaagagattcttaaaacctcttctggtgagaagtgaggcacctgaccaggaccaatgggatttggtgacttggtctcacacctgctttctctctgttggaagggttgctggcctctattagaaattttaattactatctggcaaaaatatgttctcctttctgactgcttaaatatgtaagatgggtccctcagtgctagctaacctcaaaactcaaaactaaatcatcttaataacataaacccttatctctgtcttgacagcagtaacacggagctgaacagtcagctaccagcatatctcatttcattgcatttgctttgctgcgctttgcagatactactttttctcacctagcaaactgaaggctttggcaaccctacatcagggaagtctactggtgctttttgttctttgtttctgctttcttcagccctttttctgtctatgaagccaacctcctctactgcactcattggaatgcttacatttattctacttcataaggtattgcccaattctagaaccacaaataaagccaactgaaatctttaaacgatatttgttgtaattgtgtcttctgacagaaacacaactcaatccacgcacaggtcttcctgcctcaacctttgctaacctagcacccatctaccttccccttggctatcaaaccaatgtttctgaaactcaattctggtaacatcccttttctacttaaaactcccattagctttttcatccaaactataatgacagcgatactaatatttattgagtgctaactgtacaccaggtactgctgtaagtattatacatatatgacaatattcctacaggataggcactattattacctcctcttttataagtgagcaaaccaagagacaaaggtgttaagtaacatctgttcaataaagccacagacttggccttcatatccctgggttccacatctgtggtttcaaccaaccacggactgaaaatatttggaggaacaaaaaaaggatggttgcttctgtactaaacatgtatagaattttttaagtctttattccataaacaatacagtataataactatttacatggcctttacattgcactgaatactataagtaatctggagacgatgtaaagtataagggaggatatggtctaaagtatgttggaggatgtgcataggttacatgcaaatacgacaccatgttatttaaagaacttgaatgtgtgtggattttggtacccaccgatggtcctggaaccaatcccccacgaatactgagagaggactatgtagttagtttcagaacctgcatttaaactcaggctctatacctcaaaataaaaagctatttgacatggaaattcaattaatcaacagagttgtctttgaccctctacctatcaaaaactactgacagcacaaacgattcagaactttcaacagagaaaagagaaggtgtccagaaaggaatgctgagtctctcttaacacagctatcaaatcctgaatgcctcacaaacatcagatcagccatccatcaccaaaatgggagggggaggtaggaatcgaaactgcagaatgacaacaaagaagaataaaatctaacaactcagcaacaatataccctcaggttagagataaggaagaataaacaattcagtctgaaaggacttctaccaagaagagattagtaattagactgaatggctgtggttcaatataaagtatagaaatgcaatttttttccctctaaacagaacataggcacaaccccagaagttactcaagagggctttaaaaaagaaaacaaactctaaaacaaagagtatctttaaacactaatcattgtttttttttctaaaatcactattagaacactacctgacaaggtctttaaagggttcactgttgattaagccattttcatggcctagtaagtttgagttctattaattcagactgtgctatgtacactgaaattttgtcttaggcaggctcaacagaacagttcttcaaattaagcaagtgcttaatgttaggtagaaaaaatatgtcgctgtgaaatatatactgtccaagtactatttggtgccaacaaaagctaacaaacaggctgtgtttttaagtctaagcagaagaaaagtaaccactacctgtacagaatacagttcggctctttcagtatttcagataaaaagaaggactgaaaccagaaacaacctactttctagctctgaattaccatcatcacattgtataaatcattaggtggggacagaatacaccaaaatagaaatcacaagctgaaagagccttgaattccttcccttaaatgaagctcttatatcaaatgaatctatatagtctctgtgtgttccagcattttgtcaacttgtaaatcaaagattttgttccatagcccttctcaattttctacatttaacatctgacaaaaaccagcttttatctttaccaaagatattctatccctagaaagtcactatttaaaatgatgtcatttatatcatgtaacatattaagaaatacatttattttatttttggtagtaacaaaacaaccctggatatttgcataaattaaagctgtcaataagaaaccacttctatatgtatccttctttgggtttctggctcaggggttggcaaaaatgggttatacatttaaataatatttcaatcttaggttaaggaaaatttctcctgtatatttcaagatacagagagactctgccgatttacattcaaataaaacaaaacgtgagtaatactgtctatatcaatgttctgtcacttgccagaataaagaaaacatttagtaagttagttaatttcaagtctgagaattaagcaaatatcccaaatcctttgtaaactcaaagatttagttactttctctacatattacacagctgctttaaaattttaccttctggccgggcgcggtggctcacgcttgtaatcccagcacttcgggaggctgaggtgggcagatcacgagctcaggagttcaagaccagcgaccccgtcgctactaaaaatacaaaaattagctgggtgtggtggcgagcacctgtaatcccagctactcaggaggctgaggcaggagaatcccttgaacccgggaggtggacactgcagtgagctgagattgcaccactgcactccagcctgggcgacagagctagactccatctcaaaacaaaagaaaaaaaaaatttaccttttatttctagatactttgtaaaaaaaaaaaaaaacaactcaaccttctttcctagaaactttctaattaactttctacttttttcgttaagaaaactcctttagtttacacaccaattctgtataaattaaaaacacacaatttcaggtgaaagttctaatgagtagtgtatattttgaaaacacgaatgcttattttacattactctgtgattagaatgaaaaaaacatagatgcacaagtggtgacagaagtaaacctaatactcaataacaataatcaaaggcaatacatgatactcgttcctgtctcactagtgcacattagttttaacattactgaaagatgtgggaaactcagtattttctaaaactcctgatttatttccaaaggaaaaatagttgtaactacgtcaaaataactattttggccggatgcggtggctcacgcctgtaatcccagcactttgggaggccaaggtgggcggatctcttgaggtcaggagtttgagaccaacctgaccaacatggtaaagccccgtttctacttaaaatacaaaaattatccgggcatggtggtgggcgcctgtagtcccagctactcaggaggctgaggcaggagaattgcttgaacccgggaggcagaggttgcagtaagccgacatcgtgccactgcactccagcctgagcaacagagtgaaattttgtctcaaaaaacaaaaattgcaattaatagtttaaaatattaaatctaaatttataggagattcattagtttgcccttggtaatccccactttctgccttgtaaagcctaagaccctaagaagctctacaaactagagcttcttaggcttcaaaacagttctttccaaaccatatttgatgaattatatgtaagatgagtcaataacataaggattagatttccctgaaaatgcatagaaggttaaaaattagaagaaaaagtgataggcataataggctctgggttttgcttaatgcaaacgttctgaaaggttcaacattaacacagacattcacaaatgaggcatctaattttaactttgttttaaaaagttgtttaaaaaaaaagtcaaaataagtcaaactcttcccatttgtttgaatagagggtacatttacttcctacccaacaagatttgaaaacaaaagacatattagctataaagatatattcctttcacttaatgctccacaaatgtctgaaaagcaaactcaactcaatttagttgagtcaataagggaattccagttttccttttttcttttctttttttttttttttttttttttttgagacggagtcttgctctatcgcccaggctggagtgcagcagcgtaatttcggctcactgcaagctccacctcccgagttcaagcagttctgcctcagcctcctgagtagctgggattacaagcacacgccaccacgctcggttaatttttatatttttagtagagatggggtttcatcaccatgttggtcaggctggtctcgaactcctgacctcgtgatccacccgcctcggcctcccaaagtgctggggttacaggcgtgagccaacgcgcccggccaggcaattccagtttttctaagacagtattgtaaaccaagcagagatattccctagggccatataattctgatacattagctaatctttgtaagccaaatcagagcacttctttccaaaactcacatttctaccaaaccgggacaccgtgtggtggggaaagagttcagaacacctggtatatttttccaaagcaaaatttaactttccattgccaggagaagcatgaacatgttgacttatactgccctctagagtctccttctaatattttttagcctgaaataattaattctaatcataagactcttctaattactcaagctttcagtattctaatattgtaaactgacgtttatttatttatttattgagaagaagtctccctctattgcctaggctggagtgcagtggcacgacctcagctcactgcaacctccacctcctgagttcaagcaattcccctacctcagcctccagagtagctgggatcacagccatgcaccaccacacccagctcatttttgtactcttagtagagacgggttttcaccatgttggccaggctggtctcaaactcctgacctcaggtgatccacccgcctttggctcccaaagtgctgggattacagcatgagccactgggcccagccaactgaccttttttcagtggattagtagtcttttttttggagggcgcggggtggggggaaaggagtctcgctctgtagcccaggctggagtgcagtggcgcgatctcggctcactacaacctccgcctccagggttcaagcgattctcctgcctcagcctcgtgagtagctgggattacaggcatgcgccaccatgcgcagctaattttgtatttttcatagagacagaatttctccatgttggtcaggctggtcttgaactgccgacctcaggtgatccgcccgcctcagcctcttaaagggctgggattacagatgtgagccaccgcatctggctagtagtcattattaaaacatacaatatttcaattacccactgttttttatttttttgttgtttgtttgttttggacagcgtctcgctctgtcgccaggctgttgtgcagtggcacaatctcagcttactgcaacctctgcctcccgggttcaagcgattctcctgcctccgcctcccaagtaactgggactacaggcacgcgccaccacgtccagctgatttttgtatttttggtagagacggtgtttcaccatgttggccaggatggtcttgatctcttaacctcgtgatccgccagcctcggcctctcaaagtgctgggattacaggtgtgagccactgagcccggccaattacccactattcttaaaggtcagcagtacttccccaaaggacaggaatgcaccccaaacagaatcttctaatttgcttatttaaaaaaagttttaaatagctcaaactgcaaagacttctaaaacaaagaccacttgtagcatatattaattaatccatgtagcccagagttttgtctagcaaaacccaagttcacacatttgaccacatgcacacgaacctcagccaacgcagccaacgctccccagaggctacttctgcagctaagcatctgtcctttcagctcctggcagttcctgccttttctcttgccaggcaaccagagctctaaagggatcttaatgcactaatgagaagccatgacaaccaagacctgcggtagctgcaaagcacaaacaccagtatccacttttactgagcacgcatgcaataagcaatgtgctaaggaatccaagtaaattaaaatcattcctctaacctaataactccataggcacctataacacaccataacttgaaactttctatcattctttatatttaagaacttattaaaaggcaggctttaccatgcaccactggtagtatagcttgcctcagctgttatagtaactatagaagtagggttattttcttgtttgtttcaatctagagtcataagagaccatcaaaaaaaaaaaaaccctattgaaaccatgtttagagcgaaaaagtctatattctttttaggggattagtagtcaccattaaaaggtatgatatttcaattacccacagttatttgagatcagcagtatttcctcaaaggacagcacctaaaacggaattttctctaggcacctgtggtataccataacaccaaaaagcatccctcaaaaaagaaactaaaactaagatgctatgctccatacccagatatctgttattacttctgaaaacaatctaagtaatcttggggatcccatccagtagataaaaacgatggcatcctttggggcataaagtgaaggtaagatttccacaggctctgaaacagcagctagcaactagggccaagagactgcacctgtttttgaaaataaacttttatagccaggcgcagtggctcatgcctgtaatcccagcactttgggaggccgaggcaggtgatcatccgaggtcgggagttcaagaccagcctgaccaacatggagaaaccctgtctctactaaaaatacaaaattagctgggcatggtggcgcaagcctgtaatcctagctactcaggaggctgaggcagagaatcgtttgaacccgggaggtggaagctgcggtgagctgagatcgtgccacaccattgcactccagcctgggcaacaagagtgagactccatctcaatcaatcaatcaatcaatcaagttttattagaagtcagctacaccgatttttttttttttttttttttattgagatggagtctcgctctgttgcccaggctggagtgcagtggcacaatctcagctcaccacaacctctgcctccctggtttcaagtgattctcctgcctcagcctcccaagtagctgggactacaggcacgtgccaccatgcctggctaatttttgtatttttagtagagacggggtttcaccacgttggccaggctggtttcgaactcttgaccttgtgatccacccgcctcggcctcccaaagtgctggggttacaggcatgagccactgcacctggccttatttttttatgtgtattttctatggttgtttgtcttcccactacaatggcagagttccatacttgaaacagagaccatacaacctgaaaagactaaatatttactatatctggccctttacagaaaaagactgccaacagcaaacatctccagccttctccagatcacaacttaagaggaatgtcatgtgcatgaggctaaggagtgtgggctggcttgagatggaaaaggggattatgactgctatccaccctatactacatattaagaaaatgaaattatgggaactcatgggaagaaagaatgacagatgcagctgattcctcccatatgatggttcacatcaggcttttccaaagactgaatgaagagctctaaggttttctttcaggtatttaaaaaatcttatgtaagggatggcaggggaaaataaaattttctatataacatactatttcactcacatcaatgttacactgaagctcacacctgagataggctgatatttctttcaaagagaagatttcaagtaagcttccaaatagctatgataatgtgtatgaatagaaccagatcccagaatgaacttgaggtaaataccaaggactgaaatcagtgaaccatcaaaacaaatatacttgtcaaacatacaatacacaagatgaaatataatgaatccctttgaaggtcactatatgtagatacaaaaatacagcttgaagatgatctagtcaagagacccaggttctagtccgggttttgactctccctgtaacttagaaaagtaatttcccccatttgtttttggggttttttttgtttttgtttttgtttttgagacagagtctcgctctgttgcccaggctggagtgcagtggcgcgatctcggctcaccgcgagctccgcctcccgggttcaccccattctcctacctcagcctcccaagtagctgggattacaggcatgcgtccccacacccagctaatttttgtatttttagtagagacagggtttcaccatgttggtcaggctggtcttgaactcctgacctcaggtgatccacctgcctcagcctcccaaagtgttgggattacaggcatgagccactacgcccagtctggttttgttttttgagacagagtcttgttctgtcacccaggctggtgtacagtggtgcaatcacagctcactgcaccatctacctcccaggctcccaaagggctaagattacaggtgtgagccacagtgaccagccagtttcccctttgtactttatctgtgaactgaaggactaacgctgcatgagtggttctcaaccattcacatgcctcagaatcacctggagggatttgttaaagcaaggggtgttgggtgccaggcttcattttcagttcagaagtcatcattcccatcctcacagcaagaaaacagctaaacaaactgaaatcaatggcctttcttagatccattagagaactggggtcacagagcaaacagctaccacaaaatttgaaggaaaaaaatcacaagaaaatacagagaatcacagaaaagatcagattaccagaagcaaaagctacatgaaccagtaagcaatacagtaatcaatacctgaacggtaattttgacgaactgcagaagactgagtgtggactagcttgagagttaaaacttctggaggtccagacttaagagggacctatatagcttttacctccaggagcctgaacaggttcttacaagaacatcaaagaaaaaaatcccctcgtattttaggcagggagaggggaaagtaaccattttgcaattgctcagagcattctccataacaaaggcccacctgctaagaaaaactacttcgcaggagctttgtagacctggggaaaggacaattactcaactccctcttgccttctcacagaaggggtgaggggaggaaagctaataaactcttcggaagatcacagcctaaagacttacgcccactaaaaaactgagatttaatattagattacagaatgcactccttccccaacacctttccaccacatcaacagagctccagtataaaaaaaaaaatgcattacaactgacagagcttcaagacagactctatttaagaaggagttcttagggaaacccaaagaaaccaggggtggaaaaaaacaagaaaactacaggaaacggaagcatctaacccacagcaaacatgaagcacagtatggcattttctgaaaaagctaaacataatgtttttttgtttgtttgtttgtttgtttgttttgttttgtttttttgagaagagtcttgcgctgtcacccaggctggagtgcaatggcacgatctcgactcactgcaagctctgcctcctggtttcatgccattctcctgcctcagcctccccagcagctgggactacaggcacacactgccacgcccggctaatttttttgtatttttagtagagacggggtttcactgtgttagccaggatggtctcgatctcctgacctcgtgatctgcccacctcagcctcccaaagtgctgggattataggcatgagccaccacgcccagcctgaaaaagctaaacataatcttaccatacaatcccacaatcgtgcccctaagcatttgtccaactgacttaaaaacttatgtccatacaaaaatctgcacaaattttagagtagttttattcataatcagagacagaaggcaaccaaggtgtccttcaaccgtacttcatgaatagatatgcgaactgtggtgttcactgagcaataaaaagaaatgagctctaaagaacaagaaagaggaacattaaacacatattgttaagtgaaagaagccaatctgaaagtatacacactatatgattccaaccatagaactttctttaaaaggaacttcaactttctttaaaagacaaaactatagagatagtaaaaggaccagtggttgccaggggctgggcaaagaagggagagatgattacatggagcacagaagttttaatggtggtgaaactattctgcaggatactgtaactgtggataagcacatgacatttacgtttctgtcaaaccccacagaatgtacaacacaaagagtgaatcttaaactgtagacttcagttaataatatattaatactgcttcatcagttgtaacagataagccacactcatgcaagatgttaataatagggggaactctgtgtgtgtgtctgtatatgtgtgtgtgtgggaactacttatactatctgcccaattttcaatttttctttttttttttttttttttttttttttggtttagatggagtcttgctctgtcacccaggctggagtgcagtggcgctatctcagctcactgcaagctccgcctcccgggttcacgccattctcctgcctcagcctcccgagtagctgggactacaggcgcccgccactacgcccggctaattttttgtatttttagtagagacggggtttcaccgtgttagccaggatggtctcaatctcctgacctcgtgatccgcccacctctgcctcccaaagtgctgggattacaggcgtgagccaccacgcccagcccgatttttctataaatctaaaagtgttctaaagtataaagtttatttaaaaaaaaagagagagagagagagtgagtgttgggagtcactcctcgatcctaattcagtaagtcttgggacaggcccaataatttacattttaaccaaattcacaagtgctgctgctggttcaagagccacatcttgaaaccactgggctacggctccttttagttctaaattttattattctattcactaacattttcatgagaactgtggtaaccagcccacaaaatggcccccagtgagctctgcctcctggtattcaaactcttgacaataatgtcttccaaggctacgtcataaaagacattgcagctttcaccttgctcttatatgaatcctttcttctggaaagccaggtgcagtatcatgaagaaactcaggcagccctatgaagaggttccatgtgcaaggaactgaagcttctgccaacagccagcaagaactctgccaaccttgtgaatgcactatgttgcaattggatcctccaggccctatcaagccttcagttgactgcaacctgagaagggacctcaagccactcctaaattcctgacccacaaaaggtgtgtgggataacaaatgctgaatgttgttttaagcagcagtttggaggtattttgttacatatatcatataggagcttaatctaaaatatgtatgtggctgggcacggtggctcacgcctataatcccagcactgaggcaggctggatcacctgaggtcaggagttccaaaccagcctggccaacagggtgaaaccccatctctactaaaagacacaaaaattagccatgcatggtggtgggtgcctgtaatcccagctactctactcgggaggctgatgcaggagaattgcttgaacccagaggtggaggttgcagtcagccgaaatcgtgccactgcactccagtctaggcaaaaaggtgagactccgtctcaaaaattaaaataaaataaaataaaatgcatataatataactgttattgttgacccttcttgcctttactttgatacagctggagaagtcctgaaaatgtgtccaaattcattacaaggtgaagatcaatttaaagaactcctccacatttctcaaagtattatattaataatgaattatatcatttcttcaggacataaaggatttggggtgggaggagaagggaaaggaaggaagtggaaacgagattttcatcatcttccctaagccattgctggtcatcctagagtagaaatctgagagtttcactttattgcttaaaatcctttaatattatagtttcccaaagcttatggaagtgaatccagacactgctcattgtctgcactacatctaccaagcaggctcatgaggcagcacaaggggtgcacacaaacatgggctgactttgcaagaccttggataagttacttaatctccctgcctcggtctgctcaacagtaaaatgaaggtaattatactaccaatatagttactatagggaattaatacattaaaacataaaaaacacttaaaagaggacgttgcctaagtgctcaataaatgtcagctatcatcatcatctgccattgcatctctcataacccagactatttcaagccattatgaactactggaattttcaaactcaccaacactgttttatgcttttgcaccttagaaaagggactttctctgtctggaatggccttccttcacttctctctcaattatccttctcaacttccttatatagccttctctgatttcccttttacttaccgcatccctcatagacacacctacagagaatatttaaattatttattatttgcctctcccacaaaattgtatgcttgataataatacttgatacttattgtgtcaagtactgtgtgccagccactgttttatattaagcactttacttagactatctaacttaaacttcttaataactcataattatcctagttttattgacagtaaaatctataacatatataaataaagaataagaattcaaaccttagctgtttggctgcaatttgttacaatctaaaatctaaggactaggaggtggagatttctgacatgctgaaaatatcaaggaagcaattaaaccttccagcagttagcataagtgcacacagtttaaaaatttataatatatatgcatggtactgtaggtgggctaccccacacccccagtcatatcagcttcttgcttatactttctggagatatttcatgcatatacagcatgcacacacatatatgtacatctctttgttacacaaatagtagtatacttcatatagccttctgagcccatttttacttcctgtatctttgagattgttccgtgtcagtccatacaaagtgcctcattctttttcactgctgcagagaattccaccatattccataataatatggtttggacttgtgtccccacccaaatctcatgtcaaattgtaatccccagtgttggaggtggggcccggtgggaggtgattggatcacggggcggtttctcatgaatggtttagcaccatcccctcggtgcgaagttcccatgagatctggtcgtttaaattgtatagcaccttccgcctctcttcctcctactccagccatgtgaagatgcctgctccagctctgccttccaccgtgagtaaaagctccctgaggcctccccagccttgcttcctgtacagcctgcagtactgtgagctaactaaacctctttcctttataaattgcccagtcttcagtatttatagcaatgcaagaacagactattatatttaccatattcaaccactctcctatattgtttgtagccttttgttgtaatataaaatcctaaagcaaaatccttatacacaaagaaatggatagaggatgattctacagtaaatatggtaaatgtatacgctatagcaaatatagtaaaatgcaactgtagaatctaaacggtgagtgcaggggtgctctcactatcataattcctgcaattgttctgcatttaaaccatcagtttgtttgtttgtttgtttgtttgtttgttttttggagacagagtcttgctctgttgcccaggctggagtgcagtggcacaatcttggctcactgcaaggtccgcctcctgggttcatgccattctcctgcctcagcctcttgagtagctgggactacaggcgcccgccaccacgcctggctaattttttgtattttttagtagagacggggtttcaccgtcttaaccaggatggtctcaatctcctgacctcgtgatccacccacctcggcctcccaaagtgcttggattacaggtgtgagccaccgcgcccggcctatacttgttcttaaagtgagcatcatgtttttctttcaacttctcaataaattgctaatatgaaatattttatcaacttcaaaacaatccccaaatttcaaaaatataataatcttggaatgtttgttacccttggcttatatcatagaagaacagaggaggcaattatcagaagagtcacatttcaacttccatcattttacccaagggacagtcaagtaaagtaaaactgccctaagtgtcttattttcttgggtctctcaacactcttttaggcaaacacttggtcttcaccaagaacaaagagttataggtgtctgttacctctaggagaagcaagggggaaaaaaaaaaaaaaaaaaaaaaaactaaaacctttggagagtcattgtttgacatcttccttctcagcttccttcttatataattcccaggagtcctagccaataaagaatggtttaactcttctttctgaaaaaaacaaatgattatctttctttagaaaatgtattcctctttcctctgaagactcagaagcagacctttcaggagaatttctggattagagtgtgccatttcagccaagggacttcctctaccagggtccaaagataacacattctaatgaatgcttgctggactgtttcctttttttttctgacaatttgaaggtcttcaatgaaagcatgccagtattaccacagacttatcttagggcagtgctttggtaaaccaaattcagaagctttagaaaagactagaaactaataagtcagctatacatccacttagagtttgccagacagagaaaaaggaaaataacattccagtcacaaagaataaatcacagagggctttaaggcttaattgccacgttttccctccaaaagaatcaaaagtttatcacacttgtttcctaaatctccaaaaatgtgagttattgagagaagagtcatacaatttttaggaatttccatttcttccgttgtcgaacctttgaaaaacaattgcaagttgaagagaactcacatgacccagaaactgttctgagctctatcaatgttcaggaagcagaattttttttttttttaactttttaaactctttttgtagagacaggatttccctatgttgcctaggctggtctccaactcctgggctcaagtgatcctcctgccttggcctcccaaagtgctaagataacaggtgtgagccaccacacgtggctggaaaaaaatgttttcatccagagagtaaaactcaatgaagtggcacagcacgcagtacatttcaactttcccctcttaaagatttcagcctacacactccaatttcacactcaatgaaagcttaagcaaaatgttagcataaatcaaagttttaaatcattttagattgttaactagcaaatgtcctgcagaaattttaaaactcactaaataaattataaatctagttatgagaacaaagcacactgtggaatataaggatgcagaataaacagctattcagaaagtgtgtccaatttttgtcccacccctaagtcaagaggcaaaccatgaccccgctgtgggactgggctgtcaagcactctccctcctctgctaacgctgttgcctctgttcagaagaccttccctgccctctcttcacggggcaaacctacacctctcctccaagatccagctgagcctttacctcctctgtggcccctgatcagaatccccaaggcagaagtttttggagctttattcgtgcctttcttttgttgttgttctttttttttatttttttgagatggagtctcgctctgtcactcaggctggagtgcagtggtgtgaacttggctcactgcaacctctgcctccctggttcaagtgattctcctgggctggtctcaaactcctgacctcaaacaatcctcctgcctcagcctcccaaagtgctgggattacaggcatgagccaccacacccagcctattcacgcctttctgacacctaccactcactataacacacttaacaagcctcttcccattccccacccctcaaggcagagcctgcagccctggtcatcctctatccctgacacccaccacattgcccagcagacaacagcacagtcagtagtcccatttactaaggacttacgtgccagacactatgctcagtgctttatataatatcaactcatttcaccttcacaaaaaccatatgaataatataataataaactatagtatccctccaatcagtcttccccagcctccttaggaggttccttttcatgtgaacaggctgtaacctacaggactctatcctgaccatactgtcatcttgttcctcacactcttcctgggcaatctccaatccaggtctttggagctcattccaaacccatataggacaggcacttggatatctgagtgttctgcacttaaaattggtcatgtcccaaactctgtccatctctctccccaaatatgctctctctttatgattctaacagaacactctatgtccagtcatagcctaagtccaatcaggagaaagaaactacatggtaatttgaacaagggaagataaaaaatcattaactataacaaaagattaatgagaagttggcaaataagaccttgaaagaacacagcaatagctgacataaaatatagtagcaaatataatattatgtaacacaacatataattgccaccacccttaaggctgagacagagcacccaagaaagagttcccccaactctagggctgagatccagaccttgctggagggggctcatacctgacagaacttcaggcaatccactctgtgaaatttgccagaaatcagtcctctagaatgccaaggaaagttgtttgtgggagagtgtctcagtggacgtactctgctacctgggcagcaggagagctgctggtcactaagagctgcaaatgcctgagcactgaagaaacaccatgtgccacactggcctctcttggaaccagcaagtaaatctctttcctcctcaatgtctctccagcaccctctactgacaaaactaaacatcgtgccagctggcggaggaaaagcaaaaggcccagattcattttcacagagcaagcaatgaaggacatacttcgaggtgagaagcaataaatcaataactgacacaagcacacaatcatctatcagttgtctaagcccaaaacctagaggcatccttgatttttcctccagtcatcaagtcccacaggtcctaccttctaagtatttattgaatccatctacttcactccatccacttcactccattatgattaatgttaataatactgatatattaattaattatattatataataaataatatattattgttaataatagtgttaatccccccgtccagttttacttgcttgctttttttattctgttttgcctctgggccactgcacatgggtttcctctgcccagaacagccttccttctttcccctattgccatatccactttttggttagctgattcttcatcattcttcagctctcaactctcttgctccaagttacttgcccctgctaagtacacccaaaagaatcctcttcttccccactaagaacacttaccacacattattgtacaatcacatgttgcttaacaatggatatatgttcatccttgtgtgaacatgatagagtgtagttacacaagcctagatgataccctatagcctactgctcctagactacaaaactgtatagcatgttacagcactgaatactgtaaacaactgtaacacaatggtacatctgtctagggcacttaccccatgaatggagctcactggaagttgctctgggtgagtcagtgagtcagtggtgagtaaatgtgaaggcctaggacattactatacaccactgtgaactttataaacactgtgtgcttaggttacactaaattcctcttttaaatattattttttcttcaataacaaatcagccttagtttactgtaacttttttactttataaaccatttttaaaactttttgactcttaacaactcagcttaaaacacaacacgaatacattgtgcagctctacaaagatattttatttgtataatcttattttataagctttattctatttttaaattttttaacttttttaatgtttttgttgaaaactaacacacacacattagcctaggcatacacagggtgaggatcatcactgctgctcttgcaccgccacatgttggaccaatggaaggtctccagggtcaataacatacatggagctgtcatctcctacaataacaatgccttcttctggaatacctcttccagaatagctggaggctattttacagtgaattattttatatgtaagtagaggacgtacactctaaaataatgataaaaagtacactatagtaaatacataaaccagtaaaacaatcatttataatcactatcaagtattacgtactgtccacgattgaatgtgctatatttcatataaccggcagcatattaggtctgcttacaccagcatcaccacacacatgagtaatatactgggctacaaccttataccacatacaatgtaactaagcaacaggaaattttcgcctccattataatctcatggaaccactgtcatatatttggtgtggtccaccattgcccagaatttctttacacagcacatgaccataattccttattaactaactctcatcattcatacttttacctctatgaaggcaagaaaaatttcttcatcactgaatcccaaagagttagcaagatgtctagaacaaagcagacactcagtatcagctcagttaatggatgttgaatgaaggggggtgacatggttaggcattgtgtccccacccaaatctcatcttgaattgtaaaccccataatcctcataatccccacatgtcaagagagagaccaggtggaggtaactgaatcgtggagccggtttctcccatgctgttctcgtgatggtcagtgagttctcataagatccgatctgatggttttataagaagctcttccccacttcgctcagcactcactctgtcctgccaccctgtgaagaagatgccttgctttcccttcaccttccaccatgattgtaagtttcctggggcctccccagcattgtggaactgtgagtcaattaaacctatttcctttataaattacccagtcttagacagttctttatagcagcaagaacagactaatataaggggaagcattttatgaagcaaataacaacttaaaaggagaaaattttggctttgagattatatctgatatgttgatcagtgtacatgcaataaaattattacacatatataactctaaggataaggagacaatgcctttgtctcatgcctaacaattaagatacagtaaaatataaagtctattcctcaaaagaaaaagaactaattcaaccagctggcaatatgaatttatatgatttcagtatattgtatgcagatgaggaaaaagactgttagttttcaaggtgaacagtgccatcccagtgtagtatgtatatatcaaaggattctgtttatttacacccaataatgaaaatcaaatattacaacatgacattccattgcacaccatgcttctatggtagaaaatcaatacatcctatttgttttcagtaacttgtttacccaaccacagttctagagtcattatgcaatgcaaacagtcttctaaagcactctgacccatatgaaataaaaactaggtcctctctgacactcccaaagggaatatctctctggctaactccaggaatttgctcagggatatatggagcaaagattgtagagctgaatcggtatataaagttactctgacactctgggaggaaatttagccaaatccgtaatagtgagtagcaatctcatccactcaatggccaagggaaatatattcaggactagaactcacacaagccaaagcactaaaatacacaaagtacaaccaccagcagtgctggctcacacctgcgatcccagcgctttgggaggccgaggcaggcagatcactcaagcccaggagttcaagaccagcctaggcaacatggcaaaaccctgtctctacaaaacttacaaaaattagccaggcatgaaggctaaaattagccaggcatgatggttaaaaattagccaggcgtgatggggtatccctgtagtcccagctactcaagaggctgaggtgggaggatcacctgaacctgggaggttgaggctacactgagctgtgatcatgccactacattccagcctgggtgacagagtgagatcctgtctcaaaaaaaaaaaaaaaaaaagtataatcttgaagatttaagcttttttgttgttattgcttatttatatcattctcacagtctaaaggggggaaaaacttaggatacaaacagacgttatttcagcaactcaatcattgtttaatcctcgagacatattgtggacaactgtattatagaatttaaaagtgtgtgagtttattacacacttgtttaaaaaaagacataataagtatgcagtctattcgagctgggcacagtggctcacacctataatcccagcactttgggaggctaacatgggaagactgcttgaggccaggagtttgagaccaacctgggcaacaaggcaagaccccatctctacaaaaaaattttaaaaattagccaggtacaggggcgcgtgcctgtagtcctatcttcttttttttgagacaaagtctcactctgtcatccaggctggaatgcagtagtagaatttgggcttactgaaaccactgcctcccaggctcaagcaatcctcccacctcagcctcccgagtagctgggactacaggctaatttttttttttttttttttttagtagagacggggtttcaccatgttggccaggctggtcccaaactcctggccccaaggaatcctcggcctcccaaagtgctgggattacaggcgtgaaccaccgcacccagccacacttggccatttttaaactatttttattccaactgatatatatttcatcttctataacatgtctcagtatagacatgcatagtctgatcaagaaaatcttgtcaataaaatgaaacttaacaagggccttggggatattctctctaccaagactgatctttcctttacttctacagggctcagtccctcacttatttgctaaaatgtcacctttccccagttattctttaggcccaccatgaccacttactccctcagccaaatctcagcttgccatttcccctgtgcctgcttgacttttctccagagcacttttcaccatcaaatctttacttatttgtatattactgtctgttttctcccactagaatattttctccatgaattaaggaatatttgggtttgtttcacttgctgctgcttcctcagcacttagaactgtgtgttgaagcacagtaggtgctcaataaatagtggttgaatgaaagaaaatagacagtcccagaaattaatcttaatactgatgctgtgaaatgaaaagctctcaaagtgggagtggacatacttttaagagatgattccctttcatttaacttaaagcccaaaggacttttcaaaatgaaattgttattccaactacacccaaaaatcattaaggctgcccctgggtgctcacgtacgttttaacaaaaagcaaggaattctatgtcctgctaaagcaatggaaaaccctgatgtagaaaatgtaaactgcttaagttccatatgtgggtagtaacgatttacaccacaccacttataacattatgagggtcacactaaccacagggagaattccgtttcacctttgtttttccacatacatgccctctaataatacaactcttcacaaacactgtattagctgcattcttaaacacgcctactatctaaaacatacacagcaatgtaactgatgggtacattctcaatcaggtaattttgatagaaaaagtataccaaccagtgtgccatttggccattaaaacaataggaaagacagaactgatctaaatagctcataatatggtctaaaagagatgaccttcaaactttagcgataaaataagaaaacacagaaatagaggtgttaatcagttaacagaagtcagtaagctaaaacgtacaaagttctacactgcattttgtggtaagagacaaataaaatatatgttccccatacaaaaagacttcttaaatctattaagatggaataaatagtatgtacaggataatggagacaaatgcccatagtctaaaatggaaaacttcaaaatcacctagacccaagaaaacaaaaatcacatattaggacaatttgattttcccatgacatacgtggcgctgtagatgcagtttatcctacctccagtcaagtgggtccatgaatagaaactctcaggtataaaccactcctctaccacttcaccccagggcattctagtgacttccatggtgatttggtttggctgtatcctcacccaaatctcatcttgaattgtaatcctcataatccccacgtgtctagggagaggcctggcaggaggtgattggatcacagggcagtttcccccatgatgttctagagatggtgagtgctcaggagatctgagggatttataaggggctcttcctcctttgctcctcactcgctcgtgccaccttgtgaaggtgcctgctttgccttttgccatgattgtaagtttcctgaggcctctccagctacatagaattgggagtcaattaaacctcttttctttataaattaaacaggctcaggtatttctttatagcagtgcaaagacagactaatacacatggttacgtttctctcaactactgacacttggcatgtccagctattataatttcatttctatctcccaaatgttttccatctgtcccattccattccagaccaccgttggcctaggttcagctgtcatgatcgcctggctaaactgcaaaaggaggtgcgatgacattatactcctgcttaaaacttctacaggattccacggttcactgaatgaagtctaaactccttaatactctaatatacggattggacctctgtcctcagccccttctcttccaggcttgaacctccatgtcttggcatacatacttttccaccccctaacatatattccctttcttttctgttttaaaacatctttcttactggtcgtgaacggtggctcacaccggtaatactagcactttgggaggctgtggtaggagaatcgcttgagcccaggaattcaagaccagcctaggcaacacaggcagatcttatctttacaaaaattaaaaattagccaagcatggcagcacatgcctgtggtcccagctactcgagaggctgaagcaggattgcttgaacccaggaagttgaggctgcaatgagccatgatcctgccactgcactgcagcctgggctgctgagcaagagcctatctcaaaacaaaaccaaataaaattcctcttacttttgaaaggcccagtttaaatgtaacctctgtgaaaatttctttgatcctcacaatcagaattatttgttgccttcagggtattgccaaagtactctgtttatatctctgttcaaagagattgtatctatgttaacgtaaatcatagtctgatgatagcttttgtctgtttaacaaagcaccctccttactgactttactctagggaactaccacttcatatggggacctaataacatgtagtttgggtggatccagggttgctcaccatactaaatcctcctggccaccatgacttgttcaagaatggacccatgtctcagtaagaaccactgagaaccctccccataacttctgctagaaccaccagaagaagaaaaaaaatacaaagcctattttataataaatttgaatatctcatgtaacttattgaatacagaaagtgaaaaacaaaatggttatatggtactcaaagtatggtttctattgactgtgtatcatttttgcaccatcataaacttacaaaattctaagtcaaagaatcataagtcagagactatactgacatacgagtcatgatcgtggtctgacttacattacaattaattgtactcagggccaaagaaacagttataagaggacacctggcagataagagaaacagcaagaaggcctgtgtggctggggcaagcaagtgtgggagcgtgtatgggggggaagtgagagagaaggagggcaggcaggggagggaggggagagagaagagagatgggggaacaaaaaagagagagagagagagagagagaaagggagagggagagagagacagagccagacagacagacaccccaagatggcattgtgaaaggtcaagctattgcaaagtcccaagcagaagagggacaggatctgacttaactttcttttttgttttttgagacggagtctcgctctgtcgcccaggctggagcgatcttggctcactgcaagctccgcctcccgggtccacgccattctcctgcctcagcctcccgagtagctgggactacaggggcccaccaccacacccagctaattttttgtatttttagtagagacagggtttcaccatgttaacctggatggtctcgatctcctgacctcgtgatctgaccacctcggcctcccaaagtgctgggattacaggcatgagccaccgcgcccagccctgacttaacttttaaaaggatccttaggcttgctgtgttgtgaaaacaaatggcatgggggtgggcatggaagtgggaggtgggcagggagaacaagacctgttaagaacctgctagggtaaccaggccagaggtgatgaaggctcaaagaaagttttgtccaatttttttttttaaacaccctaattttttttgctaccaattacaactttggaaagacagataaatcaacacatgatattcatacttgatttactgagtatctactatatttaagacactctaaatattaccttatctagttacagaactatcttcctaaactcaaagcccatatgcaaacggtgaactggaattctctaactaaatatcccatacacattttacccccaaaacctaatcctcctttactctctaatctcattatctcattaatattatttcctagcctagttgttactaaagataataagagagtaggtatatttgagacagagctttgctctgtcgcccgcgctggagtacaatggcacaatctcagctcactgccgagaactccgcctcccgggttcaagtaattctcctgcctcagcctcccgagtagctaggattacaggtgcatgccaccacacccagctaatttttgtatttattttagtagagatggggtttcaccatgttggctagcctggtctcgaactcctgacctcaagtgatccgcccacctcagcctcccaaagtgctgggattacaagcgtgagccaccacgcccggccataactttctatattacttaagtagttgtatacaactacacataatttcgtctaaagttcaagacaattctgggagagaaacacccttatttacctctaccattttacagataacgaaactaagctcagaaaaatgcagtaacttgccagaagttattatgctggtaaatagtggagctgagactcaaacgtgggattctaactcatccacaatcacttcagtcagaaacgtgggaattatcttagactcttctctcagccccacgccagatgccctctgtcattcactctcacaccatcactatcttagttcagagcttcccatctctaaactcagttaccacaataggctcacaggttacgttgctgtatcttgcataaccctccccttccatccattctccatactattatcagatactctcttcagttccaaacacaagctttgtgctccaacgcaagtatatggttaggaaacctacagatcatggaaacagagccaaaagtgtcaagagctttcttcatcagtatgcatgcattaattccagcaccagcaacttaccaagcaatttttggcagcatcccaacttcaagattctcattaatatcgccaagtacgaaaaacctggtgattgctcaatttctccttttgtctttcttcccagccccaaaggtgtggactttaagcatttcaaggacctcatcagacctagtcccaccttcctaaattactcttttcttatccaatcaaaactgccattcctagaaggcccaaataggtcttaagtgttcataatgaggtatcagaacatacatattttaaaaagaggagctaattaaataagtgggtctctattctggtatttcataggcatgggggacagtgatgatggtaataatggctaacatttatcaagatctcggtaagctgtgtgtcaggtactgttttacttgctttacaagcatttaattatctgttcctttaatcatcagaactactccatgaagtgggtataattattattattatcacaatttttggataaagaattgaagagctggaggagttaagtaacatgtccaaggtcacccaatcagtaagaggtgccagcgctcctaaccacctcatgctaacaacttcactataatggtagactccaatagagatatgtgaaggagatcattgtgagcttattcattcattcttaaaatatttcttgggagtttattatattctgagaattattcctgccactgggaatttaattgtagataatgcttttatggaactcacaagaaaggcaccaaaaaatacataagtaaaaatgaaaacaacacaattttgctctggaaaaaaaaaaaaggataaggtgatgtagagtaatgcgctactttagactggaagccagggagggcctccctaaggaataatattgaaatgcgatctaaattataagatgaagcaaagaaaaaaacctgatggaaccgcactgaggcaattatgatgaatgcaatacacctaggtaagagttagtttgttagttcctaaaacaacagaaaggacaggaggccattgtgactgatgctaagggagcaagtggagagtggtcagagttatatcagagactcagaagtatcaactatgctggcacacagccatggaggaaaaaaaatctgtattttactcccagcagaatgagaatctggagggttttaaggaagagaacgaggtgatctatgtttctgaaaaagcaattccactcctccaactctgtgtaaagaatgaactacaggccaggcgcagtggctcacaccagtaattccagcactttgggaggccaaggcgagtgggtaacttgaggccaagagttcgagaccaagctggcccacacagcgaaacctcatctctactaaaaatacaaaaattaaccaggcgtggtggcgggcacctgtaatctcagctacccgggaggctaagacatgagaatcgcttgaatgcagaggccgaggttacagtgagccaagattatgccactgtactccagcctgggtgacagaacaagcctctgtctcaaaaaaaaaaaaaaaaaaagaatggattatagagtgatgaaagtggaagactggagaggaattaggagactgttacttctagaaccatgcctggcacgtagtcagtagtcaatgtgttcaataaatgaatgcttcaatatcaaggtaacggaagatgagggctaagacttgggtggtaaagtgctacatgtagaaaccattctgcctcattcaacatctgtgagtgtcacaaacccagtagtcttttaaaaaccagtagcctctttttccggctggaaccatggagggtgttgaagagaagaaggtggttcctgctgtgccagaaacccttaagaaaaagcaaaggaatttcacagagctgaagatcaagctcctgagaaagaagtctgcccaaaacatgctttgaaaggcaaggaagaagcttatttatgaaaaagcaaagcactatcacaaggaatataggcagatgtacagaactgaaattcgaatggcaaggatggcaagaaaagctggcaacttctgtgtacctgcagaacccaaattggcctttgtcatcaggaccagaggtatcaatggtgtgagcccagaggtctgaaaggtgttgcagcttcttcgcctttatcaaatcttcagtggaacctttgtgaagctcaacaaggcttcaattaacatgctgaggattgtagagccatatattacatgggggaacccaaatctgaagtcagtaaatgaactaatctacaagcatagttatggcaaaatcaataagcaaattgctttgacagataacgctttgattgctctatctcttggtaaatatggcatcatctgcatggaggatctgattcatgagatctaaactattggaaaatgcttcaaggaagcaaataacttcctgtggcccttcaaattatcttctccatgaggcggaatgaagaaaaccttgactatctacaatataagctgctccaaagtgcttgaaacatctgagcacacttcccaaaacaggtagtgttctgttgcccatcatgacaatctctcaataactctgaaacatacttattcaagcagcccccatttacaaacatccaccaaccctacctctgccagccctgctactggaaaaaacacttaggacatgccagggattatgccaagcactttgcatctagtctctcatttgctccttactacactctatgagtctaatatctccaaataaatagcaatctatagtaacaaaggcaatattcttataagaatcatgtttttaatacctggcacctatgggaaaacctctctgatggaagaatttaagagaagggtggaagggagcaaattccatttcttccagagtgactaaactacaccgaagtcaaacttatgctacccagttagttttgctctgatgatcctctctgcactgacaggtgaaagcacatgcagaacatgcatggcttattattctgaaaagtccaaaatactgcgcttattcctatagcaactcggaggctaaacagagacccagtgttaacttcatacagacgtcctcagagaagcccttcctttgcagttttatgttctttataattataccaaacctttagctcagaatccctttcactttaaaaaaaaaaaaaaaagaacttacattatcatctagttatatatgcaaggcaccaaagaaacaacaacaacaaagtaaatatggaaaaagacttgattctaagaagtcataatagaattttcagcacttgactgtagtacgggaactgtccccaaataactgttttaagattgcaaaaaaaaaaaaaaaagatcaattcaatataataatagttaaaacttaacacagctctttatgtggcaggcactaatctagaataacccatttaaccttcataacggccattcaagggccactattattatccccattttacagacagcaaaaagacacagaggctaagtaacttgccagtgaagtggtagggacaggatttgccttgcgtgtctgtgttcttatacaccacatgctgctactcttcaaatggaaaaaaaaaaattcactatcacccagaaggcgatcatacgatgatgaattttgactttgctttttatttctaatccttcatcataaaagaaacacttcctttgcagtttcatattcttgtactaaagcatagctcaggaacattttcatttaaaaaaagaaaaaaaatactcccagtatcatctagtagttataagagatacggaaggcattaaactacattattcctataatccttacaagagaaattcaggttcagagaagagactatcaaaatgataaacaatagtgaagtggtaattcagaaaagttcatgtttaagtttcatcttaatctttatctcattgagggacatattttaaaagtaagaacactgacaaactgagagataacgtaacttgtactcatcgtaaggctgtagataaaaacaaggtttcttaaaaccttgtgagtttcttttcctatgctacagcagatgtttcaagaaatgaagctattgcctttgtaggaaactgatatgatcaaaagaaattaaaggaaacttaccagagacagtttgtgttggaaataatttgaagtgccaaactttaaaccatttcataatttttaaattttgttttcatagatattacattacaaagaaaaattttccagaaatattttaatcaaagttctatttaaagaaacttttgattagacattattaaattgtgtattgttttaaaacaataataataatctgtcctgagctattagaaagaaatgtatagcatgttattttaataggcctaaatgaggaaggatcaatattattttaatttttaaaggtctgtttatgaaatgcaatcatccttcattaaaaatgcaagctgtgcttcagcaagaggttagcataaatgattcacagagagatctctctccagtataatcttcctctcctgggagtttccttcggatgtttcatcaaaccactcaagctactattaaaaatgcttccctgcgataaaaggagggaataaacaatataaacacacttccccattcccattcaccaatgactcttccatttgagtgatctatacctttttcagtcataggtaaaattaattttttatattccacgcatttttgcaatcgtttcttttctcaagcattttaagttaacgttattttacagtattcaaaatcagaaattcagatttttaaggtaggtttttaatcacttacctattttgacatttcagtgtgagtcttgtctttcattgaaattaaaagaagtttgccttctatttgacggattttaaaagattttaaaatgtcaactcatcaaagtcaagacactccaaatttaaattcaattctcttctatttaaaaatgctaatgaaaatggctgtttcaatgcagcagcatctggctcattataacactcagttttaactaataaatccttaattattaaattctggtgttcaatttctttcagataaataagccaaacacatactgctacaattataaatacctgggataaattacttataccatgaaaaagcatacctcttgattctctggctgctaaataagacccaaagtatgtaaaggacacacatttgaaagacccagcattaaacatttgggctccactgtatgtaggtcccacattcataggctggcaaatctttaactctactgggtcctcatgcataatgcacagggcaatttgtctgtttgtgcaaatgggccagtttttttccatgctttttcagatgtgtcaaatgtgtcaaaactgaacataatcatatacccctaattctggctttacaaagcagaccctaccttcacccagcttgatgtttttattaaggagttactgaatatatttaatcaaggtattactgcacatcatgatgtcttgtaaaggttgaaatccctgagagaatatgtttggttttaagccctaatatgtgttagggagtgtttcatttttctctcccactcccaattcctttttttttttttctccttttttaatcagcagcatcgacagtactgactgaatattttacaatggagttgcagagtatgtgtgttcaatcgtttcagcttcccagaagattcattacagttacattagaaagtcaaatcaggcaattctgcagtctggtgaaagccagcatatgaaagaaggttaatacaaaagaatttcattttagaggacatttaggactttaaaaagcaacattatgataaaattttcaagatatttgttcttgccttagcacatgctttccaggtctaatttcagagctgtctcaatgcttttctaggaaagaatgagggtgtatgggaggaaattgtttgatctacaaggtctgccatcttaatgatcctcatgctaagaacactgcagatgtatgttttgccctcactcatggggaaagaatctatggttctccaattatgctgatgaagtagaagtcaagtaaaagtgaaggtgcgttcatttaaaacataaagattttcagtgactgttaacatctgtctttctgattataaataaaactaactgctgagattttcagatcttaatatgtatttatataacaaaaaccagtaagttaattgttttccatgattagtagcaggtatagaaagatcttcttcagattggtacatgtttaactggcacttgtgtataatatagtaattcccctctttctagaattcaagcctcaataaacccctaactaatcttatgtatttatttccactggtttataggtaagcaaaaataagaatagactatctactgaaaggcaagccttgtcattcagtacagtcgatttacagaatacaaattccaattcaatacaaaggctcacctttgcatgagcaattccaaagcttaaataccatggcaagagggaaacagcagctagcagtggtaacagacataaaaggcggctgactgtcttcagtgctacctttggcagcagtacagatggactttgtaggccactggctatgcttaatttaatatgaagctaaatacagtcaaaacatctggtgcaccactgatggttatcatgataaattaaatctggcatcacacacaaatccattcaatattctgtttatatcccttttacctaaaccacaaaactaaaaatccacatttacttttgtttttcatttcctcttagcagtcctgtattttagaaaaggaacgttttgtagatctgttgtttatacaagttggggggccttctttaagaaaaagaccacgaaaatttgtatacaaaatgtcaagagggccactcaagtgagggtctctttggtttaagcttcatggacaatccacctctggggaggttgaaaggcagtgtaaaaactaaatagtatgccaagtagcacatggaactgggacaaagaatacaaaaatttttaaagcagacaatttaactgacaagctacagaagagcaaacaagactttctaggcaagcaaatcggcaaaaacaaactgtattgtcagaatctgtttttaacatatatttctaaaatgcaaaaccccaaattgggccaggtgcagtggctcacacctataaatccagcactttgggaggccaaggcaagagaatcacttgagcccaggagtttgagaccagcccgggcaatatagtgagactccgtctccacaaaaaataaaaattaaattaaattgaaattttaaaaccccaaatctacagcatactaccacaacaaaagggctattataaaggaaaaaagtcaattaaagaaccaaattatcagtcaagtgtggtggctatagctgtaatcccagcactttgagaggccaatgcagagggattgtttgagcctagaagttcaagaccagcttgggcaacatagcgagaccccatctccactaaacatttttaaaaatttaaaaataaagtaaaaaataatcaaattgtcaattttataataactataggtcaagaaacaagtataattcttacaagcaactaattcacaaaacaattagatcatggctaaccatttgttatttttaaaaagtcagagcaccacttataactaaagtgactactgcctgaactgcaatattcaaattattgcatttttattacattgctttgaaggatattcagtgaagataattattaattctagtgctatataatattagcatcacccacactcttttaaacaaaaaggacctaaaagcctcgactctgcatctgaagggaggagagcatgccatataataaattcagtacaatcaaaatgagaaccatatttctgtttaactttatgcatcttggctcaagagccataaaaaaaaagttattaaaattaatgcatcaaactataattctgtcctttttattactggtaatattctttctaaaatattagtctgctttgctgtactactatatctttttgaaagttttctttgaagatcaggatcactttaactttagaatgaaaacatgcaattatattaatttggcactgaatcttgttagtttcagtgggtttgaaactttgaaaatgatttattcattagaaagccacatgttggccagacatggtggctcacacctgtaatcccagcactttgggaggctgaggtaggtggatcacctgacgtcaggagtttgacaccagcctgaccaacatggtgaaaccctgtctctactaaatacaaaaaattagtcaggcatggtagtgcatgcctgtaatcccagctacttgggaggtgaggcaggagaatcacttgaacccaggaggtggaggtggcattgagccgagattgtgccattgcactccaacctgggcaacaagagcaaaactccatctcaaaaaaaaaaaaaaaaaaaaagcaaaccagttactgcttctgatggcactcataaagatggaagataatgaagctacttgtcattcaacacaaaacacacaaagaaagtgttaacagctggcaaatgtcacaaagtaaacattttcctatttctgttaaataaaattcattcctaataatcactgtcctgtatgaactttccctagcaaattactgccccatttctttcactaaataatcaattttttctaaagttaacacaaaagaaataccctggaaatcctcattctctagtcatgactaaatgaatgaaccacatgggctaccaaaatcaaattctctactgcatcactaatgtaatactaaataggatgctccatcaaaagagacctagaatttacataatttcccataaacttatcagaggaacaaatgtaagacaatgggaagaaaatcaagataagctcactgttgttgctggtttgtgtattcctgtctttctcaactcctcccacagctgatagaacattgtagttaagagagctggtagaaactacttcactaaaattatgtatttgaacatcagccttttttcattctagtcagccttttttcactctaaagtattaaattcaaccaaaaagccaaacattcaaagtctgttcaccaaaaacactcatcataaagatgtttatttactatccatataaggacgcaaaatggtattcctaacagccaatacacagaatcaacctaagtgtccatcaacagatgaatggataaagtcacatacatatgtatacacacacacacacatacatacacacacacacacacacatatatatgcaataggatactatgtgttctaagaaaattctgttacttgcaacaatatggatgaacctggaggatactatgttaagtgaaataagtcagacatagaaagacagatactgtatgatcccacgtatatgcagaatcctaaaacgtcaagttcaatttttttttttttagaaagaatctcgctctgtcacccaggctggagtgcagtggcatgatcccagctcactgcaacctccacctcccaggttcaagcaattctcctgcctgagtctctcgagtagctgggattacaggcctgcgccaccatgcccggcaaattttagtattttttagtagaggtgtttcaccatgttggccaggctggtctcgatctcctgacctcctgatccacccacccagccacccaaagtgctgggaacacacgtgtgagccaccgtgcctggccctcaatctttttttttttttttttttaaagaaacggggtttcactctgttgcccaagctggagtgcagcggcacaatcataactcactgtaacctcaaattcctgggtgcaagcaatcctcctgcctcagcctcctaagtagctgggactacaggtgtgcgccaccacacctagctaactttttatttttattttttgtagtgacgaggtctcgccaagctggtctcgaattcctaggatcaaggggtcctcctgcctcatcaaccttttttttgaagctgaagtagaagcaaagagtagaatggtggttaccaaaggctgagaggaggactggggaaatgtgagtcaaaggacataaaatttcagtgaggaggaataagttcaagagatcagctttataatatagtgactataattaataataatgtattatattactgaaaattgcaaagaagaatttaagtgtcctcaccacaaaaaaaaaaaatgtgaagtaatacatatactcattttagccattccacaatgtatatatatttcaaaccatcatggtatacacaataaatgtgtacaatttttgtcaatttaaaaaatgggattattctctcacctcaacattgaggtactaactaaaaagatatttcccaactactcagatgctgaagccggaggattgcttaagcccaggagttggagaccagcctgggcaacacagtgagactccatcttgaaaaaataaataaaaataaaaagatactgtgattgtcaaagaaaggaaagaggtattaagtcactgaaaggttatatttttcctttagaaaaatgaaaaattcctactttactgtcaactattacctcttctgacacattaactgtagaatccttttatatgagaaaattactaaatcggacactacatctcagaatctgctagaggtcacttggaaaagagcatcatcctttcaaaaggcaaggatgaagaattagaaagaaaaaggccagaagcacacaagtgaaacaagccagtgcacctgaggcctttgttggtccaatcaaactataggtcacaggtatttcaaaaaggggaataaaagacaactgcagttactttagaaaagggttaaattctccaaagtagacgcttcccaaaagaaaaaacagaacgaaaactgcaaaattctttcttctctcctttggagaatacggtttagcacagtttttaaaaaatcaaaatctcaagagatatgggtgccattcccatcccaataactaagtggctctgctaactgcaggttgtgtgaaactgtacacccactacgctcaattgcaaaacagccataaagaacttagaacactacacaagttcaacagacatgaagaaaaacactacaaaattcaaatgtgagggacaattttcctgccaatatacgtataactctaaattcttactctctctatacacacacacacacacacacacacacacacacacacacaatatgtcttgatgatcagagctattacactgtataaatctaattaaggtcagtttcctatatgggaaaaggaagatttatctgagaaataattcaaaataaattctccccaagtaaatagacctaggcctatcattagtttagtttagttttgttttgtttttttgagatggagtttcactcttgttgcccaggctggagtgcagtggcgtaatctcagctcactgcaacctctgcctcccgggttcaagcaattctcctgcctcagcctcctgagtagctgggattacaggtgcccgccaccgcgcccagctaattttttgtattttcagtagagacggggtttcatcatgttggccagactggtcttgaactcctgacctcaggtgatccgcccgcctcggcctcccaaagtgcagggattagaggcgtaagccactgcgcccagcccctaggcctgtaatagttaagacaatcatttatacatcatttatatcaatcaccacagtccacaaaagtcagccttagataagatgccaaaaatcggagatgaattaaaagaaagagtcctgggtcagtagtacagctttgttgcaagtatctgcagggacctggtagaggtgtgagagacacagttccttggtgtgaagggtgagaggtcacagggagggtagcaggaagcccaagaacaggtaactgaatttggacaggcttttgatattttaagcccatttccatggatttttgttgtgttttgaagatagggtctcgctctgtcacccaggatggtttcttaatatatttactataattattcccttggaatactaatattaatactaagttaaattctttgaaaatccagccagtgtcagttatgctaaatgaaaacaaaacactttgtacaattttatatttaaaaagagaagctctacactctaggattagaagcagtggagccagcaagactctcagggcaacattagctaccatttatggagcacttcttatgttccatgtgccaggctaaattattttcatacattatcccactaatgtataaacaaccctatcatttagctattatcagctccattatatagacaaggaaatggaggcacaaagacgttccataactctaacaggattacaggacagagaggtggcagaacaaggattcaaacccaatccttctgttctcaagctcagactcggaaccattatgctttaccgtcttaccaaaatgagaatcaaaatgaaagaacctcaaagagaaataaaaactcaaaggaagaatctgagttctttaaacaacaccagagcaatcctgtcctaaaactggaggattttcaggttttgcaatgtgacaaacttggaaaagatacatctgacactaaatcctttggcaattttattccacctcggggcttcaactaccccattctcagtatctccatcttaaccttgatgacttctcaagatattaaatatttccatctgcctaatgacaaaaatcactcatctcaataaaaagctgtatttattagcatcttcttcctcaaatcagtttgtcctcctgtgttcccaattttttaatggcacaggtgtaatgcaaattacctatgcttcacacctcccccacatgtaagactatatgccttgttctaacagttgccaaatccaactaattctacctctacaacgtctcccatctgtcatacctcttcatttcccctacagttagaaaggttagattctcggccgggcatggtggctcatgcctgtaatcccagcattttgggaggtcgaggcaggcagatcacctaaggtcaggagttcaagaccagcctgaccaacatggagaaactcccccgtctctactaaaaatacaaaaaaatagtcgggcgtggtggtgcatgcctgtaatcccagctactcggaaggctgaggcaggagactcacttaaacccaagaggcggaggttgcagtgagccaagatcacgccattgcactccagactgggcaacaagagtgaaactctgtctcaaaaaaaaggaaaagaaaaaagaaaggttagattctcattactttccacccagtcttcactctcttcctttcatgacatactagaaatagctatcctaaaacacaactctatcatgtcactcctttatcagaacaccttcaaaaaggctccattccccaccaatcaacccttcaagattcagaccaaatgcctccttctccaagcaaccttgtgtaatctccttcccctaaggagaggtcattgcttcctcctctgaacttcagcagtacctcacttgacccttaccaatttcagcctcctatcacaagtacctgtactgacatacaagcatcgtcaccctactggaagacaagcgccttaggagaaggttcaatgtctaattgaactgtgagtctcccacaaattctggtgaaaatatacttgcacacagtaggtacttaaatatttgacaaatgaatgaaaaaattacaaatcagctttctcggttataacacaagcttttcagcacaagaacttgtgcccatttacttaatttttttaaaacatacaaattgtgaagactaatcataatttccatgaaaccagccctttttggttcctagaatacccgagaaaggtgcttattttatttgaagacaaaaaaagtagcatcagttagctaggtcaggcaccatctaactctactattcactgaggccaggaacatttcctagggcctcagctttggtccttctggatgaagcctcagggggactttcctctgataatggactaaacgattcaagatgaccttaatgaccaccctgtttaaaacagcctccttatttctccaatacttcttctccaaacattgatgtttccaccataaggtcagctcctctttttcttccccttatggcaaggcttatggagaaactacaccacataaatgaagactaggagctcaaaattccagaatgacctgggaccatggaaaattagtattttgccttctacagtaaagtcacactcttgagcaaaggaggaaaaaaaaattatcacagtccctcaatcagcaaaaatctaggcatggaagactaaaagaagttagggtccagtaagcttaaaaaagaaaacagtgactcagaaatttcctatctgcaatatatagcaggtttagaggacgaaaatgaaaacagaagattatttctagacagcttgatggagaaagataatatttacctcagtaaagttacaaccataggaacaaatccagattctatttgtttttgtacaactctgcaaaaaatcatagggtgtaattcacttctcagttcagaaataagacgtccttaaaaaaataagtaagaggtacttcttgaaaactaaaagaaaaaaaatctactcccataatcaagagtttccatgcagtattaaaaatgatgtccagctgggcgcagtggctcacacctgtaatcccagcacttcgggagactgaggcgcatggatcatttgaaatcaggagtttgagaccagcctgaccaacataatgaaaccccgtctcaactaaaaacacaaaaaaatcagccagatgtggaggcgcacgcctgtaatcccagccactcaggaggctaaggcaggggaatcacttgaccctgggaggcagaggttgcagtgaggcaagatcgaaccactgcactccaacctgggcgacagagctagactccgtctcaaaaaacaaacaaacaaaaaacaagaccgggcacggtggctcatgcctgtaatcccagcactttgggaggccgaggcaggcggatcacgaggtcaggagatagagaccatcctggccaacatggtgaagccccatctctactaaaagtacaaaaattagccgggtgtggtggcatgcgcacctgtagtcccaactactcgggaggccgaggcaggagaatcacttgaacccagaaagcagaggttgcagtaagccgagatcacgccactgcactccagcctggcaacagatcaagactccgtctaaaaaaaaaaaaaaaaagtccctcctataattcaggaagtgaaggtgctagttgactgttatttattctcactcaaaaagctaactcaaggtcaagaagacctctgccaccagctgcagtgtaccaatcctaggaggctatttctcagaaccccatgcttcttatcaagatggttcccacgctgtcttccctttccctcatcactgcctcctccaggtcaaagaatatccccagggcaagttgcagctgctccttatgcactcagccctggcctcagagtacacatgggttttgcctcatctatgactcttgggggaagcttactatgcagagagcaactgcaatgtgtcgctctctataggatcccagccaggtgccttagtgccatcgggaaaatgagaggaaacaaggaacacacaaaaatcatgaaatactgcttcgggtactaactccaagacagaatttttttcttaagttaaatgtttaaaaacaaaaaaaagctacagtcatctatgtattcagtcatccagtcaatcccatgccaagtataatctctgttaactatgcttagtgtggtcagaaaggaagtctagataaacaatcacaacaacagagtgggctgaatgcaaacagccggggttcaaggaaggctccctgaagaaaattacctgtaaactgaagcaagcaagaggtgaccaggctaagaagaaaagaatgttcaccacacagccattactcagggacgtaattcacccagatttctatttttaaaagatcaaaggctccaaaaaagcaaagggccagtaagcacaagacagaggctcaacctcattagggaaatgcaaatcaaaactgtaagataccacttcacacccatcagaatggctacaatccaaaacccagatagtaagtattagtgctaatgtggaaaaactgcaaggttcatgcattgctagtaaaattgtaacatggtgtagccactttggaaaacagtttgtcagtttctcaaaatgttaaacagaggttccataccccccaaaaatttcactcttaggctttggaagtcaccccaagagaaatgcaaatacacatcctcacagaagtttgtacatgaacgttcacaacagcatttttttaacagccaaaaagtagaaccattcaaagtgtccatcaactagtgaataaataaaatgtggcatagccacacaatggactatgatttggcatttattgggaatgaagtacagatgttatgctaccacatgggtgaaccttgaaaacattatactaagtcaaagcagccagttacaaaagactacatgattcaattaacgtgaaatgtccagaataggcaaatccataaagacagaaagaagattaagggctgcttagggctgggggatgagtagaggaggaaatgaggagtaactgctcatggatacaggatttcttctgggcataattaaatgttctgaaattgcagtgatgattgcacaactctgtgaacacaaaaaacaattgaattgtacaatttaagtaggtaaattatatgatatgtgaattgtatctcaataaagctgttataaaaccaaacaaaaggccggatgcggtggctcatgtctgtaataccagcactttgggaggctgaggtggatggatcacccgaggtcaggagttcaaaaccagccaggtcaacctggtgaaaccccatctctactaaaaatacaaaattatgccaggcgaggtagctcatacctgtaatctcagcactttgggagaccgaggcaggcggatcacaaggtcaggagatcgagaccatcctggccaacatggtgaaaccccgtctctactaaaaatacaaaaattagtaggacatggtggcacgtgcctgcaatcccggctacccgggaggctgaggcaagagaatcgcttgaaccagggagtcggaggttgcagtgagtcaagatcgcaccactgcactccagcctggcgacagagcgagactccgtctcaaaaaaaaaaaaattagccgagtgtgctggtgcatgcctgtaatcctagctacttgggaggctgaggcaggagaatcacttgaacctgggaggcagaggttgcagtgagctgagattgcaacactgcactccagcctgggcaacaatgaaactgcatctcaaaacaacaacaacaaaaagaaaaaacaaacaaaagatcaaaaggactacagcagtgaagaacaaaatttctaattttgttagaaattagaggatttgaacatgccaactggtttggaatctataaagtaattcaagcaagagacagtggccaggtgcagtggctcacgcctataatccccgcacttgggaggccaaggctggcagaccacttgaggtcgggagttcaagaccagcctggccaacatggtgaaaccccatctctactaaaaatcaaaaaattagctggatgtagtggcacgcacctataatcccagctactcaggaggctgacgtgggagaatcacttgaacccaggaggtggaggttgcagtcagccaagagccaagattacaccactgccctccagcctaggcaacacagcaagactccattgcaaaaaaaaaaaaaaaaagaaaagaaaaaaaagagagagagagagacagtggcctgaactagcgtaatggattaggaagagataagagatacaggaaaaagaaacaatacttgattctatatagtggggagaagagaaggaatcaacacagcccagggttacttacttagaaaattgagtagcatttatcaaaacaggaaaacacagaaagacatgtttgggagcaggaaaattcacaatattgtgaaatttaattatatttacaaaagttatataaggacttagagaaggttttaagaaggttttgttttaaggttttgttggaagctttcttgggcatttatctaattttaaaatgcaatttaatgttagttatgtttataagtagaactggatatttaaacagaattcaacttgaattaatcaacatgtatcaaaaactgcattatttttcttttacctttatataaaatgtactgaattaatgaatagactaatatgatttataaactgaactcaaggctcaaggaaaattggactttaaactttttaacaataaattgactattcattttctacaccagaaactgtaagtagttgggtatcactggcatgtagcattactggttgaaaaccgagaagttctaatttgatggcttctattttctctggaaatgaggtcatcaattcaggaaatggaacggaaggatgggtggtatgagaaagtagaccaggaatccaaggtttgatacataattgaaataaaagcaatggaggccaggcacagtggctcatgcctgtaatcccaatactttaggagtctggggcaggacaattgcttgagccagaatttgagaccagcctgggcaacatggtgaaatctcatctctacaaaaagcaagtcaaaattagctgggtgatgtggtgcacatctgtattaatcccagctacttgggaggccaaggcaggaggatcacttgaaccagtaggtggaggctgcagtaaaccaagattgcaccactgcactccaacctgggctgcagagtgaggccttgtctcaaaaaaaaaaaaagagaaagaaaaaaaatgctgcttatcaaaaaggatgggatttctaaataaaaagctttctttattaaaaaaaattaaaaatagcctgtaatcccagcactttgggaggccaaggcaggcggatcacttgaaggtcaggagttcaacaccagcctggccaacatggtgaaacctcatctctactaaaaataaaaacaaaattagccaggcatggtggtgcacgcctgtagtcccagctacttgggaggctgaggcaggagaatcacttgaacctaggaggcggaggttgcagggagcagagatcacaccactgtactccagcctgggtgacagagcgaaactttgtctccaaatataatataataataaaataaaataaaaatgaataaataaaagtgatggagaaaagacgagctacgtggtggacagatacagaaggaccacttgaaatagtcacaggccatttggagtaaaaaggccatgacttcatgaggcatccattagctgaatgatgtctttttctttaaaattacttagtagcataatgactttcttccaaataatgtaaaaagaacgtgtttctggagtcttgattttcagctataccttaaagatagaaataactaagaggaaatttgatgtatgtacttacacaggaatactctgcactctaaatctaaccatggaaaaacattctttccaggaaagttgtataaaccacaatatccatttcagaagataatgaaagtatcattcattcattatactttaatatcatttctatgtcctttttctctaatccttaagtcagaattctagacgagtattgtccaacagaactgttgggaatgatggaaatatactgtatctgtgctggccaacacagcacccactggtcacatgtagccactgaacacttgaaatgcagctagtgtgactgaagaacttaactttaaattttatttaagttaatttaaatagtcatatgagggtagtgcctaccataaagaacagcacagtaaacttttctgttaaagaaaatgaagaaatttacaggccagttaggtgtccaagagtcctgtttacaacacaaaagatgtgaattcactcacttatgaatacatgtaacaacaccgacgcttgtccctgaagagcctttggttctattctcataatacaagagctctaaagtctcaaaaatgtgggtgtggactaggaggacaaaggaaatccatttcacaccccaagttccaagagaaaccgtgtacttagagaaggagttcatcatccttaggggaaaaatgttcatcagacaacttctagaggccagaggtcggcaaacggtggcccacaggccacatctggactgcaacctgtttttacaaataaattttataggaacacagacatactcatttgctgtaaaagcatgtatccatgctttggggctataagggtagaggtgagtagttgtgaccatctggcccacgcagcctaaaatgtttactacctcacatagtaaatcattgatttgagtaaatgttttttacccaatgatttgagtaaaaggagtaaaagactttgttttgaggggtaaactgctgctgtattttattattaggaaaaaagcaatttcaaggaaaaaacaaaaaacaaaaacaatcatatatagaagatttaaaatactgcacttccaatcccaatccacagtattccatcaaaaaatcactgacccaataaatgactgtccaagtacaaagtgataggcagatgcctaattcagaatgacaaccttaagacactgaattccgaaccatttttaaagttgtaaaactccaaaccactataaaggatgtaaaacacatcattttggtttgtttggagacagggtctcaatcgctcacccagggtgaggtgcagtggcacagtcatggctcactccagcttcaacctccaaggctcaagcgatcctcccatgtcagcctcccaagtacctgggactacaggctcatgctatcatgcccagctaactttattattttatttttgtagagatggggtctctgcccaggctggtctcgaactcctggactcaagcgatactcctgcctcagcctcccgaaatgctgggattacagacatgagtcaccacacccaggccacacgatttttttttattttttattttttgagatgaagtctcgctctgttgcccaggctggagtgcagtggcacaatctcagctcaccacaacctccatctcccaggtccaagcaattctcctgcctcagcctcccgagtagctgggattccgggcgcacaccactgcacctggctaattctttgtgtttttagttgagatggggtttcaccatgttggccagattggtcttgaactcccgacctcaggtaatccacccgcttcagcctcccaaagtgctgagataacaggcgtgagccaccgcgcccggccaacaccattaatttttaagtacactaatatattggaaattttctaaaacaaagcttgaaacaactatcaccaaaagttctgtaacacaaagagtcaataccactgaacacagtgttttcacctgtaacggagtaaacattctcatttcagaatattattgaaatagttaaggtattatcatgaggtacagtacctgacacagaatgggtacttatttaaaaaaaaatttttttttaaaaggatgactgtaaggggtcattccccatggattatggataattagggccttaccttctcaataatgcaaaactacattttcaatattgtagcatcactgaatgttttgtccaaaactagatttagagaaaatgtcacctactgattgagagcacagtctcgagaagcagactgcctcagtctacttatagccctactacgtactagctctgtcctcagtttcctcatctgcgaaataactatacttaacaatccatgaagaacaagggaagggtacagtgacgtagaacaacactgtggcaaactgtaagcactcaacaaaatgctgtattttaaaaacctatggctaatgtactgcccaaaattggtacaatcttttttagagggtaacttggcaatttctactaaaatctaaaatatgcctaacttttgaatcagtaactctatttttaggaattcatcctgtaaaaatattcacaggtttatgaaaagatattgacaaggatgttaactgcagcatcgttcataatagcaaataaccggaggcagtctaaacatctatcagttgaaaacaggccaaattataacactaacatgttttcttatggaatacctgtaattattaaaaaataaactatgtgtgcacctatttggggaaatgttcatgatttgtggttaagattaaaaagtgggtctcagtacagtatgtagaataaaatcttatttctattaattaaaaaaagacagaaaataactacagcagtcagaatccactaaggagatgcaacaacccacctgctggggggggaaaatgtaatgaaaaagaaaatgcatatagcataaatgttttttagagaaaaaacatggaactcctctaacagctatcattttggagattagaactattagaaactgggccgggcgtggtggctcacacctaatctcagaattttgggaggccgaggcgggtggatcacttgaggtcaggagttcgagtccagcctggccaacatgacaaaaccccatctctactaaaaatacaaaaaaattagccagacgtgatggcgcacacctgaggtcccagatactccggaggctgaggcaggagaatcgcttgaacccaggaggcagaggttgcagtgagctgagattgcgccactacactccagcctgggtgacagagagaaacttgtttcaaaaaaaaaaaaaaaactattaggaacttctatttgctaaatatttttttgcattatgtaaagtttataattagcatatactaattttacaatcagaaaaaagatgggccgggcatggtggctcacgcctgtaatcccagcactgtgggaggccaaggcaggcagatcacgaggtcaggagatagaggccatcctggctaacaaggtgaagccccgtctctactaaaaatacaaaaaattagccaggcgcggtggcgggtgcctgtagtcccagctactcgggaggcagaggcaggagaatggcatgaacccgggaggcggagcttgcagtgaccggagatcacgccactgcactccagcctgggtgacagagtgagactctgtctcaaaaaaaaaaaaaaaaaaaagaaagaaaaaagaaagataaaataggtttttagagacttgtgagaactctgctgcaaacgctgtttaggaaaacatataaaattttgtatgtatgtactgtcacatgtacatgtacatatgtaatatctatatacccaattttgtaaaataatcccaattttgtaatacatataactagaaaaagagactggaagaaaagacaccaaaatacagacagctgttatctctataaactccatgaaggcaggagcttcaactgttttatattgaaatatatactcaattacaaacatatgcttattttttttaattacgagatataacctgtcactacactggactgaaacttactgctacttgagatatttgttcctgatatataaattctgttttactttatcctcttgaagcatcattctaagtaaaatcttacaaagtaaacttacaaatccagcaaggaaaaaaaattagattacatactgtaccttgctctgataagaactttacaatggctttgaggaactcaacaaggaaaatcagtgtttccaagaagaagaaattcggcaggacttggtggttcacacctgtaatcccagcactttgaaaggccacggcaggtggatcacctgagatcaggagttcaagactagcctagccaacatggtgaaaccccatctcaactaaaaatacaaaataattagttgggcatggtggcgggcacctgtagtcccagcagctactcaggaggctgaggcagaagaatcacttgaacccggaaggtagaggttgcagtaagctgagattggccactgcactccagcctgggcaacagagcaagactcggtctcaaaaaaagaaaagaaaaagaaatttatgggctgggcacagtggctcatgcctgtaatcccagcactttggaaggctgaggcaggtggatcacttgaggccaggagttcaaggccagcctggccaacatagtgaaaccccatctactaaaagtacaaaaattagccaggcttggtggcacatgcatgtaatcccagctacttgggaagctgaggcgcaagaatcgcttgaacccaggaggtgaaggttgcagtgaacagagatcatgccattgtattccagcctgggcaactaagaaatttacttctttaaaaaataaaaataaaaaaataagtgaatatctggtctgtacctttaatacaatatcaactaaacttaaaagaaaaagaattttgttgattgaattaccaaagaaagtttttgagaattttaaggtccaaaaatgttactattatttgtcatcttaacttaaagatctaaaagtcaaaacatctgtctaaatagagatgttcaagaaatatttcatgctttgaaatgctatagcaataatatgaaattatattaaatcataaccagatgatatgtcttcataacaactctcaaccaaagaaagcagatgctgaaagaaggttgctggccgggtacggtggctcacacctgaaatcccagtgctttgggaggccaaggtgcgccaatcacttgagctctgaagttcaagaccagcctgcacaacatggcaaaaccccatgtaaaaaaatacaaaaattagctgggcacggtagctcacgcctgtaatcccagcactttgggaggccagggtgggcgaatcacaaggtgaggagttcgagaccagcctgaccaacacggtgaaaccctgtctctactaaaaacacaaaaattagccgggcgtggtggtgcgcatctataataccagctacttgggaggctgaggcaggagaatcgcttgaacctgggaggcagagactgcagggagctgagatcgcgccactgcactccagcctgggcgacagagcgagactccatctcagaaaaaagttacatctaaagtaagttacaatgctgtacatacatttgacatcaatgacagtcaaagacaatgagaaggggaaatgtcacaaaagaactgccatagaattttaacagaatgatctctaatgatctttcccactcatttactcaagtctttgacatcagctcatagccttccttctcaacaggatcctatcataatccagggtgatggcaacaaaaatgtactcatctaaccaggtaccttgttcctaggtgtcctctctccacgaatccacacacgcagccaaacttgctctacctctaaagccattcattcgaggcatcccattctctagccataatcactagcaatcctgaatattcgagatgcatttgttctccagcctcaactgtacctgtctttctttggtcctcagttttcttcatttcagcatctttcagatttcacttctactttctctggtttatactcactgcttgtaggaatttaatattatctccttcattttggcaaactatttttttttttttttttttttttgctacagagtttcgctcttgttgcccaggctggagtgcaatggcgcgatctcggctcaccccaacctccgcctcctgggttcaagcgattctcctgcctcagcctccctagtagctgggattacaggcatgtgccaccacgcccggctaattttgtatttttagtagaggcagggtttctccatgttgtgtcaggctggtcttgaactcccaacctcagctgatcgacccgcctcggcctcccaaactgctgggactacaggcatgagtcaccacacccggccatcattttggcaaactattaaaacctataagaaatctaacttatttcaatgacctaaaagaatcaaacaagaattaatagtctattatacagaataaaaccatgtttatctaatcttctcaaggacataaacataacaaacatgaacgtgctcattcattggtgggtattttaactcctcaatagtccaaccctcatctgcttttccttaaaattatttcattattccagctgaggagaattaaatcatgtgaaaagccccatatcagcctttcatagtagcatttcttctttctttcttttttttttttttttttttttttttttttgaaacagtctcactctgtcaccaggctggagtgcagtggtgcgatctcaactcactgcaacctccacttcccgggttcaagcgattctcctgcctcagcctcccaagtagctgggattacaggcgcacgccaccacgcccggctaatttttgtatttttagtagagacggggtttcaccatgttggccaggatggtctcgatctcttgaccttgtgatccacctgcctcagcctcccaaagtgctgggattacaggcatgagtcaccacacccagccacatttcttctttcttcataaattttttctgggccgggaacagtggctcacacctataatcccaacactttgggaggccgaagcaggaagacttcttgaagctaggcattcaagaccagcctgggcaagaaagtaagaccctgaccctgtctcagcaaaaaataaaaaaataaaaattagccagatgtggtggcacgcacctgtagtcccagctactcaggaggctgaaatgagaggatctcttgggcccagaaggtagaggctgcagtgagctacaatcacaccactgcactgcagcctgggcaacacagtaagatcttgcctttaaaaactaaacaaataaatcaacttttttaaaaaacaattttttcccttaacggtattttctagcacctaatattaaatacacatggtggttatttcatgttttctaggaaacaagtaactaacataaaaacaaaaaataaataaaatacacatggtgtgtgtttgataaacaatggaatattttacctctttcatcacttaagctttgcatatattaactcatttaactcttttaacaattttatgaggtaggtattactactatctccattttgtatcgaggaagctgaggcccagggaggttaagtaacttcctcattaatataaagcctctatgcagtagagctcagatttaaacccaggcggtcttggattctgcatctgtgctcttagcaatcatgccacactgcctctcaaacccaggctaaacttttgcttaactgagaaatctttccactgaaaacatggttaataattagtttcattatattcaagtaaacaccaaattagtacatcgcttccataccaattgtaataatctctaaattcttcatctgtttatcattcataacacagtaatcattcttcctattttcacaaaccatttcttatataaatttcctaaactttacatttcctttcactttaaatagctcagtaactttctaattttttcatccacctgaagttaccgggttactttcttcactgtctcattcttttcttttttaagacaggggctccctctgtagcccaggctggagtatggtggtgtgatactggctcgttgcaacctctgcttcccaggttcaagcgactctagtgcctcagccttccaagtagctgggactacaggtgcacgccatcatgacccactaattgttgtattttgagtagagacaggctttcgccatgttggccaggctggtcttgaactcctggcttcatgtgatctgcccggcttggcctcccaaagtgcaggactacaggtatgagccacggcacctagccccaaaatattgtttcattctattaagcatgtaatatacaacttaccaaattttgtaactaagttttcctctttccttcttctaaaaaccatcaatgtttcaacttccccttaaattcttttttattttattatcttttttttgaggcagggtgtcactgtcacccaggctggagtgcagtggcaccatcacggctcactgcagcctcgacctccccgggatcaggtgatcctcccacctcagcctccggaatagctgagagtgtaggcatgcgccaccatggccaactaatttttttttttttggtaatttttgtataggtggggtttcaccatattgcccaggctggtctcgaactcctgggctcaagctatccgcctgtctccacctcccaaagtgccaaaatgcaaggattacaggcatgagccaccacaccagacctaaatactttcttttgctgaatgttaaaacagtatcaaagtcaaaaattagaaccacttattctgagtgaagccaataagcacttcacctttgaaggagctctaagtagaacacgaaagaaagttatcaatattttatctgctaacatttacacggcaacctacttaaaaagttatatgggtgcttccacttctggaaagcattgtcttatctaagaagtccagattttctctttgcccttctagaaaacacatactatcaagtgtcatcaaatatttttcttatgttttataccaattaaaatttaataatggaggtgactgtgaagggagaaagaacaaagagaatacccaagcctaggtttaatttttataactttttgaagaaaaatatcaagaaaataggaaaacagaagagaatgaacattatattttctacatgaaattaaaagaagacagtagtttgagacaggtcactctgaaaacaaagtgtcatactttttttttttttttttttgagatgcagtctcgctctgttgcccaggctggagtgcagtggcacaatctcggctcactacaagttccacctcctgggttcacaccattctcctgcctcagcctcctgagtagctgggactacaggtgcccgccaccacacccggctactttttgtatttttttagtagagacgtggtttcaccgcattagccaggatggtctcgatctcctgacctcgtgatccacctgcctcggcctcccaaagtgctgggattacaggcatgagccaccgtgcccggccccaaagtgtcatacttttaataaaagtatatggtataaaaataaaagtatatggttaaaaaaaaaaaaaaacttcaactacccagacctcaatttgaaggccaaatgttgtattactaatagtgataccctgcacaaattaattctctgaatctccatttcctcatctggaaattagtaataccatctaccctgaagaatgggttattagaagtaataagaatacagcagctcaatcattccttttctccaaccatttcttacagtcaccacactaagcaaacagcaagaactgactcacctcaagccattacataaaatttatctattagacagtgagttaaagtatcaaataattctcattgtgatgaccccacatagactgttgtcttaaagtctttctgctgtattcagctctaagaagatgtttcttgatgcgcagttaaatttacaataaattacctgaaaattttctcaggcatgccaaaaatcacaagatctatttatatattttagcaatctagtgaaaacgttctttacttatcaagaactgatgatacttaaacttccttccagaggtctctactcagtttaatttgtgatagcacttgtatgtgagacagcaaacactatacattttaagcaaagaaaaatactatagaagacttcattttttacagagtttaaaggaaagctcattctgatgttcagaaatacagtggctcgggagtggtggctcataactgtaattccagctcttcgggaagccgaggcagaaggatcacttgagcccaggagttcaagaccagcctgggcaacatggcaaaaccccatctctgcaaaaatacaaaagctactcagttgtggtggcatgtgcctgtagtcccagctactcgggaggctgaggagggaggatcacttgagtccacgaggtggacattgcagtgagtcaagatcatgccactgtgaccttgtctcccaaaaaaaaaaaagaaaaagaaaatacagttactaaacagttttgtttttgttttgagacagtcttcctctgtcacccaggctagattgcagtggtacagtcttggctcactgcaacctccatctcttgggttcaagcaattctcctgactcagctcccaagtggctgggattacaggcatgtaccaccatgcctggctaatttttgtatttttagtagagacggggttttgccatgttggccaggctggtctcgaactcctgacctcaagtaatctgcctgcctcagcctcccaaaatgctgggattacaggcatgagccaccacgcccactccagttactaaacagttttatgtgtaacatcacttagactctatcctaaggaaataattgtaaatatgagatgacatttatctgctagaatataagttccatccgggcgcagtggctcacacctgtaatcccagcagtttgggaggccgaggtgggcagatcacgaggtcaggagttcgagaccagcctggccaacatggtgaaaccccattctctactaaaaatacaaaaattaggctgggcacggtggctcacacctgtaatcccagcactttgggaggcaaggtgggtggatcacctgaggtccaggaggtcgagaccagccttaacaacaaggtgaaaccccatttctactaaaaatacaaaaattagccgggcatggtggcaggtgcctgtagtcctagctactcgggaggctgagacaggagaattgcttgaacctgggaggcggaggttgcaatgagccgagatcacgccactgcactccagtccgggcgacaaagcaagactgtctccaaaaaaaaaagaaagaatgtaagctccatgagagcagagatttttttctatttattcattatcatatcctcagtgcctagaacaatgacaatcacttatttactgaatggaaataaaaagatccatagtgttacagcagtaaaaaacagaaaacacttatgatacattatgcattcattacaatgatgatgaaaatttatgattacataaaagtgcttacactcatttatttaaaaaacattaacttagtggccgggagcagcttatgcctgtaatcccagcgctttgggaggtcgaggcgggcagatcacttgaggccaggagttcaagaccagcacggccaacttggtgaaaccccatctccacaaaaaaatacaaaaattagtcaggcatggtgttgtgcacctgtaatcccagctactcaggtggcaagattctgtctcaaaaaaaatgactaagtcactaacttaggcattaagaagactgggttctaatgccaactctgtcactaatttgacctgtaccttggggtaaaggacaacctatttgggctccagcaccctcgtatgtattatttcctccccatttcctggccttggctggtcttaatgagactggctttgggtagacattacagcgagtacatgcctgagttacctcagaaagcaaagactaacacaaacagcagagaaaaaggggatgcaacctggagcagatcaaatgctgcatcccagtggactaggagatcctcagtgacatgctcttcaagccacactgactcagaatcatccatttttaactctaggacctcaaagcatccttgaaccactttacaataaacagcaagtaatttaggtcatctgagtcaagagaacaatgccatccagggtataccaaaatatcaagccctactgtcaaaaggaccagaaaataaagtacaggtggagaggaagtgatttcacccgctggaaatagaaaaagtagatctgtgtgtcagccaacaactatcacacaatggaacaggatgcttacctctctgctggaggaaaagaagctattctcaagtccttagaataaaaactattgtaatcttactatatctattttatgtcatctgagagcaatccatgaggacaatgcttcctctttcagagaatcttccaactgaaaatctcaaagaattcccaagcaccacttgcccttcaacacctacctacacctcacttctctgccccacactcacaaactttattagcatccacaattaaagaaccatgaggccaggcgcggtagctcatgtctgtaatcgcagcactctgggaggccaaggtagaagaatcacttgagcccagagggttgagaccagcctgggcaacatagggagaccttgtctgtacaaaaaaaaaaaattctcggccaggcacggtggctcacacatgcaatcccagcactttcagagcccaaggcaggcggatcacaagctcaagagatcaagaccattctggccaacatggtgaaaccccgtctctactaaaaatacaaaaattagctgggcatggtggcacacacctgttgtcccagctactcaggaggctgaggtaggaaaatcacttgaaccctggagatggaggttgcagtgagccaagatcatgccgctgtactccagagcctggtgacagagcaagactccgtctcaaaaaaaaaaaaacaacttttttttaaattagctgggtgtggtggcacacgcctgtgtcccagaggctgtggtaggagggttgcttaagcctgggaagtcaaggctgcagtgagctatgactgtcccactgcattccagcctgggcaacagggtgagaccctgtcttaaaacaaataaataaaaaacaaaataaaataaaactctgctctgccacttcctagctgagttactttgggaaagttattgaatctctccgtgcctccattttctcacaattataaaacggggataatacctgttacacaggattgtgataaagattaaattcatctagaatgcctgggtaaatacttagcataaaatagatttccaaaaatgtaaggccaatttctaccgaggcctattccttacaaagaaaactgaagacacataggaattctcattccttgtagtgatctaaattaccaaaccatgcaacatcttaatataaaagaaatctcaaggaaggaaatgaagttactgcctcatggttttactgacaagcagtttttaaattgcaggttcacagagggatttgggggacccattaatcccctgaaattatacctgattttgaggcagcgtgctacttctgtaaatgtcttcactgaatttccactagctccaaacctatttctctattctcctttacagcaaatatcctcaaaaaggtgctatactcactctctcaaattctcctttcattctctcttaaacccactccaataagaatgatgaaacaaaccctgccctgaaactaatcttgccaagatcatctgtccacattgctaaatccaatgatcagttctcagtcctaagctgatttttagcagatttttgacacacttcatctacccctcctgcttgaatacgtttttctcatctggcttccaggatgccatataatatagtctatgatttcttggttttcctccttttttgctgatctcttatcagcttttgttgctgactgttgtctcagactttttaacgtccctggacttcgtccttgaactttttctcttctcttccctatactccactggtaatctcttctggtttcccagctttacttacacttgccacacactcacaactaggtatctccaacccaggtttctcacatgaattccagactcttacaccatcttaaaactgtctacttggcatctccacttgagtatctaatactactttaaccttggtgtgtccaaagtaagctcaagaggccaggcgcggtggctcacacctgtaatcccagcactttgggaggccgaggtgggcagatcacttgaggtcaggaattcgagaccagcctggccaaaatggtgaaatcctgtctctactaaaaacacaaaaattagctggatgtggtagcaggcacctgtagtctcagctactcaggaggccgaggcaggagaatcacttgaacccgggaggtggagggtgaagtgagccaagactgcgccactacactccagcctgggagacacagtgagactccatcttaaaaaacaaacaaataatctgctctaaacacagccttcccatgtcagctcctgacaaccccatcctttgagctgcacagtcccaaaccttggaatcatccttgactcctttctttcaacccctaccctacagtgaaattcatcagagaccaggcatggtggttcatgcctataattccaacacttggggagggcgagacaagaggatcatgtgagcccaggagttcaagaccagcctgggcaacatagtgagaccccatttctacagaaagtttttaaaattagctgagcatggtggcacatgcctatattcccatctacttgggaggctgaggtagaaggatcacctgagccagggaggtcaaggctgcagtgagccgtgttcacaccactgcactgcagcctgggcaacagagtgagattctgactaaaaaaatttaaaaactcatcagaaaatactgtcgctctatcttcaaaatacatccagaagtcatatacttttcacaagtctactagcaaatggatgaagcaccaccatttctcacatgaattattatcatgatagcctcccacctatctcattatttctagcctgttgtcccagtctgctgtccacaaaggagtcttctgtccttttaaaatgcaaataatgcactatgggaggccgaagtgggaggactgtttgaactcaggagtttgagaccagcatgggcaacctaaggagagctgtctctactaaacagaaattaaattttttaaaaaaagaagagaaaatgcaaatcacatcatgtcacttctttgctcaaaaccatccagtgccttccccatttcaatttaagccaaagtcctgaaaaggccccaagaagcacctttacattcccccagccccttaccggtgaacatctacctcagaagtcacaacagacatcgtagactgaatgggtggtccccagaaagatatgtccaagtcctaatccccagttcctggggactgccaccaaagattgccagcagccaccagaagcaaggaggaagtatggaatgggctgtccctaagagcccccagaaggaactaaccctgccaaccgacaccttgatttcagacttctggcctccacaactgtggcacaataaatgtctgttgtgttaagccaccaagcatgtgcttgtaatggcagccccaggaaactgacacaccactctaccccctgctcattctgctcccaccacgctgtcttccttgtgcccacttcaggacctttccactgactattctcctctgtctgggaagctcacgctgcagaacttcacatggcaaactcccacacattttagccttttgctcaaacatcatcctctccatgaggcctatcctgactcccctatttaaattgcaaccaccaccatctttccacttctttcaaactcccttacagtatctatttttttccacagcatttatcatactctaatatactacataacattcttgtttattacccattggattccatagaatataagctccacagaggcagggtttttaggtttgcttggggttttttttctcttttgttcactggtgtattctaaacatctataaactatgcctggcagatagtagctgttcaataaacacacgctgaataaatctgttgaacgaacgtgtatatgtatatgtctttttctggaaacagaattcacagtttttatcagattaatgaagtgatctgctacccaaaaaaggtttccaaatctttgttctcaagctttaagtggttaaggaaaagggaattctatcctaaaagaccccaactctaaaaaaagcaaacaaaaccccaaaaacactcatactatgacttcgtatcttacaaatggcagacacaagtttaaatttcatactcccaaaaccaaattttgctaaagaaaaaaagacagtccactacaatttaatggcttgagaagcaccttcacccacttttcacagaaccttgcacactaaaaggtgtacccaggatgagcttatgtctctactgcttaagcaacaaagggtggccagcagtgtgaagcattcacataagcaaatcaaagttccacacagctcaagaacatgatccaatgctccacctaggtaaaatcctatccaaagtaggggagtagaaccaaagcaaatcataacctgtctagcatctatccttactatggaataaacagatatttactcaaaatacaacactgttttaaagaccttgagaaaccatagaagagatgtcatttacatgccccctcagtatgaaccataaagcgtaacaatgaaaggcagtcaagcataggaaaacctgttaatggattttgataacagcagaaaggcacccactacattccttattattgctgcaacatatttcaaagttactactaaacaggtctaggctaatacaatcacaccaaacaccagaattcagcatattacttatccaagcatacattcttcagacatatcttttatattaaatcaatgaccattacagaggaaaatatgcacatctgctgttccatctttcttgttccatcagcaagtggattcacaatgcaaccaagtcctagtccttacctttcctggttccattctccaacagaggaatttcaaggatacagaatctatgacatactttgaagacaaaggcattttaaactctaattaactcataatttgccttgagctgcttttttttgagacgaagtctcactcttgtccccaggctggagtgtgatggcgcagtcttggctcactgcaacctccgcctcccgggttcaagcaattctcctgcctcagcctcctgagtagctgagattacaggtgccaaccaccacgcccagctaatttttgtatttttagtagcaatggggtttcaccatgttagccaagctggtctcgaattcctgacctcaagtgatctgcccacctcggcctcccaaagtgctgggattacaggtatgagccatcgcgctcggcctgccttgagctgtttttttaaatactggtaagactttcacatctcagaacacatcattttatcaaattccaaacccaaccgctcttcatcacctccacgactaccacactaacccaggcccacagcacatcccctgcagagtctggccacactcctcatcagtctgcctgcttccactctgactggcagcagtctaactttcttttttttcaacttgagagcagctactgtttatttaaactgatcagactagaaaaataattgtggtaaacacctcggttcattcttctaagaagcctgtggatctggtcctccctgttgccagcatctccaccttctacaaaatgggtggtttttcttcattctatcttgtggagaaaataatttgaagggccacaggaagttatttgcttctttaaagcgttttccaacagtatagatgtcatgaatcagatcctccatgcagatgatgccatatttaccaagagatagagcaatcaaagcgttatctgtcaaagcaatttgtttattcatcttgccataaccacgcttgtagattagttcatttactgacttcagatttgggttcccccatgtaatatatggctctacaatcctcagcatgttaactgaagccttgttgagcttcacaaaggttccactgaagatttgataaaggcgaagaagctgcaacacctttcagacctctgggctcacaccattggcacctctggtcctgatgacaaaggccaatttgggttctgcaggtacacagaagttgccagcttttcttgccatccttgccattcgaatttcagttctgtacatctgcctatattccttgtgatagcactatgctttttcataaataagctccctccttgcctttcaaagcatgttttgggcaaacttctttctcaggagcttgatcttcagctctgtgaaattcctttgctttttcttaagggtttctggcacaacaggaaccttcttcttctcttcaacaccctccatggttccagctggtaaagatcgcagtctaactttcacacagcagccaaagtgatctttataagacagagatcagattctgtcacacacacctgatgaaaaccttccagtggcattatacttggaatgaaagccagaggtcttagcatggtccacagggaactttatggcctggctcctgcccctctttcctggtatcacctcctactgttctcccagagtttttccactgttccttgaccaaaccagcaggcttccacctcgggatttttgcacctgatgttccctctgcctggaaggctctattcctatacctccgcatggctccctagcctgttcaaggccttgtccaaatgtcacctcttcagagaagccatccctaaataacctacttaaaatggtaccatccgtacaccctgtcagtgtctctctctttgtctgagtatcatggttgcctcattttataatttgtttaatctgagtcagaactgaagcatttatttccctataaaatgaaatctgggcagaacaaatgctattttatagaccactcattttgaagttaaacacaatatataaacaaacatacacacctttaaaaaaaacagtgctttggccaggcacagtggctcacacctgtaatcccagcactttgggggaggccaaggcaggcggatcacctgaggtcaggagttccagaccaccctggccaacatggtgaaacctcgtctctactaaaattacaaaaattagccaggcgtcgtggtgggtgcctgtaatcccagctacttgggaggctgaggcaggagaatggcttgaatactggtagcagaggttgcagtgagccgagatcatgaccctgcacttcagccagggcaacagaggaagactctgcctcaaaaaaaaaaaaaaaaaaatgtgctttggtgtatggttttcctttatcgttcttaatttaaaagtattaccagcctgggcaacatggcaaaaccccatctctacaaaaaatacaaaaattagccaggcatagtggcgcacacctgtagtcccagctacttcggaagctggggtgggaggacggcttgagcccgggaggtcaaggctgcagttagccatgatggtgccactgcactccagcctgggtgacagagtaagaccctgtctcaaaaaaataaaagcattaaaaagaagtgctgtatgtacaagaagtttatggttgtagtactagatagagtacaaaaaagaaaaatggaaataagccaagtgcccaataataggaaaatacttaaggaatatacatgtgaaaaaaacataatacaaccatgttatgttaatgtgttataataacatcataacgttataataatatagtaatttttaatatatgttaataatgactacatagaagcacaaaggtgtttatcaaggagtttttttttttttttttttgagacggagtcttcctcttgttgcccaggctggagcgcagtggcgcgatctcggctcactgcaaccacctcctcccaagttcaagcgattctcctgccttagcctcctcagcagctgggattacagatgtgtgccaccacacccagctaatttctgtatttttagtagagatgggatttcaccatgttggccaggctggtctcgaactcctgacctcattatctacctgcctcggcctcccaaagtgctgggattacaggcgtgagccactgcgcccagccagtgtttttttttttttttaagaagctgtaatgatagtaacaaagaagtccaacctttatattgcacaaatatttactaaccatgtagcatctatgtgcctgaccagccctgacagatgaggattcaggagcaaacaagactcgtccctgtgctttcagagcacacagggtagcaaagccactgacaagtacaggtgggattacagtgaggcataagagatggctcgggggagtacaggggccaggcagagcaccctgggcacagccctgaggctttccaaatgaaatgatcccaaaactcagacctgaagaataaacaggagctaagaagcaaaggagggggagataaacaggtatgaatcagtgggtgctcagggtgagaggcaagagaagacatgaaacagaatatgtgaactattattttttaaaaaactaaagtaacttctatatttgatggtagaatttttggtaaaatttatcttgtataaaatatgatactaggctgggcacagtggctcacacctgtaatcccagcatttggggaagccgatgggggagggttgcttgatcccaggagttcgaaaccagcctgggcaacacagcaagacctcctctctaccaaaaaaaaaaaaaaaaaaaatatatatatatatatatatatatgagagatactaaatgaaagccaaatactttaccaaccactctggcttctcaaagcttatctgtcctgtggctactacctctctttccttcagcctaacctactatctgaccaaacacgagcagtggcaggaagcaattttaacacgtcacacagatgcacacataactctttatcaggactgaccaatacacttcccatccccacattacaaatttggggccaaaattactcagacagagatgtactctccagtctctggctgacgtgctaccttattacctcgccccaattcccttcaggtgccaacagacactccgtgcctagcattccaagcctgtcttctttggtctacctaacttatctggcactattcctccccacaaattctgtacttcaaccaggttctctttactgaacgctgcgcataccatatgcattcctgcctcaggccgacccctgcctggactgtcctaacctgctctcccagtctgctattcaaacagcacccattcttcgatggcccactcagcttttcaatggatctttggtcaacttatttaatccacaccaatctctaacctgaaactgaactaaatttgttatgctaaacagtaagtacttggttaaattccgcttttgttctagaaatctctaaatgttgtattcttgcaaggcttccctcctaaattctgaggccaaagatagtaacttttatttcttttgtatcccactaacagcaacattaaacttggaaaacacacctcccacacctgttggctagctgacagatcctggatggaaagatgagccagagagcattcagtgccagttgcttttctctggaactgcgggttcaagcaccaagattaggactagacttatgtgctcctttgggacaggaaatggcatatgtactgaaacgcgagatagttaaaggacacccccccaaaaaaaattaaacatgaggaaaaacatgtgttcctaatgtgggcaaaccccaccatattacaagtctccccagtaccttctatactatgtagctaataatacaaataaataataaatctaatctatttgataaatgaatagatttaataccactaagagaaatatgaaggtaataggtataaccaacagcctagagtttaataaagctccaaggtaatccctgtatcaatttataagatgctaatgaattatttttacagtttttcaaatccttcatatagaaataaactaagccattttctaggaagaaaaaaggtcaggctttacttacagagtcttgctcttgttatccaggctgcagtgtagtagcacgatctcagatcactgcaatctccacctcccaggttcaagcaattctcgtacctcggcctcccgagtagctgggattataggcatgcgccaccatgcccaaataatttttttgtatttttagtagagatgggttttggccatgttggccaggctggtctcaaattactgacctcaagtgatccacccacctcagcctcccaaaatgctgggattacaggcatgagccaccgcacccggcccaggctttacttctttagggagacagggtggtaggggtttcataatgaactgaaaaaccaaacactgtgtccctttcatttggcaagaactccttttccaaagaagggactcagaaaaaatgaaattacttatataacgtctgagaaatattcttaaaagacaacaaaacatacagaaaggtattttggattcaggagaatacaacctcttccaaaaagagatttactctctactccctaggaactactaatgacatggaaaatcccactcaagttacatgaggtcacacacccacaataaaggtagctgcctgaaggtggtctgccaagataaacaccaacttgttaactccctaagtgctatgcaaatgcccaagatagtatatgcacacttaatgactctctacattgttggagcatcatgtttctactattactacagttctttcagtctgtattttagtggggtttttttcatatctgttccccacttttcatcatgacctccaggagggtagggacacatcttactcatctttatatccccaatgcctagcattatatcttgcaagagacactaaaaaaataaaattctgccaaatgaatgggcaagcccaaaatatcactcagataatcccttattaacagccaaatgcccaggggaagggagacttagatgacagcaccttcctagaaaatatggcctgaaattacagatcatttctacaacaagttacatttcacttactaagcaactggtctatcttttcagaataaattttacttttcatgatcagtgtaagtatacgggaagcatgattattctgaaatctcttcttttcaaactaaacacatagctcctggacacccacaggaatcatacgagaagagggagaggcagtagacattagtttcaaacctataactctttaagagtcaaacaaaagtagaaaatactaagaaaagaaaacttgtcagaaaccatttaaagacaaaggacaccatcatctcccagaatttatcatcaacagaacaggtgaagcttaacaaagataaattaggccgggcatgatagttcacacctgtaatcctaatactttggaaggccaaggtgggaggatcgcttgagcccaggaggtcaaggctgcagtgaactataattgcaccactccagcctgggcaacaaagcaagaccctgtctcaaaagaaggaaaaaaaaaaagaaaacaaaacaaaaagacaaagtataagagcgccttcttcacttaatgaagcccaagttataaattcttataacccattaagtttataattgaaagagtatcaagcatatagctttatctatgcacataaaaacaaacataagttcagtaattcataccagaaaccaggtaatcacaagtccaacagtttaccttatctttgaaatacactatgtagttggctaatttcacagtaatcaattcttacgggatcctcttataatagccactcaaggagaaaatttcaaatactgacctctaattcaatgtaatacaaataagaggtcttccatccagaattatatcaaatggccacaattcctttctcagtaacaccataaacaggctgaagctctccacaaatcttctctgtaagtggatcccacggtggttgtgacccggtgctgagcgcacatacagttactcctagacaatcacctcctaaaagaagacagatgactatcactgtgactaaatgaaacaacttcaaaaatgcagctctgccaactagtttcattagcattttccaaacaaaacaggtgtcacagacaagctcaaaatagtcaaactcctctctctttggtgctttagcaacattcaattccctaacacctcccccagatgctggattctttttaacagtgtcttacatcgggtatgtttctcaatattaggaaggtttaaagaagctgtgaggatcggatagcggaacataaagaagcaggaaggccgggtgcagtggctcacgcttgtaatcccagcactttgggaggccgaggtgggcggatcacttgaggtcaggagttcgagaccagcctggccaacacggtgaaaccccgtttctactacaaatacaaaaattagctgggcatggtggcgggcgcctgtaatctcagctactttggaggccgaggcaggagaattgctagaacccaggaggcagaggttgcagtgagctgagatcgcgccactgcactccagcctgggagacagaatgagactccatctccaaaaaaaaaaaaaaaaaaaagaaagaaagaaagaaagaaggctctattttgatactgggagcctaaactgaatgattctggagaaattcacagatggggctgaggctcaccttcatgacagctgtatcaaaggcctaaatttctaaggctcagaaatcactacaataagcctatcaacagcatgtgatactctccaagcattttgcaaccttaacatttccatcctttacagtactttgatatcctcaaaagatgtcttggatttcaaagccagtcccacaacaacaaggctggcaatcagcatcccagaaaactgcaaagaggttaagacccaagcaaaatggacttggggatgcaaggaatttgtcagcacctgtattctcctaagaagtggtaaaaatatggccgcttcctacaggaagaaactatgccaaataaccaaaccaaaagtgagaaaacctaaattatattaacttctcatgagaagaggcacttaaccagataactctgagtcaggaccgttcagagggcggaaagaaaggacccatattaactgttctaattacaagttactctttgactcttcagatcttatttccttgatgattagactggaataaacaatttgagggcaggtactataacacctgtcatcccagcactttgggaggccaagacaggtggatcacttgaggccaggagtccagaccagcctggccaacatggcaaaacctcatctctactaaaaatacaaaaaaattagccaaatgtggtggctcatgcctgtagtcccacctactcaggagaggctgaggcacgagaatcgcttgaacccagggggtggaggttgcagtgagccaagatcgtaccactgcactccagcctgggtgacaaagcaagactgtctcaaaaaaaaaaaaattttttttttttgagagagaaaaaaatggcctctgaaggctgggcgcggtggctcatgcctgtaatcccagcactttgggaggccgaggtgggcagatcatgaggtcaggagatggagaacatcctggctaacacatggtgaaactccgtctctactaaaaatacaaaagtaaagtcccagctactccggaggctgaggcaggagaatggcagagcttgtagtgagccgagatcgtgccactgcactccagcctgggcaacagagcgagactccgtctcaaaaaaaaaaaaaaaaaaaaaaaagcctctgaaatcatttcaggaactaaaagctaactctggctctctctacatctttatattaaagggtcctggacctgtgattgttgaggtggcagggaaaactgctacctgttcccattcctaatagaaaccatcttttgatgccattcccattgtatttttccacaaaaaatgtatttacagatttctgggactgaaaaattgctgaatttgttaaaagagaagaaaaaggtggcccagcaagatggctcatgcctgtaatccctgcactttgggaggccaaggtgggtggattgcataagcccaaaaattcgaaaccagcctgggcaacacggcaaaaccccatctttacaaaacaaaacaaaacaaataaaaaaaaaactggccaggtgtggtgacatgcacttgtagtcctagctactgccagaaggtggggagggaggggtggctgaggtgagaggatggctgtcacccaggttggagtgcagtggtgccatcatgtcacactgcagcctcaacttcccaggctcaggtgatcatcccatctcagcctcccaagtagccagaaccataagaatgcaccatcacgcccagctaatattttttattatttttgtaaagacagggtctccctatgttacccagactgtcttttattccccgcaagacggagtcttgctctgtcgctcaggctggagtgcagtggtgcaatcttggctcactgtaacctctgcctcccgggtttaggtgattcttgtctcagcctcccaagtagctgggattacaggtgcctgccaccatgccagggtaatttttgtatttttagtagagatggggtttcatcatgttggccaggctggtctcgaactcctgactttgtgacctgcccgcctcggcctcccaaagtgctgggattacaggtgtaagccaccgcccccggccccccacttttttttttctttttaggagacaaagttttctacgttgcccaggctggcctcaaattcctgggccaaagcaatcctccagcctctgccttccaagtagctggaactatagacatgccacatatccagcatgcatttttatattttcaaggtatttccatatctatttgttcatttcagtttatgtactactgtccctatttgacagctaaggaagtagggcacataatcatacttcaagcccatagttcaggtggaaatggactctaggtcttctcatgccaaccaggagtcatggcttatttttcttatgcacagaggctatcacagttcaggacattttagtgaagccagaagaaacaggaattacatggccgggcacagtggctcacgcctgtaatcccagcactttgggaggccaaggccggcagatcatctgaggtcaggagttcgagaccagcctgaccaacatggagaaactccgtctctaccaaaaatacaaaattagctgggcgtggtggcacatgcctgtaatcccaactactcaggaggctgaggcaggagaatcgcttgaacctaggagacagaggttgtggtgagccgcgattgcaccattacactccagcctgggcaacaagaacgaaactccgtctcaaaaaaaaaaaaaaaacaaaacaaaacaggaattatgtagcatatataaattatgttttaaactactatcatataacctagtagttctctccaatgtaatcaacatatcccttagtaaaatattgtttctagagttataaatagtattctgccataggccacccagatctcagatctcatcttgattcaaatgggcactacacaagaatacatggggtgtttaatttatattcattttgttatttttcaggacagtgcctctaagccaggaaatagccttcaagtagaagtggaaacatccacaggctaagttaaatgctatattcaagccactcaatgttcacagtcttattctaagtaatcaggccactgacccaagtgtcagtcagcatcatcttcaatctccctatgaaaagctgaaggaaaagaaaatctaattaaaagcccaagaaaaaatccactttaatcaaaactgcaactaaaaggcaaaggaactttaaggtaggaaaaaaacttaagacatgaaaaaattaggaattacaaaaagggatgtcaagagggaaaaagaggagatactgcgattttttttttagaatagtcaaatacagcagtgagaagagggaaagagtagaataaggagtttgatctgtaaccatcaattaagattaaatcactaacttcagcctgatactgtaatttaaatgactaaaagcaagccaatgaaaaatatgactttccaaacagaagaggcataaaactatagaaaaataatgaaatacgaagggttaaaatacagagaaccacaattttaggaatattttactatgaagaacaggaaactgaatgtttaagtatatataaaagcaaaaggaaggaaacaatacatttagttccatcaaaatcaacagaaaaccatctactatgagcctccgttgacaacttctcccaagtgaaacaatacagatgagggtcacagacttagccagtgataggacctactactctgtaatcatccatgggcaacagacaagggctgtcagaggacccaacagacggaagccagtgctagaagacagaactagtttcctcaaaaaaaaaaatcagtcaaagccaggaacggtgtggctcatgctgtcatcccagcactttgggagcctgaggcaggaggatcacttgaggccaggagttcaagaccagcctgggcaacacagggagaccctagaaaaaaattaaaagttgttttaattgaaaacaaatcagtcaaacaaattactggtatgctttaaaaataactgtgtgacagaagaattacttgaacccaggaggcggaggctgcagtgagctaagatcacaccactgcacaccagcctaggtgacagagtaagactccgcctaaaaaaaaaaaaaatcagcatgaatcacaaaagaaagatacacgccagatcattattgttcttaaggtgaagcaatttagtcatcttagcgtaaacacacatatgctttagtagacatattaagaaatctctggaataaaaaatgaccagactaactagaaagcagttgaatcacccacctaaaaaaccgacttactaatttaaagcacttaccatattttaaaatcttttttaccttagaagcctttttcacttcaggttttatatttaaaacattttccaaaaaagtcagggtttgtgtcacctcttgcagttggaaatcagtttcaactgtaagttactttaaatccagtaccaaagcactgagattccaaagcagttgtcacattaactccatttcagaatccaagtacctgactgcagtctctagtaagagaagcctctaactggaaaagtaacaggaaaagttgtactttctcatttcaaatttggggcctactatgctgaatgaagaaagagagaacttcaagttcagcctaataggcatttactacaaataatatgacaatggttggcactcaattttaaaataaatgactaggccaggcgcagtggctcattcctgtaatcccaacactttggaaggccaaggtgggaggatcgattgaggccaggagtttgaaaccaacctgggaaacatagcaagaccccatttctataaaaaatttaaaacttaggccggatgcagtggctcacgcctgtaatcctagcactttgggaggccgagacaggtggatcacctgagatcaggagttagagacaagcctggccaacaaggcgaaacccggtctctactaaaaatagaaaaaaattagccaggcatggtggcgagcgcctgtaatcccagctacctgggaggctgaggcaagagaattgcttgaacctggctggggaacagaggttgcagtgagccaagatcccgcccctgcacaacagcctgagtgacagagcaagactccgtctcaaaaaaaaataaaaataaaaataaaaaattacccaggctttctgctgtaggcctgggtggctgctataaaaacgggcaagttcatgaaacctggaaagtggtgctgttctggccagacgctatgccagatgctactcaggaagcaaagatatcatcatgaagaacactgatgatggcacctcagatcgcccttacagccatgctctggtggctggatttgaccactatccccacaaactgacagctgttgtgggcaagaagaagatgaagaagagtcaaagatcaagtcttttttttctttttttttttgaggtggagtcttgctctgtcacccaggctggagggcagtggcgcaatctcggctcactgcaacctccacctcccgggttcaagcgatcctcctgcctcagcctcccaagtaactgggattacagacgtgcatcaccacacccagctaatttttgtatttttagtagacatggggtttcaccatcttggccaggctggtctcgaactcccaacctcaggtgatccacccgcctcagcctcccacagtgctaagattacaggcgtgagccactgtgcccggcctttttgtttttgtttttgttttgagacggagtttaacccattacccaggctggagtccaatggcagacctcggctcactgcaacctctgcctcccgggttcaagctattctcctgcctcagcctcctgagtagttaggattacaggaacccgccaccacgtccagctaattcttgtatttttagtaaagatgaggtttcaccatgttggccagactggtctcaaactcctgacctcaggtggtccacccgcctcggcctcccaaagtgctgggattacaggcatggaccaccgcgccccgccaaagatcaagtcttttgtgaaagtttataactactatcacctcatgcccataaggtgctccgtggatatccccttggagaaaactctcatcaacaaggatgtcttcagagaggctgctcttaaatgcaaggttactgagaggccagggtcaagttcaaagagaggtacaagacagtcaagaacaagtggttcttccagaagctgtggttttagatgtttcatttaggttattaaattttttaattaattaaattaaaatcaaaattagccaggcatggtgacatgcccctgtaatcgcagctactcaggaggaggcttaaacaggaggatcgcttgagcccaggaatttgaggatgcagtaagccaggcttgtccaatccgcagcccaggacaggtttgaatgaggcccaaaacaaattcgtaaactttcttaaaacattatgagtttttttgtgattttttttttttatttttagctcatcagctatcattagtgttaatgttttgttttggttttggtttttttgcttttttttaagatggagtctcgctctgtcacccaggctggagtgcagtggcgcaatttccgctcaccacaacctccatctcccaagttcaagcaatttctccctgcctcagcctcccaagtagttgggattacaggaacccaccaccacgtccagctaatttttgtatttttagtaaagatgaggtttcaccatgttggccagactggtctcgaactcctgacctcaggtgatctgcctgcctcggcctcccaaagtgctgagattacaggcgtgagccaccgcacctggccagtgttggtgtattttatgtgtggcccaagatatttcttcttctcccaatgtggcccagggaagccaaaagattggacacccctgcagtgagccatgatcacaccactgcactccagcatgggctacagagtgagactctacgtcaaaaaaaaaaaaaatacataaattaaatgactaaaatccagaaattgcagtctttaaagagtaaattttatagcatgtgaccaatctcaatgaagcttttattatttaaatgtgttttaaaaataaatgacactcagaacgaagtattccatataacataaaccacctgtctctatgactgagagaccacgaaagtatatcttaaaattctgatatatgaaaagatcatcaacttcattcatggtcaaagaaatgcaaattcaaatgatactgtaggagccaggcactgtggtacacacctgtagtcccagctactcaggaggatcacttgagcccaagagttaagaggctgcagtgagctatgattgcgccaccacactccagcctgagaaagagagattccgtctctaaaaaaactttgtaagggccagaagtggtggctcagacctgtaatcccagcactttgggaggccgaggcgtgtgatcacttgaggtcaggagtttgagaccagcttggccaacacagtgaaaccccatctctactaaaaatacaaaaattagctgggtgtggtggcacacgcctgtagtcccagctattcgagaggctgaggcaggagaaccacttgaatttgggagccgcaggttgcagtgagccgagattgcgccactgcactccacctgggtgatacagcaagactcagtctcaaaaaaattgtaaggccaggcatggtggctcacgcctgtaatcctagcactttgggaggctgaggtaggtggagtgcttgagtccaggagttcgagaccagcctgagcaacatggtaaaaccccgtttctacaaaaaatacacaaattagccaggtgtggtagtgcattcctgtagcctcagctactggagggggttgagatgggaagatcgcttgagcccaggaggttgaggctgcagtcggccctgatcgcgccactgcactccaacctggacggcaaaacaagaccctgtctcaaaaaaaattgttctttttttttttttgagacggagttttgctcttgttgcccaggctggaatgcaatggcacagtctcggatcaccggaacctccacctcccagattcaagtgattctcctgcctcagcctcctgagtagctaggattacaggcatgtgccaccacgtcaggctaattttgtaattttagtagagatggggtttctccatgttggtcaggctggtcttgaactcccaacctcaggtgatctgcccaccttggcctcccaaagtgctgggattacaggtgtgagccaccgcgcctggccaaaaaaaaaatgttcttaatgaaaagatatcattgtacacatttccacctatcagattaacaaagattataaaatttcataatatccagggatggtgagaaggaaatgaaaaccctaaaatattctgtgcatacacaggcatatctttgggggcaatttatttacagctttcaaaataaaaagtaaacataacccactgattcagcaactctacttaagagcttatcctatacacatacttgtacaatagtacaacagtacagatatgaggatgcgaaccaaagagtctgagacaatttaactgtccatcaatgggaaaagtgaagtttacatccatacagcgtccgattatgcagttgttttcaaaaacaaacctgagttataagtattgaattgaaaaatatgtttggaatttttttaaattcaagatactatctatagtatgcttatatatgcagagaaaatgtctggaggaatactgaattgtgtgaaagtgattacaatgagtatatattaattttataattataatttgtatttcatttgaacacatgaagctatcaaataaagtcatttaaccctggtgttaaatcagcctatgctatgatcccaacctatctttccagtgctctatggttctggccaaaccagtctgttccttctttgagaaaccagtcccaaggactccctctccaaaatgctcttactatgtggtctgaacagctacccgctacagcttcaaatacaaattacctgagttgaaaaaactacgcctgcctgcatctgctataaaacattttaaaagagatcttttttaaaaagaaaattgaaacacaatttaataatccccatcatagaagcagcaaaagtactcaccatttcccaagttttccaggctctgtgcctttgcttcatgcaatttcctgcctcaaatcctcttagctacttatcacatgtccaaatcctgccaatccttcaaaacacaggtgacacaccaactcctacaccaaatcttccctaatgcccccatccagagctgattctctttcttaaaccacagtatcaacaccttttgaggcactttcttctacctagtactcagttgtgtacatgtctcatctttcccattaatgagaaaatcatcatgggcacaatctctgtcttggtcattttgtatgccctattttgctacattaattaaacttgtatttcactaaagcatataataaaaagaaaggggcaagaatctaaaagttaaaaaaaaacaggcttttagtatgcattcatttgaattaggtcttgtttacctgcaacaaacgctatgtaagaaaagtacgaaaggtaagatccttccctctccatccagctgcccagggccctggtatgcctcctgaaaaggcaataactatgggttctaagaagtccttggacactgcaacttcttaacacattcaggacattggaactaagttgacaaaaagaatttataagttatattttaaaataaatttatttatgacaattacacaattgcacagtttacatgctgaggcaaaatatgacgttcaatacatgggaagataaactgtataaaactatctgagctgtgaaaagaagtcactgttcggccaggtgcaatgacttaacgcctgtaatcccagcactctgagaggccgaggcgggaggatcacgagatcaagaccatcctggccaacatggtggaaccccatctctactaaaaatacaaaaatcagctgggcatggtggcacatgcctgtaaggtcccagctactcgggaggctgaggcaggagaatcgcttgaacccgggaggtgaaggttgcagtgagccaagattgtgccactgcactccagcctggggacagagtgagactctgtctcaaaaataaaaataaaaaaaaagaagtcactgttcattatcgaccatcacagaataaatattccaaggctacatataatcccaagttactaaagttttgaaggggaaggttggtctggttttctgtttttttgagacagagtctcactctgttgcccagactgaagtgcaatgcagccttgacctcccaagctaaatcaattctcccccctcagcatcgcgagtagctgagactacaggtgcacaccaccatgcctggttttttgttttttttttttagagactgggttttgccatgttgtccaggctggtctcaaactcttgggctcaagtgatctgcctgcctcagccccacaaagtgctgggattacaggcatgtgccactgtgcccagccaactaaagtttctgtagcgtcaaaagtgtttaaggattccacaaagactaaattctcactaagctatgcaaacaaaggtgctaaaccattccaaccaaaatatgaaagaaacatgtagatgttttataaagctagatttcctaagaaatattaatattaatgaaaacttttctcaatatattaatagaaacaagatgtctgcacatttttccagtttatagatgttaaaaattaagtctcaacaaggtctttaatcatatgtgtataatcctaagtgtataacaacttaggaaatttcagtaattattcctacaataatgaatcacataaaatatatatatgtacacatggcagattatgctaccaagatcagaatgttcaaatcagaaggcagttcatcttgttagaaaatttacccagcaataaaaatctgaagccatcgttagatcaagacaaatttcagtgaaaattctatactggatactgaactggaggtggggggttattcttacaaataatactgaaggattacaataatactgtcaaattatcaaatgtgttaatactacattagccattctactggtatttatggcacaaactgccagatgtagtgcaatactgattcttcccttcctccagagtaagagaacccctgatttttgactaggcacatagtaatttccagcacagaatatactttctagcttctcttgcagttatgtgtgaccttgtgattccgttataatcgaagggacacagcagaagcgatatgtacaatttctggaaagtatcttcacaagaagggagtgtgcccagcttttgccttttcctccttcctgctggtgagaatgcagaactgatgtgagaaagtggagaagccacctctgacaaaaaggaaagagttacatgttgaaggctgggtcccctaatgagcatgaaggtagcatactggttcaggactgtctatgagatacatgaaagaaaggaaacttctatcttgtttaagccattgttatttttggtttctaccactcactgctgaatctaatcctatctaacacacggcaaaattatagagaaagagtactatatttattaaactttactttttcaaatgattttttttgttttgttttgtttttggttttttttttttttttttttgagacagagtcttgctctgtcacccaggctggagtgcagtggcgtgatttcggctcaccgcaacctcggcctcccaggttcaagcgattgtcccggatcccgagtagctaggattacagatgcccgccaccatacccagctattaaataattttgaatacatagtttaaacttactaggattaaaataaactcattttggggggccaggcgcaacagctcacatctctaatcccagcactttaggaatccgaggtgggcggattgtctgaggtcaagagttccagaacaacctagccaatatggtgaaaccccatctctactaaaaatacaaaaattaagccaggtgcagtggctctcgcctataatcccagcactttgggaggctgaggcaggtggatcacttgaggtgaggagttccagaccagcctggtcaacatggtgaaacctcacctctactaaaaatacaaaaattagccaggcatggtggcaggcgcctgtagtcccagctacttgagaggctgaggcaggagaatcacttgaatcccggaggcggaggttgcagtgagcagagattgcaccactgcgctctaccctgggcgataagagtgagaatccgtctcaaaaaaaaaaaaaaaacaaaaacaaaaattagtcaggcatggtggtgtgtgcctgtagtcccagctactcagaaggctgaggcaggagaattgctcgaatctgggaggcaaaagttgcagtgagccaagatcgcgcggttgcactccagcttgggcaacaggagcgagactccatcacaaaacaaaacaaccttcttttttttttttttttttttttttgagacggaatttcacacttgttttccaggctggagtgcaatggcgcgatttcagctcactgcaacctctgcctcccgggttcaagagattctcctgtctcagcctcccaagtagctgagattacaggcattcgccaccatgcccagctaatttttgtacttttagtagaaatggggtttcaccatgttggccaggctggtctcaaacttctgacctcaggcaatccgcccgtgttggcctcccaaagtgctgggattacaggcatgagccactgcacccggccaacaaacttatttttgattattcaaataactaagctctaaaatgttttttctacactatatttgaggtataaaattgttattatcaataattttttggccaggcacggtggctcacacctataatcccccagcactttgggaggcagaggtgggcagatcaccggaggtcaggagttcaagacctgcctggacaacatggcaaaacccatctctactaaaaatacaaaatttagccaggtgtggtggtgatcgcctgtaaccccagctccttgggaggctgagacagcagaattgcttcagcccaggaggcggaggttgcagtgagctgagatcgtccagcttggtgacagagggagactccatctcaaaaaataataataataataataacttcctaagtatgccttggggtcaagcgattaagccaaatctcccttatctctacctcaataataccatacgttaatattattcattcatttaacaaatgaatgcctactgtactcttcgcaagcaaggtgcactgaagtgaccaaagcagatgatgggcctcttcctccgggagtttgcaagccagtatcaatgcagccgaggcagtagaagcctctgcttccctcttctctagcctccaagttcatcactcccctgctgtcatcatattcttgcttcaggctacaatatgagagtacaatgtgactagacttcagctttgctctgctaatataatcacacataatcatattcctcaaagatgacactcctgttaccaaaattagcatcagcatcttaccaaaatgccatagcagttatcactgatggtgggtcagttttccacatggcaaatcttatttatcacaagatatctttccctaactgtaccttatggggttctcttatccttacattttgttgttgttgagacagggtctcactctgtctcccaggctggaaagcaatggcacaatattggctcactgcagccttgacctcctaggctcaaacaatcctcccgcctcagccttctgagtagcttgggctacaggcacgtgctaccacgcctggctaatttttaattttttttgcagagacgggggtcttgttacgttgcccaggctggtctcaaactcctggtctcaagggagcctcctgcctcgacctcccaaagcactaggattacagttgtgagccaccacatccagctttatccttaaatttgaaaaatactttgcagttccgccgccccccacccagtcccagggactatactgaaaaatgtcagaatgtagggctgcttaggcagatagccaaatatttttagttactcctcacaggccattacatcaacctcattagagatttgaagccagaccaacaagaggtcttgctctttccctcaattgcctttcttcttgaatctctctaagaggatggaacactaatcggattgggtcaagagtccacagtactgattgaaccctgtgtacaactatgaagatcaatgaagattaaaagttacacaaatcttgattcaagtgcaagatagaaaaaaaagtcacatacatgtaagagtttgtgttcttgttcttggtcatttcactcttacacactctaaaagactaattgttggggtcttctgcaaagccatcaaccaaagagtagtaagacagtgaaatttaggaggatgagagagcccttgactagtcctggagcttaagtaatatgatgtcaccctgtttactacacaaatttacattggtattttggccaaaagcccaaattaataataaagtaatacttctaatttcctacttgccattgttctacttatataaatctccttcagaggccaggcgtggtgggtcatacctgtagtaacagcactttgggaggccgaggtgggagaatcacttggaccctcaagatcgaggctgcaatgagccgtgatcatgcaccactgcactctagaacctgggcaacagagcaagaccttgtctcaaaaaaaaaaaaaaaaaaaaaaacctccttcaggaagctaagccatgatattctgatcatttattaacaccccaaacttcaaactgtactattactctattcacttggtatttaatcacatattgtttttagcatttcctatattcaaggaatagcaaacattttagaattggtacctcaaagagaatctattcaaaccatctagagttcacccattgtctcctgcagatctcctgattattataaacaacaaagagaacatactggaaagctagatctctagatgacaataacagtaataataaaaagaggctgatatttattgaccatttactatgtgccagggacctttttaaatactttatatgaattaattactttggtcctcacaacaaacccacgagtattattattatctcaattttacagatgaggaaactgagacccagaaaggtaaataacctgcccgaagtcacagagttaataagcagtgggctgcagattgagtctagagctcttaacaacttttctgcaatagcataatagttagttaacggtagacaaatactacagcttggtaagttctgaaacttagggccaaaaagatattcaaggaggcaaaagacaacacagatctgcatctccagagagagattttcaaaatttgaggctggaccaaattggtgtttaaacaaagtattgagggagggctgggtgcagtgactcacgcctgtaatcccagcactttgggaggccaaggcaggcggatcacgaagtcaggagattgagaccatcctggctaacatggtgaaaccctgtctccactaaaaaatacaaaaaattagtcaggcatggtggcaggcgcctgtagtcccagctactcaggaggctgaggcaggaaaatggtgtgaacccgggaggcagagcttgcagtgaactgagatcacaccactgcactccagcctgggcgacagagcgagactttgtcttaaaaaaaaaaaaaaaaaaaaaaagtactgagggagaggttaatggatagaatcatgaggaacatcaatatttaacataaactcagcacattttaggtcaaaatgataatacagtaaggtagtatttgtgtatattatagatatacaacatatattacaaaccaaaatacataatgattatccctactccataggaagtagaacataatttaactataattactataggtttatggtagcatctctgttggctgtagctaagatttttcatgctaagtccttaggcaggaatgcaacctataataatgttactacaagagacaataatctgctttaaaatctttcttcagacatgctttccagggaacagacagttgtgaaacgaaagtcagcctaaatagatggaccatatttcaatgactctaagactcataatgtttgttttacatttgtatagtatgccactggaattaggaaaggtctcacagaggttaactggcatttttttcattcttagcagtatacaaaataataattcattttacaaatgatggcatcttggagtcaataaaatgtttttcagaatacatctaattttaagtgtgaacacacatactgctgtagtcacaggaaaactttctgccttcaagagatgtataatctaataaagagaacataattatctctaaaatataaatggaagtaataaacattaatacaagacatgaagtgatcaaatgagtgagaaggttataacaagaactgaagaaaaggtatttaagtggtaggaaataaaagtggccaaaccaaaaaaacttcaggcactgtgtcctgagcacagtttgttgtttttgtttttgttgttgttgttgttgttgttgttgtttgagacagagtcttgctctgtcgcccaggctggagtgcagtggagcgatctcagctcactgcaacctccgcctcccgggttcaagcgattcttccacctcagccttccgagtactgggattacaggtacccgccatcgtgcccagcaaatgtatttttgtagagacaaagtttcaccatgtttgccaggctggtcttgaattcctgacctcaggtcacccatccgccttggcctcccaaagtgctgggattacaggcatgagccaccgcgcctggcctaaagttatttttaaataaaataaatccagacatagtggctcatgcctgtaatcccaacactttgggataccaaggtgggtagatcacttcagctgagaagttcaagaccagcctgggcaacatggcaaaactctgtctctataaaaaatacaaaaattagctaggtgtgatggtgcatgcctatggtcccagctactcaggtggctgaggcaggaggatcatttgagcccgagggggtcaaggctgcagtgagcagagattgcgccactgcactccaacctggatgacagagcaagacctttcctcaaaaaatttaaatttaaattaaaaaaaattaattttacaggtgcatctcaaactgtgttctattaaactagaatagtagtatctatcccatgagtatctcatgagaaagaaacaggtattctttggggtaagggaggaaaatgaaaaacaaaaaccctctatagtataaaatgtttctgaggctttaaagagctcatgtgcattataaacgtatttcaccccacacttaaaatacttgcagcatattaggaagccataaatacagttcgggaaacactgacttgggtaggcaggtaggtagacaggtagtcagtaggcgggcagagtcacagaaaataaaaggagaataagacaaatgtaataaagtgataccacctaaaaaaaggatcataactgactacgagttatgactatgaagtctcttgaaggaaaataaggtgttagaataagctatcaaaatcaacaatagccgccaggcgcagtggctcacgcctagaatccacttgtgtggatatacttccccagcatagccaggtcctgccagagaacatttccagtgcctccccaggcagttcacacagacagacatatgcccacatgctcatctgctcacactccccctgaactgtattcaccccacacacactgagtgccttcatcactgtactcccttgcttcccaccccagaagcaggaagaaggtcaagaatcagacctttggctgggcatggtggctcacacctgtaatcctaggactttgggtggccaaggtaggaggatcacttgagcctaggacttcaagaccaacctgggcaacatgacaagacttgatttctacaaaaaaaaattagccaggtgtagtggtacacacctctagtcccagtcccagctactcgggaggccaaggagggaggataacttgagcccaggagttcaaggctgcagtgagctatgctcatgccactgcactccagcctgaacaacagagcgagaccctctctcaaaaaagaatcagacttctgggagcctagggaacatatacaggtgccaatgaatgtgtccgtgcatgctctgctaagtgtgtgcatggctgcgtgagctagaatgggtttttgtaggaggagctctgccctgctgctgcaggactgtctgaagatgctgcacagccatgcttcctcacaagctctcttttaaggttagtccaggccaaccacattaatattgtcccctttggggtggtatatttattgcaacacacagcctggacattcatatacagggccatggcactagggtaaggcgccacaaactcctcctgctgaggaggcaacaaggtatctggtcgctaaagctgggtgggacccatatccctgacagtattccagtatgtatgaggcactgcagacctggggtttttgttcttaggtgaggcctggctcgtacggcttaaatttctgttctacttttccccaacttgagatgactcggaagactttctgttccttgcaatgaaaaacagcctaaccaaagtccttaaaagtcatgtatataactactttaaaattaagataaaacccatggcttcgacttctgatgcaaatacccaagacaaatagggtatgaggattcctcaaataccgagtggtttatgaattagaggccacatcattttataactaaccatataaggaaaattttcacagttaaatatattgctcacacttgctgacatactggcaaattttaccagttaaaaatatgccgtgtgcagtggctcacgcctgtaatcccggccctttaggaagccaaggcaggtggatcacttgaggttaggagttcaagaccagcctggccaacatggtaaaaccctgtctcttctaaaaatacaaaaattagccaggtgtggtggcacatgtctgtaatcccagctactcgggagactgaggcaggaaaatcgcttgaacctgggaagcaaagttgcagtgagccgagatcgtgccatcgcactccagcctgggtgacagagcaagactccatctcgaaaaataataataataataattttacactggcacagaccactttaccaaaaaaagcatcttatattaactgtactctctgacctagttacctaatgtacagacacacagtacatcttatattacttggcacaccaacaagttagctatacaaatcacaattccaacccaaacttgaagctagtaaatatatttagtatttgaacttgagttgtgttcaaatgttcattaaattggcctatgcaatcttaacaatgttctaacacatatttaaaatgctcatttctcctccattatttaaaaaaaaaacacacacacacacaaactataactctgttagacaagaaaccaaacataagccaaaaggctcggcaaaatcacacttaaataggacaaggagagcttcaacttcagaataattatcaggataccaatcacacaaatatgattcaacaatcacttaaatatcattcaagaggaattcctggtagtaaaaaaagaaatcccgtaattaactagagcacagcattatcagaaactgattatgtaaaacaatagcttttctttcaggatgtgtgtatgtgtgtgtaacgaagttcacagctaggttacactaatgactcacttaaacatttgaattttctgctatcttaacctttaaatcgactgcaaaagtagctgccaaaagtagcttagtaggaaagcatactactctcaaaagaacttggtatgtccaacttattttactacttaaattttttttgatcactgatatttgaaactaatttttaagtaatgaatgcttactaaatccatgataatattcagcatatacaggtttttagaagggcacagattatattcttatatgtgtgtttttacagcacctggaacatttctgttcagtatctgttcagtattacacataattattgcaggacctgacagtgtttactatcctattttttcctttttttttttttttttttagacagagtctcgctgtgtcacccaggatggagtacagtggtgccaatctcagctccctgcaacctctgcctctgagttcaagcaattatcgtgcctcagccccccaagtagctgggattacagccacgcgccaaagtgccaggctaatttttgtatttttagtagagacgaggtttcaccatgttggccaggctggtctcgaactcctgacctcaagtggtccactcgccttggcctcccaaagtgctgggattacaggcgtgagccaccgcactaggccttactgtcctattttttaaaagctttttcgactgaccagtaaatcaaagttgaaaaggtaactggtacattttatttcttgatttggattacctttttgttgtgaattggttctcagttctagtttccttgtgacaaaacactgatggagaatatattgaactgaaatcccctgaatccattcccactgagaaaataatacatttgaactgttcacatttcattgtaaaagatacacaactttagagattactcttgaagttttgaaagtaaagtgaatcagaagtcacattcctagaagcagtcagtctggaacagatgtttatcctacacacccagtcccctttaccactgcaaacctctctaatagttcattacattagaacaactgagatgggccaggatttgtgaaaataaaaatcctttgagacatttattaagcagattatctctgaaactgcaccttagtttacaagcctttgggcaacaatttgaccctcttctatgataatttgtgtacacactcatttcacattttctctggcttccaattttaaattctttatctaatccatacaataagtcaccctatcagactttataagactactgaaaacaacactactgcaatgcaaggccactacatttgcaaaattgccgattttagtgagatttccctccttcaactcctcctctacccctctacctggtttaaatcccaagaaaaacctctgtccagtgctacaattttactttccatagagtaggtttatttgattttttattaatgatactaaaaacttttttaaaagactgctggtgtatatagtttccaatactgggaacagaaataaaccctctggtttaatatttcaagagaaattatctcataaaagatgagaaggtatcattcaaaggagtcctgggaagtcacaaagtgtaaatacttctggtaacagaacaaattaatgtcgaagcacaaccagtaacataataatgcctcaatgcaaccgtgcctgtcaaaggacatctgtattagcagctcggggaagtggcatttgcagaaaggcacaacaactgcgcttaaaagaaaatcattaagcctcagccattaatcccctcccccatcctcttcgtctggatctttccaaacaattaaccagtagaaggtgctattctgcaacccacatgtattcacaccaacctccatccttgggccacagctgggtttatcccaggtggactagcctattccctgtccagtattcaaaggagccccctaaacagaaaaccagatcttttcttataacccttatttacaaaaacaacattgacagctcaattgccagcaaacctgaccatcaaaccatcacaccactaaaaacatgcaaacatcatcttgctaaatattaacctcaatacaacctttataatattaatcaataaaatctatttctatctagaaagactctgctcacattcactactaagactcaagtgaacaaatcactgtccccaacaaaatcagggtcaatgagaaatacaaaagcaatgagagctgaacgtaaggccacaacatataaagagggattttatctttacatatacaaaaaagaaagagcagcagaaaccacggctgcaaaaggaataaagggaggcagagagaagagaagtctctgaacatgtttttgagtgtcctttagtttccaatgcactcttctgcctcacaaggttgcaaaaacggccaggcatgagatgggtggaagaaagctgtaacagaaaagcaccctcccttcccccatcttctctcttctctcccaaaaagagctgtgtttgtctgtgcaaacctagtcccaaatatgggagagagagaatgaatgtgtgtatggaagaacaatgagccctcagcttggtattgtgtgtgtgtgtatgtgtgtgtgtgtgtgtgtatatgtgtgtctgtctgcctctgcctcttttcccttcgacctcaacaacaacagggagagctggaagccagctttccacccatcccaggccatcaaaatcaaaactggttgataatttacagtagtattaactcagcaagcaaatccatggaacaaaatatcaacccaaagatgattttattattgtacagatccagcttctctcccctcccccaacagactgagactaaaaagaccagtgtacactagacaaaaaggtctctctttaaatggaaagcaattatgaaaactgtttcaaatcttagatgcatcaattcctgctatattaaaatgtctattttgtaattcaccaagttcaccctcttactagttatctttttttgcgtttaaaaattcgctgtgaagaaggctatttcacgattcatacaaaactactttctaaatgtaccttaaaaaagcaacagatactgaaacatttaaagcacccagtttctcaaggacccattttacttaaatcaatgtttgaagtctgtaatccagaaaaattgtaagcaaaccttggaaaagagacagaggaaaatgacaattcaacaatgaatcattctgttttcctttcaacaacttctcaagcaaccagtttcaaaggaagcctgcaacacttttcccccctcctagcagacacacatacacacgtgtatgtaaaactacgaatctttccatcatcttaaaaattagtaataaatagaagccaccctccttcagagagcagaactaaaacaggatagtaagaattctattctgctgcaagtgactttgggtttcataattttctaatcacatacagctgagaactagagattgggagcacaaagaggaaatcttcccccaatgagaaaatgatactttaataataaagtcctccccccagcaccccgaaatccacaaacattcaagaaatttacagtttcagtccttgacttccttcccttccagtttcagccaataatgtagtcacatgaaatagtttaacctcaaacaagtagaacaagagcatgaataagaggccaagagagagcaggggtcagaaggcacgcaggaacggtcacctggcccggacaggaccaaagaagtgccctgccctcgcccgactcccctcgacttcggcttcgaccccagccttttcttcctgcctccccccgggcgagtgactgctttcacggccgaccctctctgaccaccaggacgaggggccaaaaaagaaagcacacgacccggcgcgggcaagttggacacttaccttcccctaaagcgctacaccatcaatagtgaggtgttcgcggcccagctccggggaaagtggcggggatggggcgggaggccgcgcggaggctgcggggccgcggggcgcagggccgagaggggcggcccgcggggaggcgacgcggaggggctgagggggcttccctgccgtgacctttcctgcgacttgaacctaggctccctcctcctcggtcgggcagatctttcagaagcaggagcccaggatcatgtctggttttgttttccgagggcgagggggctccctgaggatgatggtgatttttttttttttttaatcctcaactaggagagaaaatgaggcagagacaatgtggggagcgagagaggggaaaaggacgggggaggaggcggggaccgaggcccagcggggcgagcgtctcggggtgtgcgggaggctgaggaggctccggagcgcggagggttgctcgcgagcgtct

SEQ ID NO: 133 - DNA, 465237 bp, Homo sapiens; identical to SEQ ID NO: 132

SEQ ID NO: 134 - DNA, 624136 bp, Homo sapiens
aatcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtgagtacccacccggcggcgggtccgcctgtttcctgacaccgaaggggaatgggggggtgggtgggagcgagggacagatagttgctcgggggtcgaggcgggggacgcctcgacttttcgagataacaggtttgtccgattccccccacgcccccaacaggttaacggagtttgttgttagacgctgtgtgtgtttgtttactggagaccctaggcttcggccgccgggaggggagtggaggaaggggcttcttaaagatgagtgggggagggatctgtgctcactttctccaatacttggcttggagggtcagttttcctgtttgcggggtgcttgaattcttggatgagaaaaagggctgacttggggcgggagccgctgaacagaccgattcctgcggctgccgggctccccctacccccaccccacccccaccccccctcccgtcacgcgaaagggaacccggaaggccattcggactcccagcctcctgctcgcctcggggtcgctgctatccgctccaggcgcgcagtcctccagcccaagagggaggctcggccaagtcggcccccagccttggccttcaggtaaccccggttcctccttcaaagtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagagccagatttggaaaatcctttcctcttctctggctccatggttcagatcagaacctggcgttgggtagggtgcacgctccaggcggaggatgacgggtgtctgtacaagcagccttggggaactgatttgataggaactcaccccgcaactccctgccgttttgtatttctcttcatgaccggtgtttgacaaaatttctctgggaaatttttgccttattttaacagagcctgggatgtccaggattgggtatctaataagaggaaagcgaggggtccgcagaaggtagtacataagcaataccaaagtgcagatttcttggtttctaatgatgcacagcgcgggcagcccagcctgggtagcccatgctggtcttgaaggaccagtgaagtccagcttcgcagcagcgcgatggcgggcttcatctgcctgggatgaagacccccgtagcctcgggctgacagctctggcgagaggggtggacaatgtgtgcctttgcagggctgggtgattgaagacttccaagtcccttccaagaggacttggatatgtgtgtgctggggggagattctctgacctcagggttgattctctgacagcaggggttgtgaatcccaacttcattttagtttgataattagggtgtgtgtgtgtgtgtgtgtgtgtgtgtgtgtgtgttggggttcttacttggtgaggaggatggatggatggataggatgtgtggaagtaaatatatcctaggaagaggaggatgcaatgtctttacatctgtggcttccctactgccacattaggacaatataaattcaccctccctgaagagtttttctgtgtctctgcttttattttaaggattatttttgagtatttacaaagcctctgaagatgggactttagagaaaatgcttcctgcaaatagcagttaactgtgcatggccttctttgctcatcttcaaagcagttgtgcagcagaagaggtgaggggcaggtctggcccgtgctccctggggaaatgactcttcagtcaaatgacggccaaaggggcttggggactggagcagttgggcttggagaccttggtgacagcaatgagattggacaatgtatgaacagcccacagggacttattggttgtgctcttggccagccttactgcccatgcaagagcaccacaggtggatgtagggccacgcactgtcctctctctccaatctggggaataactgcctctttagcccctaggctggacctgtctcttctgaccacattttgtaggcaatacgagagagagatccttgattatcaggtctgtgagcctgtgtaaagaagatggagaagcatactcacatggccctgtctttgagactttaaggaaatctcctggagagtcactgggaaaccagtttcagcaacattgacccagctggtttttctcctgtccccctttcctgatggcaggaaaagaaggtgttgtaaataaaagccagggtgaagagtgatggggatgaggacactttgggaagattccttcatcattggtttcaaagtggagggagatgtccgtaaaacagagaacatggggcctagctccaggctcttatgacgtggaaagagaattttatcttttattctggcttctggagtattagacatgtccttattcaggaggccaccagtttaatttttaacacaatgagggtttccttgctcttcttccaagtgtctctgatgcacctgattgcttgatatgagttcccttttggggagcgttttcagtaaccctatgaaattgaaaattgaactccattctgactgagtttacagtcagggatgcagggtgggacatgaaggagaagggccttcagcccaccccattggtccagtgtgtgccccaggtggttgagggtgcaggaggagacccttgaccaaggcttgggctgggtatttgccttggtcccaggactgagaagagatggctttggggacaaaggagaaggagtgcaactggctttgggcaaaggaatcaggagggcatgggatctgggtaccacctcttgaccatgttgcctgccaggtgctctggctggaaagtgagtggacttggccttggaccctttactctggaggagcgatttgctattttttctctccagttgcctccagctggaatcctggtgattaatgggttagagagtgtttcaaaaacacccagagggagcccagtccccgtggcttacagggaaacagaaaaacacattattctgtccttttccttcaaatgaaagaagaagcctccctgcttgctcagtgagttggcaaatggctctggagagtggaaagttgtgaaggcacagtccacttctccacaccccctccttcttggattaacccttcatggggcccccattcctggtgccaaggtgaaaacactgcatctgccctcacattggtcttcatttccttccagcagcgcactcgaagtggcagcgatttgcaggctgctgcccctgcagtgtatctgcttggaatacttgccaggtagttctcaattaatgggcccaacactgcatcttggtgaagagaaatggggagatgctgatatttctaggccctcccagatcaccctgccctgagcgtactagtaggtgtaacacagattctcccaggcaggatttcctacccttaactaattcagctggactgtgttctaaaatatttactcctaatgtgcaaaatagtgacagatttgatcagattaattgtatttcactcactggatcatctaattgtggctcccaaacagatttttcaaatagcttttggctggattgcttgtcttcatcctccctgctcacagttcctgtgtcacaatatcttaatgcattctgcctttttggaggcttaataaagaagcttgccacagaagccattcttcagggttttgccaaaaaaattgttttcaattagtattacaaggggaaaccatctcagttgagatgtagctgggaaatgcatggggacataacggtactaattgctcctggtcattgttggtctgaggggccgtagggagaggaggagctgggcacagcctatttatctgctcagtgatttctctgatggctggattacaggatgtgatttccttctcagatccttcagtgatttccaaggtgagcagaagttgcagattccttaattgggaggcctgatttaatgattacagaaatgcagtggctggaacttgctttgtagctggcaaagaaggaatgcccgggagtggcttctccagtggtgttggatttaagggaaagggagggtgacttcagtggcaggaaggctcagtggacagaagggaaaattgctttttctttgggctgtgtaaatctattgtcagtgaaggaatcctggaactggatgatctgtgggccctgaatcatctcataaggagcagagaggtgcaacaaagcagacactctgtgatagaaagatttggctggagactagtggtttatccaaggctaggtatagattggctaagtcacttaaggcctgtggcttgacctacctgttgatttcccgctttctgccttcttttggcctcttggctggtttgagacacttcccttacagggagaaaatgtcaaaggaggattctgcagtaagtttgaaggagaaaagaggccttgtggaggaggaggtgggagatatagaatgtgagtgcctagtgggtcactaggcagttctggtaagcagaactggctctgtgggatggatcgaatttggctaaccaagtttattctcctggtgttgtgggtaactgagaaaaggctctggatagggctctgactttgttggtagtcagtggagatgagggagctttgccttacacatggttggcacttgataatgtttgactgagtgaatgaaagacagtctcaagtctcatcaagcagaggctataaaggaattagaaattgttgttgcctgggatagcaatgatttcagaacttgacagctaccatagccaggagtgtttcatccagtgtgtctacattctggcttgaggaacttcggtttcttaaattcagatccagagtccattagcctggcattcaaggctatgtatgtcccgggtctacttctccaactttggatttgactcttccctgattgactcctgcattctggccagggcagcgtcttcattgtcccaagcatcttgaggtctgttccacttggggtacccttctttcttgatgaaagggcacctgttattcatagctcagttcaacattcagactcagtggctctgtgaaactttccttagaagcatttatttctcttttcccctacttgtttatagaatttgcagagtgcaccacacattttgtcatatttagtttagtacttactttagtcttatattatttggtgagtgatttgagggtaagagctgaaataattaaaacagcaccccttccctccaatcaccatcaagtgcgagttctgttcttctcatccgtgcctggcagcatgtgccgtagggtagtacatagctcagtaatactgaactcacctggggagttggactgtgccttagctgcagggtaagaggagaggaaagaagatcattttgccctaagataactaacaggttaacactgtctcttaataacactgagtttagacaactggtgtattatttcatgtatgaatgttaacataagattcagaggggtctctacactacttagtaagaggatagaaataaggactagttaacaatcctggcttctcatggacttcagagatcagatggacacccccataagacattcatccattttctgagtgtttcctgtgtatgtggcattgtcctagaaactgtggggttggtagaagtgtgatagagaggagacaaagaaggataagacagcatttgcctcatggtcctgccgacatgctttggatgtgagactgctcttctgtaaagttaaataacacatgacaacaagacagatgccatggggtgatatgtggttaattgtcaagtgatcgtttcaggctatgagctcgcagaagagaggatccctgtgggacatactacaggaatttgagacttgcagaatgtcaagactggaagtgcacttgggaattgtcttcatcaaatcactcatgatagagatgaggatatgaggctcagacagaaacatggcagcctgccttggaccctgcttatttttttttctcttggaagagccatcccctcttcacacccatttttctcctttcttctcaggttaacagagcattttccttctaagaggatttgtgtgttttcactctgatgaggtgcccattttataggtaggatagattgaggccccaggatgggtatcgtatgaggctagttagagagatttaggaatagattctttccttctgttctggggccatactctatagtcaacctgcccacccaccgcggtggctgcagacaatgaataacaagctagttaatgttggacaagctgtatcttactaaccattgttaatgggggcctcttgtgagtcactttgtaatttgagttagtgagtgaatcaagcctggttacatcacaaccaggaatattttgctcatttattttgatcagtgtagtttggatttaattatttatagaaatactgttgtttatagtacactaataaatgttctatagtaaatttggaaaaaataatggagtctaagaacctcaggattgcacagattgttttctgctattgagtgcatgcagggaatcagaggaagccatccctgcttggttgagatgagagggacctgcagcagagtggggccagcagggttcttggtcagtaaaactgtgcccttggctaagtaggggactgttacttggcatgcactggaaagagaaaaaaccttctttaggggaaaaactggaaataaagctatgtaggataatcaaggattatattgggttgtgggattatttagtatgggtatatggtacaacttgtgtgaattcatatttgtggagagatttcatcatgaatgcaatcctcttctggatttgttgagaacagatagactgggaacctgaaacaggccacatactaaataagatcaatggattttgcagccaggtgcctgggttcaagtcctgcctctgtttcttaatagctgtgtgacattgggcaagttgttaccctctctgctgtttcttcatctgaaaaaagggagtgatgatatagtatctctaccttgggctgttgtaagaattaagtgagactgtacagggcagagtgcttaaaagaagtgcctgacccatttgtagcaagcactcaagatactttagtttagttgttatttttatatctggaaggggccttcccttaattttcagatggaaatgttgaagcagaggaaggaggcacttgctcaaggtttcccagtgagctgatggcaaggccttggctagaacccagttctcatcaagatgctcatttcaaccacctcccatagttcatgtccccagtcaatgagtctttgccatgtctatcttttatgtcgtgctaaagtagacattgaaaaggatctagaagtgaatgactggggacctgtattcttgaaattcatactcagaatttgtagtagaaacagaataatattcattagatgattacactaataagctatgaataaatttaacattatttcggggcttttattgcatggagagttaagggatccagaaagatgaagagtagcttctctcagaattggcatccatgatacaactcacagctaatcaagggagacttcttgagggaagtgagtaaagtgtgtagctactagaacattggagaacactgggttgctggggctggttgacaagcagatcccattgtgccaaagactcatgtatgccaaagtcatgggctagacctcaatgttacatttttcctttcctcttctgtatttgtgcctgttgtgaaatgggcatatcacatggattggagctatctgtagaatatctgcagcctgttccccagaattatcacactggtacaatccactactttgtggtgatctatacccatagagttgtaggcttgagttccctttttgccttcaccctgtgtaccaagagtggaacctgagagccctacatagacactagagggagtgttgccctgggaaagaagtgaaaataaataggatgaaataacaagacaatgctgtaccaggaattgttccgaaggagggaagatgaaaagtagactgtaagtgaattgtgtaggggttgtatgatgatccatagatgaataatcatttggcagcaggacagttttcaatcctggggggggctgatcattcagcctcttcctacagaaaaaaggggaatagatacaaacacgttcattcagcagttagatactcagaccattaatgaccaaactaacactctacaaatagattcagctggaagtgatgcttaggctaggttctcccattgcttctgtatttccttcctttttgcttccttgctctcttgtatctggtggttaagtcaataggtgcttattgagttgaacagaataaatacttgcttaaatacttaaaagtgcctgggtaaagaacaagtgtcttggggatggagtagtgtctggcctgctgttgctggcctgggatctgcactctgggacattgcggctgtctctcacaggctctcaggtcccacgtgcctgacatcctcccagaagcctttttgacatctatggtgaggtaggcagtttctcattcagatggttagaatcaggttacagattacactgctgcataagaaataaactttttcttttaaaaatctgttctcagtgggagatgaagaacaatgactgagttgaacattttcaagactagaaaaatagctcaagctgccatatctgaatgtgattacacatagtgggggaacttgtctacaataagagttctgagacaatgaagctggtgacacagataaacttgttttccagagtggtggtggaagaggagggtatccttagtggtgaaagagttgcttatctcactgtgttgctttcagtgttattcatgcttgaaagcaaacttttgtttgaaagatttctcaaaactctaaagcgtcttttctgtcatgagaaggtccctaagccacagcaatcttgaacaagtctctaagccttagtttcactggctgtaaaatgatgataatactggaattgcaggattgttgtgaatcttagagatgatgcctataaagggcctagcataataggctattttaacataagaatgttaatttttgtaattccagtactttgggaggctgaggcgggcagatcacttgaggtcaggagttcgagaccagcctggccaacatagtgaaacctccgggctctactaaaaaaaaaaaaaaaaaaaaacacaaaaattagctggtggcacatgcctttaatcccagctacacgggaggctgaggctggagaatctcttgaacgcaggaggcaggggttgcagtgagccaagatggtgccactgcattccccagcctgggtgacagagtgagactccgtctcaaaaaaaaaaagaatgttaattctcatttggagatctgttggtactctacccgtattcccggggtgttcctttgctctgcatgctggcctgatttccaaccaccagcaccagggaccagctttccctgatcactgtagcttgctttgatcacacaaggtacaggctggaagagtcaaggagttaatgcctgtgagggagcagagagcagccactaccaatgactggtaggagttgatggataaatatctagcccccttgactactggggttggctaactctgagacatgtttctttcatggtttcccagagctccctgtgggattaaaccccagttttaaatatattttaaatgtgtgtgtgtgtgtgtgtgtgtgtgtgtgtgtgttttaaatgggtgcattattagtaaggagagagcctgcaagtatgatttaaaaaaatggaaaatgcttctttcaagcatgcctagatttggtcttacttcaagcagatatattttcattcattctttcgctcattcattcaataatttgtttgcttagtatgatgccagttaagttatttgaattttctgggattcagtttcgtcacctataaaatgaaaaagttgcaaaaattggtgcagcccatctcaccacaaagtagatgtgatattaggtcagtcatttcttgatgggtaaaatgggcacaatcctgtttactccctttatgtcacagttaaaaaatgagatggtgcacatggaagcattttgaaaagaatagggggtgatatgaactcaagttgttagtttacctcacctctccttcattccttaaggagctagagaccctttgacaacagatttgagaccagatgcagctcttgccttcttctgccttctctcagtacaaatgaacacttccattaacacgcataccatggtagtaaaaaccccaagattcttattccaggcgtgttgtacaatttttttcaagtcacgtctgataataataaaattctcagatgggagtgtaatttggatgttttaacaaaacatttgccccaggttgtgacctgtattgattgctctgccttactcttttcagatcatgtgaagtgtttcagagcacctagtatatgcctagtgaggcagcatgtgcaaaaaaatctatgtgatgcagactggacacccaagaaaacttacaattttgtgtgtggtaaacatatgttggacagatattgcagagaacagtgtgagatagcataagacatgtgctaattggagcatgcttaggaaataacttgaacataatcaagaccacagtgaatgaaaattaatgaaattattaaaaaattctggttgtttttattatctgcaacaaaatctactagcacaataagaaatagatgctatcaccaaacctgggtcacttgacaaggagtgtcctgagctttgaggtcaaatagattacctgttgttctgacaattgttcagaattctgccatgtcagtgtggtgtataaattgcttacagagaactctgttttaccgtgtgtttctacttgttttattttctttataggaagataaagaatatgctatttcaccatagtactatgatattccaactttttagttgtattattattagatattctaatttgtactgatttctttctttctaggcctgtttcccttctgtcatcttgagatttctatttattttactcttggattagtgcctctgttttttggatcccattcctctgttgtgggctgcttttcatttttctgtggcatatcctcaagtaatctttttcagagaatgcatgggaatgtcttggtttatacctcttgtcctgatagaatatgaatagatgtattttgactctcaaaagatccaggcttagatgatgaatcatatggtcacccagtgcttgggagatattaatgctttaaaaatttttaatttaaaaaattgtttgtgggtacatagtaggcgtatatatttatgcgatacgtgagatgttttggtacagatatgcattgcataataatcacatcatggaagatgggatatctatccattcaagcagttatcatttgtgttacaaataatccagattatactcttttagttattttaaaatgtacaattaaaattattattgactctagtcacccttttgtgctatcaaatacttggccttattcattcattttattttttgtacccattaataatccccacctccccctctcccccactacccttcctgcctctggtaatcattcttctactctatgcgcatgggttcagttgttttcatttttagacgccacaaataagtgagaatatgccatgtgtgtcttttggtgcctggcttatttcacttaacataatgacctctacttccatccatgtttttgcaaatgactgaatctcattcgtttttatggctgaataatactccattgtgtatatgtaccacgttttctttatccattcatctgttgatggacagtcaggttgcttccaaatcttggctattgtgaatagtgctgcagcaaacatgggagtgcagatatctctttgatatattgatttcctttcttttgagtatataaccagcagcgggattgctggattgtatgatacctctatttttagttttttgagaaacctccaaactgttctccatagtagttgcactaatttacattcccaccaacagtgtacaagggttcccttttctccatgtcctcaccagcatttgttattgcctgtcttttggatataagccattttaactggggtgagatgatatgttattgtagttttgatgtgcatttctctgatgatcaggagatccacttttaaaaaagattcttggcatgtctaaaattttgttttgctctcacattggcttggtggttcctctggacatagaaatctagggtcaaaaaagtttttcttggatttgggaagtacttaggttacttgatgcttttgtatcatgtgctatttggcattatatgtgtctccccttctactcatggactgatgaaggtgggaaaaggaggtacataacataagatacctctgactttgttcaaattagtgatgtgcaacccttgaggaagcctgatgcattaaaactggatttacacaaaatcggtagtataaggtgggggattaaacactctgcagagccatttgctatttacactcattatccaaataccttcaatgtaaaactcaaccaaaagaagtagttttaggcaggttgcattggctcatgcctgtaatcccagcagtttgggagaccaaggcagacagattacctgaggtcgggagtttgagaccagcctggccaacatggtgaaaccttgtctctagtaaaaattcaaaaattagccaggtgtggtggcacacacctgtagtcccagctacttgggaggctgaggcaggagaatcacttgaaccggggaggcggaggttgcagtgagcagagatcacatcactgcactccagcttgggtaacagagctccgtctcaaaaaaaaaaaaaaaggagtagttttatttatttaattttagcttcgggggtacatgtgaaggtttgttatgtaggtaaactcatttcatgggggcttgttgtacagattattttgtcatgcaggtatttaagcctagtactcaatagttattttttctgctcctgcagaaaaaatagccagcattgtctgttgttccttcctttgtgttcatgagttctcatcatttagctcccacttgtaagtgagaacatgtggtatttggtttctttttctttaaaaaaatttaaaatcatttttaaaaaccacagcaatagccaattaatatggtttggaactgtgttcttgcccaaatctcatgttaaattgtaatccccattgttggaggtggggcttggtgggaggtgattggatcatggagacagatttctcatgaatggtttagcaccatcctcttggtactgtccttgtgacagtgagtgagttctcataagatctggttggttaaaagtgtgcagtgcctcctgcccccactccgccttgctcctgcttcttccgtgtaagacatctgctccccctttgccttctgccatgattggaagtttcctgaggtctccccagaagcagaagcgaatgtgtttcctgtacagcctgcagaaccatgagccaattaaacttcttttattaaatataaaatacacagtcctagatgtttctttatagcaatgtgagaatggactaacacatcaatattcaatacatatttgtggagtcccctctatgtgccaggtgctgctggattctgagtctgtaatagtgagcagtgctctgattgagaggtacatgacaacactagggacatttaacttaggaagggcagagagggagatgcagatgagtggagattgcaaagatgtgcagggtggattaggtgcagaggtgagggcatagtgttctgggcatatggcttctgtggcagggaggagcaaggtatttgaaggggaaaggaaggacagtgtggctggagcagaggggctgggggatggtgagagatgagatgaagctagacaggcaggcatgggcaggactaagcaagggtttagttctttatcccaacagcaaaggggtggcctggcctggtggcttatgcgtgcaattctagcactttgggaggctgaggaagggagatcccctgagcccaggagtttgagaggcaacatggagaaactctgtctctgcaaaaaatacacacacaaacaaaattagctgggcatggtggaatgcacttgtggtcccagctactcaggtggctgaggctgaggtgggaggatcacttgagcccaggaggttgaggctgcagtgagctgtgatcatgccactgcactctaacctggatgacagagtgagaccttgttaaaaaaaaacaaaaagaaaaagaaaaaaagtaaagaggtgagccatgaaaaggtttatagtaggagagtgataaaatgataaaattaaatgtacattaaaaaatcactctgatcaccctgtgggttagagggaaaaaaggatgaatgctaagaggatgtagctggagaggttgatggcttggatggtggtagtgggggtagataagaaggagtccactgaagaaatatttggcagatgtagttgattgtgtcattagctccaattgttcacttctctttataactccctttgtatgggacctttgcagtgccctctctctgaatgggaccttcttccccatcttctaacttttggtttggccttgtgacttgctttggccaatagagagttggaagtgatagtgtgccagttctaagctcagttatcaagaagcatgtgtgtttctacctgtttttttgtgcctttggggtggccatgagaaaaacatagcctattggtctcaggaggaggatgagagacaactagtacatagccattcccagccaagcccacgctagatcagcccagcccagtccagctagaaccacgtagctgagcccagttatgatcagccaaccccaagctgccctgaatatttctgagaataaagtgattgattgttgtgagaataagtgattgagatttaggtggtttattttgcagcgtttttgcagcaggtaaaatcaatagaacttgagagattggatgtagcaaatgtgtgggaacataattacggtataaagtgaggctcacctgtatttcgagatcattagcctgctacatacatgctcagggatggacttaggagtgtttttttcgtggttgcctgccccttgcctctctttacaattcatggtttctttttctggagctgaatgcggtaggccagatttatagtccaaaagaattaattgtctactctttttccttctcactctccttctggcaggctaatcagattccagcagagcctgagagctgagtaatcctcagttccctcaataggggccttcagactctaacatttagtgtattcttgttggagttgaaatcaattttagctctgactgtgaagatagaatttcacttgaaggggtgagaaatacagggccagggattttcttggttttgactgattatttaaaatatattagttccgataaaatatttagcttttaaacaacaaatttaatatagggaattgtactttatttgttaatggaagttgcagggagattggtaggagttgtgctaaagtgcactgttgtgattttgcaaagtatagtaattactgtaatattttgttgaattattaatatctactatgcctacaggaacataagctttgcagctgaattcattttaaaattgcctttctcccttctggttttgttttgtgttttctttcttgtgcacttactaatttttaaagaaatggggtagggcagtgttaattatattgtatgaaacactgttgtcacatgctaactgaatatatgcttcttccaaaccggtttgcagtggcagattgagggatgctgaaagaatcatgtctggggagaaagggctcatccatgtgtttttttcaggagctgagatgaggagagaaaaatagcagagaggtcacatgtatgcacatgagtattatgtctgcatgcttctaagcagagctggtcctacctgtagatgaaattggtaggtgtttaggcatgtgtgatgaaacagcacaagtctccttttttattttgagatggagttcactcttgttgctcaggctggagtatgcaatggcatgatcttggctcacttggctcagtttgtatttgtatttttagtgtaggcaacagttcattatgttggccatggtggtctcgaactcctgacttcaggtgatccacccaccttggcctcccaaagtggtgggattacaggtgtgagccacagcacctggcctcaagtcccctttcttaattgccttaacagtgattacttagtgtctattatgtgctcaaatgagattattgtgcatgatgatgatgatgatgatggtgatagcttacaattgttacctgagtgggctcatgctgcaataggactctggatggagtgcagggttataaataagcactttttttttgtcttttgttttttgttttttgcttttgtttttgttttttttttggttgtgactaaactgaaattggaggactagccttcacatgaatatctgccagctttatgaaatggtgtaagtcggtcaacatctgagactcaagtttcctcatctgtttaatagttgcaaggatcaaaatgaaatcatgtatttgaaagggcattataaactataaatgtacagatatttttaaggaaatatcacaacatggtattaaattgtggaagaagttgctcatactcatgttgtgattttgaaggggagcaaggaggacttttttgcttgattttattttttcctttccagaatcttcacaattagaggaccatttttcatgttgaacattgttccctctaaggtcctcttaaaatataaataattcagagacaatatttagagctggaaagaacacataatgacctaactacatctttttcctgacatagaaaatgtgggcaagcgagattgtatagtgcccaaattcatccagatagtagaaactcccacatcaatgtccacttctctgacttttagtccagtgctctttctgtaacactctgatgcccattcgtattccattaagtttttagtccagagaatttccccccagaatgtagccttgggaagaataaataaatagatgactagtggggagatatcaggtttgggattcctttaggtggaagagtagtgcttggatcggaaggacctgatcttgaatcttagctccacccctgactaggtagctgtgacctgggcaagttacttttctgagacctacttctctcctttataaaatcaggatataatcccattttgcctggtctttgtgaggatttagtgagtttaaagggcttgccaaggcgcctgccctgtggtagaagatactctaaaatgagtaggaaatggttattgttagataagaggtcctggagattagcttgatctccctcacagttggtctgccttttgccagccattctttcactctcctgtgagggtgtgtattttttaagaggagaggaaactgcaccctccaacattgctggttcccttccccaggatcggggagggaggactatgtgaaaggcccctgcagagatgcctgcacagtgggggacactcctgcactggccagaggatgagctgggacttagcaatagcccttcctttctcttttttctcacacagcagcagctccagcccgatttaaatttcctttaaaggagctgaggatgataggagggtggagatgtgcatcttgaaagaacggcaggtgactctaaaaatgagacaaatcaaagctcctgcatctatagctgcacatcgctgtgtcttaggtggctctgcttcttattttaagttaccaaggtggcttcctgaaaagtgggtttcagttttttaactgagagtttattatcctgcatctgtgcatcctgccgatctgtgagctgggtaggacctattgtttctagtgaacttacagcatgtaaagcatgaccacctatgggttaacatttaggtagtggaggaacttctagggacagaagaaaacaggaaacaccccagagtctgagtcccttctcaggtatgggggctgggtcagcctttacctgaaataaaataagagcaagggatgcagggaagtgagctcctgtggccctcaccctcccctctacccagcaccctccactttccttctgacctagggaaaatggtctaatactggtcctttgtgtcttcactttttttttctgagcccttcacatttcaaatctgatatcctaatggtgaatgagttggggatggtttgggaaggcgttttagggatggtgactcttgaaatcagagcctgtgctatttgcctaatttttccaatttttagggctggcatcagggagaggtaggacagtccagacatctttctggtccagagatgcctatttcctgtctgactcatgcctgagcctcaaaaagctcccatgagaggagagccatgggctctggccaaagactggctcttctctctgtgttggtcaagtacttacaatgatggatttttcttggtttaagcggaggggcaattggggagagctttgctctgtaccttttttcctttttaaattttatttatttatttaaaatacatatgacataaaatttgccattagaatcatttttactgctacaactcagtgcctattaatgaagaaccacttaaacagtgacttcctcttgctctgttctttacacaattaaattatcttcttcagcatctgagcaaatatggggatttctagtttattcccctcttctgccttctcctgttccgtctctaaccattttctcttctttcttcccagaacaggggcccatggagttgggaatgaggacgagtcttgtaatattcagggataagaaataggggagtatttttcatctcccccttgacagctatgttatttatttatttataaagataatcatacctgctatcacccagagaaagatatgtatcttgctccaccaccctaacttgttctcctgaagcagggatggtaatgccaaattatctgctccttgaccatcatgggcatcctagcaatcagtgacatacctcaacaggcaagctgcccttgtccagtgcagtcttgacattgtgacttagttttggctaagcctttttaagaggagacttgcttgtacatagctgagatcaaacacacttcatagttgagttgttattacctatatatttattaatatcattgttatttaaggtagtatgatttgggaatatagatagatagatagatagatagatagacagatagatagatagatacatatcatcctgcaataaatagtttttaaaatatcttgaacaaattcctaattgcacttcagtactgtgatcgatgatgaacaagaaacagttcagacttgatctcggccttctgggaacttaaaatctaagagaagtatgtgtaggtggaaggatggaaatccaaatcaatattggaatcaaaagtgaagcatctggggatgggatccagcacttactgaaggtttgctgtgtgccgggtgccagttttgggtgctttatttgtgtcagttcatttttccctcataactttatgagttggaggttattactatctctctttaacagaaaactgtgatgaagagaagttagattatcaagctcacatggctaataagcttcagagtgggtaatgaaatagaggaaaatacagatgtaaggtagttgagtctactgtattattgatgttgaaatcaggatattacagagtttgtgagtgcggataggctgagagtatcagagcaaaagggtgggagaaggtaaagacatcagcttttatttcattttaaaatgacataattttgcaaaaataatagaccacaattaggatactcttactgtgtgccaaacattgagctgtaacttttgcattcagcatcttgtttaatcttcatggtgactcgatgaagtttctactattatgagccacattgtaaagatgagtaaataaaagcatggtggggctcaatacctgacccatgtcacaaagctggtgagtgacagagctgcaagtcccacgtggaccatctgacttgagagctccttacttgatgagttacagagcccacttctccaattcataccagccagggaagcaaggcctcagcaatgcaaggttgaactgctgaccccatgagggctaagatgggttttcagctcctgggcctttttgcaattagactggcatgttcttttctagaagccttcattgaatatttgtacttaagctctggtgtttccaggcaaagagcaagatgagtaaaggcttggaggtgagaagtaatagggtgtttttcggaactaggagagtcaggaagagatgggtccagatcacacaggcattgcatagcccactggcaaacttgcatgttatttttataggcactgggaactcttagtaattttaaacaagggaaacatgtaattagcagtggcatcaattgtcctcaaaacaccacaaaatccattctccctacttcatgggaggaaaaagaaaggctcagagaggctgagtttttgcctggagtcagtcagcaacttgttagtggaaggagcagcagaagcccacactgccgtctctccttccagctctgggagctgccggctgccttcctttcactctgcctgttcccttcccacctcttgcccgctccctcctggcacagtggagtcctctccatcattacagcagccagtggggttctgttgtaattaaaggaagccaacagggagaagcaaggcagagcaagggaaaaaagcaaccaccaacaccacacaaactccgtaacaactgctgtctatcgcctttcatgggcacttgcttgctttaagtacagcagagggaaaccccataggatggtgtgggaaagcaggttattaagttgccttcaggctggcagaggggggatttactccttttcttgtactccctaccctgcagtgcaaaactgatcaaatattaaaagttgaaagagacttcgaaggccatttagttcaacttctcctccaaggcagggcttcctccattgctttcctctctccgcatggcatctctgatatgttgttatgtggtggctccctcgctccccagctccccacattttctggatcaaagcttaggtagggatgggagacattttcactagcaaaatactggccacacaagcctgttgtcatttacggcaatgacttcagaaatgtttaattaattcatttatccaattagcctcttgctctctgaaatgctttttctaggttgctgagcaactaggacagactttgaacacatgcatgctgctgctgaatgaaccaggagctttttccttcacactggcagccccccactcctctttcttcttttatttttctggtgcacagtaaagaagaagatctctatcatcccccatccttctcgccttccccaccccggcctctctgaatgtgcatgctgcctgccttaacacatttccaaaggtaacttttatgccaagcatttgtcatggacaaggagaatgacaggatatatgggcacacagagatgcctctgtaaaataatgaaattatctgggctcaggcatgacttgggaagagctttgctggttgctgggggaggcgagggtgagggctggctaagggtaggctcagatgcattggggaagaaggtgcaggctgtcttggggtgacgttgcattaagtgcagcttgactaggcagcagttccatctgtctttacagtgtgtccttcatgggggaattgtcagccatccccagtctggagtgcattgtgagcaataaacaggagcggggcttaaggtgaaaatgaaaggaaaaatatcaacccaggagggcagcaaaatgccttgaggaatcatccttgacgtgtaacacatttccgtttaaggatgtgaaaatgccacaggctgcttcactgagttagaatgttagagatggactttgagctcaaattgccaccattcttcgtttttacagatgagaaaatcgaagctcagggaggataaactgtttgctcagtgtctcacagccatgtcctgcttatgtcaccacattcctcctcttagatttcattaaggggcccttgtccataaaattagtcacttgagtcatcaaagcttacttttaaaattttgactttattttggagtagttgaagttggcagtgaagatttgcagcgctcaaggatcttggcatctatctccccattcaccttgacatgtgtgtattgcagatgctaggggcgtgtgcttgggctcagtattcaaatatgaatgaggaagggtcccttgtcttcaaagacctcccccaaacccctcatgtggtggaagagatggacagtaaaggaggaaggaactccttctcagagacattaaagaagcattcagagaagaggagctgggcaatttgctgggcccagatcttacagtgaagggggctatggggatgggatcggggtggaggacattcctggtcaaggagacagcatgggcccagtaaggaggcatgagagatggtgacatgtttgaggactggagagtggcctgggaatagagccttccagctgtctggcttttctctgatgcatggtggatggtttggtgctgcccacaccgacttctggaagacaccgcctcttgctctctggaataataagaaagcacagttatctctatgcatgtatcagtatgaaaaagcatatgccaggattcccggatggaaatgacttccctttgaagttagttcataaataatgatgaagaccataaaagtacacatgcactgcacacatttagctactgctgtggactgtgcttgctgggagcagaaccttcaggaaaaccagctgcccagagaaagaatgagggactatacattcgctaaagcacgggctcccagagcctcctgtaggaccaagggagaccttttatggaacagggtctattccacggcactcacaattgtagtaatcacttagtcactctgaaattccaagagatagtcagagaaaaaacatggcctgtgacaatgattgccctgaccaagcctttccaaggcagcagatgcttctttacttccaagcattgcccgtcatgatcaagttcttcctccagcagtgcagccacgtttccctggtggcagacattccttttccaaggttgggcttgcttttagagggcccagagatggcaaacagcattgtgtagtgctccttagtataaactctcctctgggattgttcttaacaaggtggtttgagtttctctaggaattaagctggggctggctattatttttctggtaagacttgttactctaaaatgcatatggggccaaaatcacaatagtcttgtctttggagcaatcagacgcacatggcaatctaaggctctggtaaggaagagtccgtgggttcttattcaataaatatttaatacattgggctttgatggatgtagacactgtctgcttgggttttcctacaccaaaaggtgaagtctctggtggtcactgcctcttgtttgttcctttgatttcctttgacgaaaaacaattcttgtcttggtgaggtctattaaatctgttcttttccaaaatggggctggtagtgcatgttggacagaactggaactttccctctggtcattccttgccatcccctgggtgattcggtttcccattttctgggatgtgctgatagggcttgtctcccgccccctcttatataaggaggcagggtgcatctagtgccagattttattcaaccctgtaacaatcccccctttatgacatcactgctcatcaccatggaaacatttcctccgagtcacagagactggattgtggcatcatagcatcaggcaggaggaggagaagaggaaaggggagaggattgaaactgcctggagggatgaaatgccaataaaataggacgcagtcacagaaataggatttttctgtccggatccttgaatggagaatctaaccatgagccacaggaataaaccttatctagcataaggaggaagagcttttgtggaatgtagacctgggaccttttgttcctgtgcagtatttcttcagggaaatggaataattttaatgagagctatgctgtattttgttttattttagagacagggtcttgctctgttgcccagactggagtgcagtgatgtgatcatagctcactgtaacctcaaactcctggggtcaagtgatcctcctgcctcagtttcccaagtagctgggactataggtgcatgcctccatacccaactatttttttttattttttatagagatggggtctcactgtgtttctcaggctggtctatcctgtattttatatgcatttcttatttcatcctcacaaagtctctttggactattggatcagagaggttaaataacctgcctaaggtaacacggctagaaaatggcagagctgaaaattattaggggcataagatgtaaactgtgttctcatgcagcttagtgttgggagagagagagagagaggagagagaagagagagaatatgttggagacaattatcaagttaataacatatacatagttaaaattgtggtaggtgtcatgaagagaacagacatgatgctttcagtgaggagatactggagtgtgcataggaactacttatgtttgtatgttattaaatttgggacaaggctctgaacctagttggtatggacttagacgtgcaaggcactgtgctcacatatgtactgactttcccgagctcacgtgctgggccccacaaccaatacccttctcctcagctgcttttctctgcctatgccccatctttttgcttctccatttgtcttctcccttctcctgagatcttcctgcctgccctcctctcttgatcctgtttcttcctactgatctctgatcttctctttctctagactataaactcctcaagagagagaaaactgttcccctgttttatatcttggtttacccaaggatcaggctctagcctgatctaggactgcttctatggtctgctacagaaataaatgagcaatgtccctttttaaagaaaaaaaatgactacatttttcacagttaaaaaatattgtctagtagacttttcttaacaaacgctggctgataaatgaatgaacaagtaacaagtgagcattaaaagggaacaaaaccccagagtaaatggccaatcctgtgttgttctacagcttgtttgtcgttgtttgcataggttcattatgattgtgatttcaagttgtattcatgtgatctggccaccttttctcttaatacaactggtccaagtctgtaggatggtgtcagcttagtgcttcacagggttctaagagctgggggtgctttgccatggacctcctctgggagctgctgtgctggtgccccatgtggcaatagatggatgtaaggaggcctcatactttccatttgtgtcaccttgctgagctttccttgattcatctgagtttcaggagtgtttgccacttgagttcaaggcgccttcgtggcactcctaggatttaaagtgggcaggttggtctcaatttggtctccagtgtctgggctgcccaactcagatgagcaccttgctggttggaggtctgcaattagactttattgcaacagctgtgtgtgtgtgtgtgcgcgcatgtgtgtgcacgcgcaatagtaaaccatattaagtgcctttactatccaaccttgttctttccagggcctacagtaacttgatctgacttctaagggggcccttctggacctgctttatggattctatcagaaccatttatgacgggcacatgtagaactactaagtgcctttttttcctctttttctttgttaagtgttacatggggagtgaatagtgaattaattaagaccacagggtttggagtgagagagacaagagtttgatcctggtttagcctcttactagctatatggtcttgggcaagttacctgtattccctacatttaaatgtcttcatatacaaaataggcatgaatatatatttgtacctacttcataatgttgatattcagattcagtgagatacacttgtattgtcttaccatgatgtctgtctcatcaaaattaactgtgattaagtgggtcaaatgtaccatttgcatattttcccccaaaattatgcaaatactttttgaactcagaataaaacttgaactatagcacagatcatatctagactttttcaagtttgaattagaagggtcagaataattggcattttaattgttcaccatttacaggcaccataggtgaagggagtctaggaagaataactcttagttggaactaattcccgagagccttatcagatattagagatattttccccaagtgcgattctgacattaggactgttaaagcaaattaaacaggtgcagtcccctccctctgagagcaaagagttatcttccagcggggaagttagttcagctggacatgtgtctgtgttgatatgcacatacacttcagcagagagaagtgttaagaacaagcactgccactcaaaagtggctctgtgactttaggaagtcagttcatctttctgggcctccaaatcttcagtatagaaggggaaagggtagtagctactatatgctttttcccttcagcatgtttattgatgtataatatacatgtactagagtgcacagatttaaaacatttattatttttattgtggcaaaatacacataacataaaagtttaccatcttaaccattttaaagtgtatagttcagtagcattaagtacattcataatgttgtaccagcgtcaccgccattcatctctagaacgcttttcatcttgcaaaacaaactccatacccatcaaataattactccccattctaccctacttccagccctgacaaccatcattctactttgtgtctctatgatgttgattactctagctaccttaataaatggaatcatatagcatttgcctttggaatatttcacttagcatgatgccctcaaggttcatccatgttgtaatatgcgtcagaatgtcctccctttttaaagctgaataatattccattgtatgtatttaccatgttttgtttatccattcgtctgttgatgaacacttgggttgctttcatatttcagctattgggaataatgttgctatgaacatgggtatatggtataccagtatctctttgagatcctgctttcacttcttttggggaaatgcccataagtggaattgctatattatattgtagttctacgtttagttttttgaggaaccatcacactgttttcaatagtagctgtaccaatagaacagaagtcttccaatttctccacgtcctcaccaacactttctgtttttttttttatagtagtcatctgaatggaagaagtagtagctcattgtagtttttatttttatttctctaatgattagtgatattgaacatcttttcatgtgcttattagtcatttgtatatctcctttggagaaatgtctattcaagtcctttgcccatttttgaaattgagttgcttgttttgttgttgagttttgggagttctctatatattctgcataccaaccccttatcagatgtatgatttgcaaatattttcttccgttctgcaggttgcctttttactctgctgatggcatcttttgatatataaatttttttaattttcacaaactccaatttttctcttttgttggctatgcctttggtgttgtatctaagaaatccaatgtagtgaaacttttcccataaattttcttctaagagcattatggttttaggtcttacatttaggtcttttattcattttgagttaatttttatatacggtgtgaggtatttaattgttttctatcaagttttctcagcaccgtttattgaaaagactgtcctttccccattgaattgtctttgcacctttctcaaaaatcatttgaccatttatatgaaggtttatttctgggctctattctattggtttatgtatctgtctttttgctagtgccacactgttttgattactgtagctttgtagtaagattttattcaggaagtataagtcttctagatttgttttgctttttcaggaccgttttagctattcaggctcccttgagattccatatgaattttaggatgggcctttctatttctgcaaaaaacatcattgggattttgatagagattgcattggatctgtagattgctttggatagtattgacattttgacaatattaagtctctcgttcatgaacatggggtttgtccatttatgtctttaatttctttcagcagtattttataattttcattgacaactcttttctgtcctttgataattcctaagtattttattatttttactgctattataaatgaaattgttttcataattttcttttccaattgttccttgttaatgtaacgatatgcaattgattattgtctgtatcctgctactttgctgaatttattagttccaatctttttttaaactttaagtgttctacatactacatcatatcgtctgtaaacagagataattttacttctttctttccaattcgtatgccttttttttttcttgccgaattgctctggttagaactttcagtactgtgttgaacagtattagtaaaagccagcttccttgacttgttcctgatcctagaggaaaagttttcagtcttttatgattgagtatgatgttaactgtgtgtttttttttatatggctcctattatgttaaggtagtttcattcttttcctttttttttttttttttttttttttttgcgacagagtcttgttctgttgcccaggctggagtacagtggcacaatctcagctcattgcaacctctgccttccaggttcaagcaatcctattacctcagtctcccaagtatctgggactacaggtttgtgccaccatgcttggctaacttaaatatttttttttttcttttgtagagatgaggtcttactatattgcccaggatcttgaactcctgggctcattttttctgcctcaggctctcaaagtgctgggatcacaggtgtgagccaccatgcctggctggggtagtttccttctattcctagtttgttgagtgtttttatcatgaaagggttggtggattttgtcaaatgctttttctgcatcaactaaggtgatcgtgtgtttttttccgtttcattctgttaatgtggtatactggtcaattttcataagttgaaccatccttgttttccaggaataaataccacttgtcatggcgtataatcctgctaagatgctgccacatttggtttactagtattttgttgaggatttttccagctgtgtcaataagggatactggtctatacttttcttttcttatagtgtctttgactggctttggtatcagggtaattaatgctggcttcatagaatgagttaaagagcttcccctcctcttcagttttttggaaaagtttaagaaggattggtgatagttctttaaatatttggtagaattcactggtgaaaccatcaggtccagggtttttattttttggaagattttcggctacttaatttccttactgttataggtctattctgattatctacttcttcatcatttagtgttggtaggttttgtgtttctaggaatttgtccattttatctaagttttccaatttgttggcatacaattgttcatagtactcatttatagtcctttttgtttctgtagaatcaatagtaatgtttccagtttcattttttattttagtgatttgagtcttctctctttttttcttagtctagtgaggtaaatatttgtcaatctcattgatcttttcaaataaccaacttttggtttcgttgattttctctagtgtttttctgttctctgatcgctgttctgacctttatttttcctgtctgctagctttgggtttagttttcttctttttctagattcttaagttaggttattgatttgagatctttcctgttttttaattgtaagtgtttatagctctaaatttcccccttaggactgcttttgctgcatcccataagatttgatattttgtgtttttgttttcattcatctctaagtattttctaatttctgttttgatgttttctttgctgcattgtttgtttaagagtgtgttgtttaattttcattgctgctgaatagaatgttctgtatatgtttatatctaagtggattattgtattaattctttcatttccttatatttggtctagttgttttatccattttttgagggtaaggtattaaaatcttcaactgttattatgaagctatttctcccttcaattttgtaatgcttttacttgatatattttcatggtctgtcattaagtattcataactgttgcattttcctgctgttctgaaccttttattaatgtatattgtccttctttgtctcttgtttgcaactttttttgatttaaagtcgattttgttagatattagtatagtcacctttgttcgcttttggttaatgtttgcatggaatttttttctcatcttttgacttccagtgtgtttgcatgtttggatctaaactgagtctcttatagacagcatataattggatcatgttttaacaatccattcttccaatctctgcttttgattggagaatttattccatttacatttatagttaattactgataaggaggtacttacttctgacatgttgatatttgttttctatatatgccttacagcttttttgccccccatttcctgcattactattttcttttgtgtgtgtttagttgatattttttgtagtaaaaaaatgtaagtttatttcttatttccgtgtgtgtgtgtgtgtgtgtgtgtgtgtattttttgatgttgttgtttgttcatttgtttttgaggcagagtctcactctgttgcccaggctggagtgcagtggtgtgatcatagctcactgcagccttgaattcctggggacaagtgatcctcctgcctcaacctcctaggtgcatgccaccatgcccagctaatttttaaatttttttttggtagagacagggtcttgctatgttgcccaggctgatctcaaattcctgggctcaagcagtcctcctgccttggcctcctatagtgttgagactacaggcatgagccactgcacccagtctccttttgtatatattctatagctattttctttgtggttaccatagggattatatttaacatcttaaagttataacaactaacttaaatttataccagcctaacttcaataacataaaaaactctcctcctttagcagctctatcttcaccccttttggttggtgatgccataattacatctttatacatcatgtgcccaaaaatgtaaattaataattctttgaaatacattagctagctagcatacattttcggtgtccatttcaatgaagtttcaacacctgattacgctgatgttactcaccacccaaacaagatcaagacatagaacaatttatagcaccgcagaaagctcctttatgtttgctgtagaccagaagtctctccccctgggaataatcaatgttctttcttctattaagttttgtctgttcttgaaaatcatataaatggaataagatagcatggtagatggccactatatgcagctctaatgtggttctaacagcctttgccttctaatattcctatccttgtacagactcctcccctggggtgtggactggactcagtaacttgcttgtagtgaatagtatttggcaaaaatgatggggtatcacttctgagattaggttacaaaagactttggctttcattttgattttgtggtctctggctctcctcatttgctctgatgaaaagcctttgtgtttttagctgccttattggcaacaaccaatgaagaattaaggcccttggccctatatccatagtgagtgagggaagcaaatcttccctcagttgagccttgagattacggtagcctggctgacatctttcgtaatgccttgtgaaaaattgtgagctggaagacccaggtaagatgtacctgcattcctgacccacaaaaattgtgagacaataaatatctgttgttttaaactgttcagttttggaataatttgttacacagcaatagatagctaatatgtataatccttgtattctcttttttgttaagggtttttttcaattaacattatgtctgtgagatttaaccctgtggatatatataactttagtttgttctttttatttctccatagtataggaatatatccaaattatctatctattctgtaattcatggacatctgacttgtttccaatttttggctatatgaacattcctgtacattttttggacatctgtactcatttctttggcatatatacccaagggtagactagctgggtcataaagtagattttagtagataccaccaagtaattttccagagtggttgtaccgattctactccctccagcaatggatgagatttctaatcatttcacttccttgccaatgcctaattttttttaacgtttttcattttagtcattctgttgggtatggtgataaatcccattgtggtttttaattcaattactgagatgttgagcatttttcatatgcctaatggccatttggatatattctttagtaaaatgcctgttcaagtattttgtccattttatattgcattgtctatttttaagttagatttgtaagttccttattttctggacttgacttctttgtcagatatatttattgtagatatcttcttacagtctgttcttaattttaatgaaatacaattgagtgtttttttcttttaaggttataaaatctttgtctattccaaggtcagggagatagtctcctatgttttattctagaagttttattgttttaatgttcacatttaggctcgtgattcttccagaatttgttttatgtgttgagtgtctgatgtgacgaagggggccaatttcattttcttttctcatatagaactccagatggcccagcaccatttactggaaagatgtctttgttgcaaatcaggcgtcttacttgtgtgtccatttgtgaactttctatttggttccattgctctattttcctatcctaataccaacatcacactgtgtcaatactgtagctttataatcaatcttattatttggtaatctaagtttgccaatcttatctttttttccttcataattgtcttggctgttttggactgtttgtgttttcataaacattttagaatcacttgccaatttccacaaaaaaatcctgctaggattttagggtaggattatatcagtcagtaagcttggggaagaggaacctttttaaattttccttaatttctctcagcagtgtttcatacttttcagttgaaaggtcttgcacatctttcagtagatttattcccagggatctgatgctttgtgataccttaagtgggaatttaaaatttttcattttctaatttttgttcctagtataatctttaaattggattttcattatgtcatctgtgaacaaaggtgttttgtgtcttcatatcttttatttataccttttatttcattttcttgccttattgaacaggttatgacctacccacagtgttgaatagaagtggtggtagacataattctcttgttcctgagttcaggggaaaaacattcaatatttccctatgaatcatcatgtttgctataggtggttatggatgctttttactaggttatggataaaagcctctttttcaagtctaacttttgttgacatcatctaattgtatggaaaaaaggaaaagctaatatgtagaaggaataatgatgataacatgggtaagaacaagagaagcaagagagaaaatgaggtaaaggagtatgtaaaataggagaataaaagaatttttggggtgcctcctatgttccaggtgctctgagagccaagttaacttgtgataggacatagggctagtgaggactggaggctggaggagaacccagatcttctgagaatcagagcttattctttctactgcactcagaggaagagtaaacaaaggggaagatttgtaaggaagagaacagttactcccaaatcctcctgtaagcctagggcattgtgtcttttttctgtctcttccatctctttttttttctgtttctttctcagtcatgtgatttctaggtcttggccttgatcttgaattttaacttgatttcattctgtctccagtggtcgaatggtagtgtgtgccttctctccacttccatccagatcatatgaggttcttgtgttctgagacatctcttattttaattcagcttttgagatacccattacataatgccagttcaccctggtcactcagatcacaatggctggggcatgagattaatggtcatgtctttggtgtcattgtcagcactctgcaaatcatggttatccagtggtcactgggacacacagaataagcgggttgagcaaggttcaggctgtagtgaaggctgtaactacccctgagaagtccaaccttttgtggtgacagtcacatttatctcctgtggctgtggactccatttcaaccccaatctgggcatgtttgggagagaggctgctcccctgttgcctgagcttttggcagctgggccagctcccctgtcggtttgctttctcttttgcaaagtctatcctgaggctattatttggttttctagccttgtctgaattaggatggttccatttaaagtgaaaacaatataacacaaccttaaaaaaggactgaagaagaaacagaataaagagaggttgaatgcaaatgtgttttgcagtgttttaatgtattcgggatgttcctctaacattagccagcctgtcgcagcctgcccaggaacctggtgcatttgttgtgtggcagaaaacgttgctgaagaagaggctgaggtttgggctgagaagttgcctgaggcctcctgaaccatcatcttcattattgaaacattaaacaccctttggtccccagggcttgctatcagagcagttggctcagaggacgaaatgtggcaggaatgaggccattatctgccattatcctgttgttctgtaagatatccctatatcccacctatatcccaccccagtagccagttgtttctcagtgtgactttctggagaaagtgtggataaatcaagatcatccatcttcattcctggaaacatagggggtgaagagagagagagagagactgactgcatatgcttagcaaagaggaccaatctcattattacatttaaaatatttgtttcctcccttttgcagtgttttaaagtatgaaggatgatgaccagacatttgtttaaagcaggaggcacacccacttcccaggagcttgcattctagtaatgacataatccatgtcaatgttagacacatgtgtgcatggtctggccttcaaacaattaaacaattgtgaggttgccgaagttaaatttcttacctgggcatagacccattgaagcaacaataaagggagtgtactttaagaatacacatggaagacatctttaggctttagtaataaaaagccctatttgatcaaggaggttctcgttatttgggatagactggttgggtgaactagacccagttcacacaagtgacttatagagagttcagagctgagaaagcagctgttaagtgcgttcctatgtgtaagcacgtacacatccctggcacatagtaagtgttctgtcaatattagtgaatatgactattattgatgaaacagaagtaaagattaaaaaccatctgagtctggtaaccaaatccctaggttcagagtttctttcatttaggataaaagacactggccagtgctggaaagtgagttagactggatgtgtccacatgtttgtaaatgttttacctgcctctttgatgattcttcttggcctaacctaatagggcatgtgctcaggacttgctgcccctactgttagcctcctgagggcagggaccacatctgtcccagtatttcctagccagtagagtatgatatgctcaaaatatattgttgcaataattgaatgatattttcaaaatgagtcagcaacatctgtggtatccctcaaagttgatactatggaggtttaaagaaataataggaacatgcccatcacaaagccctgctctgtttcctcccctcccagtgttatgttcagctcttggagcccaagccaaacaagagaatcattcactgagggaaagcaggacagggaaggatactggcaccctattgtaaaataaaccattacaaatataggttcatttactctggaggagagaagactttgggaatgaaagttctaaacatttgaagggcttttatacagaagaaggataagaattgttctctgtggcctcagaggacaaaagttagaatgcggatgagaagttgcaaggaggtagagtttcttgcaccataaagaggaactatgccatggagagaagtggttggcagagtcctgggatctgtttgggtacctgctgagtggttaatgtgtgtgcaagattttggaatctaccttcagaatttcttataaagtagaaattaaataagatgagaactggggtctctttcttgtggggagggaagtaaaagctgttgtagtggcccaggtagaccacttagggctgctgagaacgttgtctaccttgaaagagaaatgaagggacccaccagttactatgaatcaggaatattaccagatgctttctttacatagagttacttgtctcataacactgggaggttagtattgaaggaaacatactcacagaggtagagtaaccagtccagggctcacttttcctgtcttaatcctctcctggaatactgtgttgtcaactggatcccctttacaccaaatctactttttcttcatcgaaataaatgactcttgggtagaatatccctgcctcaaactgttctggaactttcttcagggacttggatggccttctaagtactggattttgccttgtcagtcaagaccttcttctctttcctgcagagtccttgccgagggctcttgattgcaacattccatttctttccttctgccttggtggagggtttcagagagccttctgttgaccttcttttaattgctaataattattcaattttatatagcccacagtgataaatattcatgaaaagcacagtgtatcaagatccaacactttaagctattgtgtttttttaattaaactgaaacatgggattaaatgcaataaaacgaaaaaaagagagagcatatattgttatctatttcagtcctgctgtgagactgcatgggaggccgataggaaaccttgacctgggtgctgcagtgttctgtcctaaagtatgtaaaggagacctctaaaacatctggaccggctggattcattcattcattcacacatttattcattaattcactcagcacacatttactgattgctaccatgagccttcctagtgcctctcagagggatacaaatagactagaacagggaccccaaggagctcactgttgagtcctagatgaggcagctgcatgaatcagccatgccagagttgcatagtaaatacaagcaagcacataaaacagcattcacacgggggcagtgagcagctgcctggggtggtagatgtggtgttgtagaggtggtggtccccatcaggacttaatactttattagtcctgccttcagtgcatcttttctcaacctagtgagtctcatctctaggcgtgtgccagaagcaggccaccgaccttctcctctttccctggagaggctgtcccccgtgtggactctgaagtcaggctgcatgggttcaaatcccagcgctgccacttcccaactgcataaccgtgggtgagtcatttgacctccccatgccttagtttccttatctgtaaaatggggataattcatagaacctactgtataggattgttgtgagggctaaactagtaactgcacgtgaggggcacagaccagtgtctggcacactcgaagtgccaaaatgctgacacgcgttattattatttgtgccgaggccttggcccatgacttccaggttctctggagggctcttgtgaggttttgctctgtaggaagcaggcaagctgcaggtgcgcccttgtggagagttctgaatcgctcctgagagcttctctcaagcaccagcaagaaggaggcaacgaaaagccttagcaaatacctcccagaccaccagccttcagaaggagcaggaggccaggcaggccctgcggggaacagagagcaggagggacaggcgccagggcagagagcaaactccctaggaccccaccttccgcagagctccgcctcggttcccctctctcccgggaagaggaccagcttgcgcatgcgcttgggcgtaacacatgccggtctccctgctttcccactttaaaacgggaaatgtacgttatttatttgcagcgcaggcatggggagacgctcatgaatcagcatggggattttctccaagtaaacaaacccactttctggagaggcggttgctttttccagcctgagagatgagagagagctggagagcgcagcagtgccgcaggcttcctggcaccctggagtcctttcccgggccgactccgtcatcctcccccgcccgcccctgcctgcagtgtgggggctgctgagcgaacccaggccccagccctcccacggaacaccaccaggctcgtctttttgcgtcaattcacccaatagctgtttgaagtccaagatgggcttccaggggctgtgggctgaggaagaggctctggggcaaggcttggtgggatgaacagttcaggttgattttgcttaggggccttggtttgcactctagccctgtgtggcttttagggaatcaccagccctctctgagcctaggttctttctccatcactaggggattgatcagagttgaagccagagtctttcccatggccagttgcaccctcacctcattcctgtctgctcctctagcttcctgggtccatctacactagcctctctgttctccaataccccagtaaagctcctgccccagggcctttgcatggacggctccctttctcggaatgctctgtcccctgatagctgcatggttcattctctcctcttctggtttttacttaaatgtgtcttctcagtcctgtcctggccacccagtctaatactatgttcccctccacatatttctcttttttttcctgccttagttttcctcctgtaaatgtcctgcatattgtatattttaatgatttatctattgattgcctgtcctctggtgggaatgcagtctccatgaagacagattttgtctgttttgtttccaggctgccatgtgatactgtgaaggggctggtggggggagtattatagaggtggggaaacttagcaaggcaaggtggtagaaacattttgtgattgtgtgctttctggttctcttttatttccagagctgtgaaatttagtggcctctccagaaagcagtttgtttacttggaaaaaatcttcatgctagttcatgagcatctcacctggcacacctggcccaaagtaggtgtctaatagttggtgaatgaatgaatatgaggccaggtcctggggctgcatggcctggactcttgcacgtatcacctttgtgaagctgggccagtttcttagcctctctggctttggctccctttcctgtaaaaaggggttaatgatgtaactaccttgtaaggttgttggaggactctgtgtgaatctgaataaggcctgaaccttataagtcctcagcaggttagcttttatttttaaaagtactttcagctctaacattctaattccaggcagaggggtgcctcctatggaacttgggtcaagtccttaaggaataacttatgtaggcaataggatggttaatgcatcctgcctcccaggctgctctggaagaggttgggggctgctggtcaaattgcaggagatgcagctttctccagcatatttattttgctaaaatcattgaagaaacacagctaggcagaaaagtattccaaaatgacacctgcgttaggaaacttggaggctgtgggtctggtaccaggaggaaggttgggatggaggggtctggccctggctcctgaagcaaaccatgaactgctcttgagggcagatgcagcagcccctgaagctctctgctttctgctcctgagtcttgctcaggcctggtccaggattttatctagttgttcagctcttccctggcatcatggccattgtgggggccattggcttttagccagtactctgggatctctacctacccttgacatctaagcatgctttggctcagggcctcacagaccacagaagcaggccctaaatgtcctaggagtagggacacttgtcctcaacctggtgcatccccagccaactttacagtggaccattcaagtcaaggtaacattggacctgggtcatgaagagtccagggaacaaaagaagactttgagaaggagaaagcctttttaaatttggggcacagtactcaaataggaagtttgagtacaagtctgtgtttgcctcttggtcttagagacaggatacacttctcagggctaaagtgcccaagactccacgtactttggattcagatagagcagatgctttgaaatgaatcctcactgcccacttctgttcctcataattgttctttatggggaagataaaagaagtggccagctaagacctatctggtgagtcagtatatcttccaggatgatttttgccctcagcatgaagccttgagtaagagaggagtgaccaggagagaaaggtatttttacccttttgccttgatgctatcatgatggctcattgtatagatgctgtgggtaatttttagtgccaggtggtatttgtcacctgatttttgtcccagccaaacagcagcttggagaggggaagctaggtatgggagggattggccttaggacttagaagtgacaggctcgccagttggctccctggcagcaccagtggctggcaaggtctggaatgggtccctccacatctatgaaaagtcttattgtccagccaaacaaacaatttgcttattcctgctgcatgtgtttggtaagcatcttctatatgctgggctcagggctctatgctggggatacaagatagtaagaccaaggccctctcattgagttataaccatctcagaggagagccttagaaagcctgcaaagctctctaataggggtctatagaaagctctatagtaacagagaatgttgtctacatttacatgctatcacctccaccaggagagttcacagaagtgacacagttactgtatcttgaagtttccaggaatcaaggtggtaattctgctgtggctcagggatggctctggcacgaggcacccctggtcttgacactctccagggatgtgaccctggactggtaaagggctgtgagtctcagcttcctcagctgtaacccaggaagcatggtaccaccttatagggtggctgcgaggattaaaggaggtgccattcataaagcatgcctggcatgtggcagggaatggagctgttatcattctgtaagcactatggtgctttgcttcatttcttattcctatctttaattggtgatttggttgcattctctggaatagtgacatacagaataggggaagcccattcattcattcagttaattcctccaatttttcaacattttttgagcacccactgtgtgcccggcacgggagccacccctgggacacagatgtaggtaaggctgactccttgcccttgaacattggcaggggctgcggtgtgtttgtggctcctcagtggaccctgctgctgctcagccctcttccaccactggccactcgtgggatctgtgggcagttttttttcactgcttctgttcttcagatatctcaactgaagaatgaggataatgataatatcaattttatgatatagttgaggggaataaatgagctactaaatataaagaacataatgtcaggtattggttggaaagtcctcagtgttttttttttttttttttttttttttttttttttttttttttttttttttttttatgagacacagtctcactctgtcacccaggctggagtacagtggcatgatctcagctcactgcaacctctgcctcccgggtttcagcaattctcctgcctcagcctcctgagtagctggaactacaggtgactatcaccacacctggctaatttttgtatttttagtagagacagggttttgtcatattggcaaggctggtctcgagctcctggcctcaagtgatccacctgccttggcctccaaaagtgctgggattataggtgtgtaccaccaagcctggcctgaaagtactcaatagatattgatgttgatgaatagctggaatatagacaaataaatagatagcagacatgcaatgcaaaaagccctgaaagaagactgaactaagcattgtaggagcacagaggaagcacagactctgcctacaaggcaaagagaaaggatgctgctctgtgtccaagaatgagctcactggtcaccctgggttgcttctaacacccaggctgctactccctggttccactggaatcctacagtgggcaggagcttctgggaccatctaccagtgttcttctggagtgagatcatggggccatgaacctgggatcagctctccctgcccacccaggaggaagaggcagcagctgcaaaggttgcctgcatgaggtgctctagcatatcctgacctaggtcacatccctcctgtctgtttgaacagtttctaaacccctcagccaagcagtgcctctcccagtttattgaattgcattagttttctagcctaagccctggcccaccttccccatctttaagcccttaaaaaaacttacatatgcttggaaataaggccccgttctgtatagtgatttccagtaggagcaacgattagtgttttgggaaggtagaacattctttgtggtgcaggactatcatgtgcattgtaggacttagcagccctagttctaccctttaaatgtcattggttccctcttccctttgtccccacaaatgttttctagggagtggaacatcccctagtgagacccagtagaactgagataggataagtttttgcttctattctgggcttctttgctgacattccttcgactttgggattgcccggctccctcttgcctgacccttttgtctgtgccttactggcagtgagatcctgcagccctggggtgggagagagggagctcctgggaggaatggtgtggtgggggaagtggatgaagtggaatgaaagtaggtagcacaggcatctctttagggacatctactctaatttctctcgcaggccaccatcactatctctgcggtgggagaaggtcaggttggagggtatggcctgttctttggaagtgaggctctgagcaggggcctggctttccttgaggcaaccaggggctctgtgggtatgttctctggtcttggttttgggagggtggtaatttttgttgggggagtgggacaacaggagcagtggtgaccagctggggcatgggggcaggagcacagggaatggtggaagggagtcaccaactgctgcaggcttagactggagtgacttcagcttcctgactcacccctgcaccagcctcctggataaataaagtaacaaccaatcgtcgtgagctctggacacccacagttggtaaattgcagagatgaaaagccaggtccctgtgagaccagttctactctgaggtaatagccaggaagactcaggaaccctgggggagagccatttggattcagaaggccacacaagtcttctctctcccccattttttcctcctttgttctttctccttatgcattcctatctgtccagtacccatccttccctcttccctccttgtcatcaaaacctctcactgcacatgatggaaaagatccaggatcctgggaggagccctgtgtagttggtggtccctcttagaaccacaaacccaccccgtctcaggatcctcatacatctgtttgtccatgtatccattcattcatccacctacccatccatgcatccatctgtcagtccacccatgcatccatgcatccgtctttccatctgtcaatccatctatccatccatccatccatctatgtatccatgcattcatctttccattcatctatccatccatccatgtacccatccttccatctatctattcatccatccatgcatccatgcatgaattcatccatccatgtatgcatccatccagtcatccatccatgcatccatgcattcatctttccatccatttatccacccatccatacatccatgcattcatccatgcatccatccattccagccctgccttacatcccctgtccaccaaggtggccttgtctttccaactggacagtaagctccttagatgagggctcatgactcagacttttaaaaaatcatccaaccaatctggcttggagaatggggtgctgcctaatatactttgatgctttctgagctccttacctcttgcagctgcctccatgtagaaggcaactggatgaatggaaaaaccctttcctgataccaaataccagtggctgagcttcctttaatgatgagcaacatctttattctctaaaatgagacaaccccacattcaaatgcctaggagaggccaccccaaacataaatacacactaaggtgtaaatgatctatgtgaatttcttccctgagtgtgtttgtgcactgggggtaggggtaggggataggagacagcctgaagtgtgagtgggtaccatgcaggagcagggcagaagagaagaagcccccaggtttcaagctgaagggcaataatttgagcatgagaactctgttggactggtatgtctggatccactgcctgtcaagagggtggtggggagcggagggctggaaggcacaggctctggagtctgactctggtagttccagtctcagtccctgcttcctagctgtgtgccctaagttctaagcctcaacttcttcatctgtaaaggggggacaataatagtactgaaaacatatggttttcatgaggatttgctgaaataaagcctgtgctttgctttcacagtgcctggcacataacagcccaagaatttagtgatcatcatcatccacatctctagctttgggaaaaggatttggagcaaaaagaagagggattttcatactttgaccataaatcatagcattgtcagatttagtaaatgaaaatacaaatacatttatgtgttgtttatctgaaattcaaatttaactgggtctcctgtacttagtatggcaaccctattgagtctcccagaagcgggtctggattgcctcctccgtcttggtcccaaactagaacagttgcagggtcagggaggtctccagtgaagcagggttgtgggggcaaggaagccctgcaccctgactggccactcatccagcagcctggaggctgaaagctctgaaggagggacgattcgggtgaagggagctgcccaggcagaggctgcgtgtgtgggggggcagttggagggggggacccagccgtggtgcagaagctttgagcttagtggatgcagagggcgttgtgaatcagagcacgttgactccagcgcctgccagccagcgtgggcagagagtagcagcgtgtgtggatacgtgcaggagtgcagcggtggggaccgcttctgttttcttcttgaaagaagcagcctgcggagctctgagcgttctcacccctaatgggtggattgttcggcctcaactccagttttctccctttcttgttctttttctctactctctttcctcttttcttcctcccctatcattttcttctcttcttttcaccctctctctcagattccctccacaccagccattcaggaagtacctctgtgggtgggattctgacgcatccttagttacctgctgttccatacccacagactctattccctccacgtgccaactcccaggaacctgcccaacgtggccagttattggcagcaagtccttgagtcctcactgacaaggagatgcccagggcaggttctgtgtgacccatgggagatgagccctggccccttcagatgggcatgcatgccaaggaagtgagaatgtgccacccagaagtgcctgaggtagagtatagctcagagtggcctcttactcagttaacaccctgctgctccacctacttagggcactcacactttggctcctgttcttgcctcggcatatgaggccctgcatgacttgccctctttaggcattcttgcttcattttccatcactcctgtcctcccacctggagctccaggtaaataaaactgcttgtagttccaagaaagctctgtgcccttcacacctccaggactgtgtaccttctgtgtctctcctgactcagcaagatccagtcatccttcagtgttcagctcagatacctcttcctccaggaagccctcctgacagccactggccaacttggccttcaggactcttactcttaagttctgcttacgttgcccatgttgccatccacattccacaatgtgtggacttgtggttgtttgtttgcgtgtctgtctcttcatgtagactggaagttccatgaattatatcttttaatcattcatgcctcagggcctttgcacaagctgttggttctacttgggacactttcatcttctcactgttcatgagatctcagcttaaatgtcaccttttcagagtagccctccctgactccccttacactggaaaactactttatttatattagcacctgttttatctctcagtggtttattacaacttgaccttttttttcattttgtcagtcttcaccactggatgataacatcttgcagggcaggtggcttatcagctgcttcaccatcatatacccaacacctggcccagtgccatttgctgatgggctggacagtgaggcatggagaacagaaacaccgaaggcctagagaaaaggaattccagctcgggattttctgaatttgcagactgatttctctgtaaaccgtaccatcccatcttgtctgtggctaactggttaattccagagcaggtacttccattgtgtagcatcatcagcctctcttttggcatgctttaatcttaatgtatgtttatatttgaaattcttcagtttggttgctgtccaaccaacaggaggggtcattttctggaagcatgagggatgtttaagggagagtggctgcagtgcctgggtcggctctgggtctggctcactgaggaattgaagtttcctttatcccttgcctgtagctgggaagctgggagactcccttatgcatagatctggcctgcatggcagtacctgcaaaggcataattcttggggttgaagcacttctctggaccctgggactcctcaaggtgggggtgtgggatgtggatttgacgggtcagtcctcagtaacccatattctgctgccgtgctcctctcaggagtgatgactcagaagtccccatctctggagtctcccactgagcggtgaagaatgtcagtttggaaacagcctggagagatgatcttctcagagtcccatactttacagatgaggagaccaaggctcatggagaagaaatgctttgcccaaagtcacagggttgaggcaagactggaacccaggtttcctaccacttcacctggagtgcttcaccctcaggcataggcagaccttcatgtaatccagaatgtagattcagaggtgtgggcttttgtgttgcaggaacctttatatttatattcactgtacaaacagaagccctctttttcacttcctacttttccctccttgttcatcatcatgagaacattgagttgatgaggacgaggtcttgggtttcaggatagtggacaacaggcattctcctatggatccgtgatccaaagaaggtctgctgacccctgactgtgcatcgagggaccaggcaagaccctgatagcaataactcaatgcttcctttatggaagagagcccccatgtgtgttcagagcactttgtgtttggatacagattttacaaagctgtttctatgtgtttgaccttttgaagggtccactggaaaactcttctgcagcttggcttagttcaggtgtgtgattacagctggctcaggctcagaccattgcatactttaggacagtgtccagggggatgggctttgccagcacccgtgggcagcttgtcctgcagtgctgttgccctcctgacatgcaataaaagatggggaaggaaggattccatggtaacaaggctgaagagctctagcaccatggtgtcatagcaaccaaatggaggaattccatccacatggtgacaaggagacccctggacctatcagactcagaccagtccactgcattagcaaccaggctgggcaccctatgatgggggtgagggtgggaggaaaatgaaaaagactacagtgggaggattggaagaagttgtttgtgtgggtttagaaaactaaaaaacaaaattattaaaagagacagacatagagaagtctttgctggattagcaccaactaaagagaaaaaaaatcaggccaagctttaaatcacctcttctgggaagtgtttccggattcattcgcccaatgtgggccatttagttttcatcttccctgtcttgtctggaccatttgaccctggctctggggacgacattcacttccagttctcctcctttgtttttctctgttccttttgctaactcaagacatggagcagatgctaaaataataattggctgccctgtccctcccttaccatcttattatgtggcatgtaattgtttatatgtccattttggttaattaaatgaactatataatgtgtgtttgatttccttttttctttttgttttttgaggcagggtcttgctctgccacccaggctggagtgcagtggtgtgatcatagctcaccataacttcaaactcctgggctcaagtgatcctcccacctcagcctcctaagtagctaggactataggtgtggaccaccacacctggctaattttttgttattgttgaggtgagatcttgctatgttgtccaagcttgatttccttttatactttaccttccaccccagacaagggtctgtttttttttaccctgcaatgtggacacatacaggtattcatgagctgatcaggacttgatttggggttaggtaactgtctataggctcttgtggctggtgtctgtcagcaacctggcagcctttctgagatgggatcatctcaacaaggatctggggaagggattgagcctttttcctccttccttctcagttggggaaggggagtggggatgcagagtgtgggaggccttggggagaaataacagagggaagaatggatgagggagatctgtgcctgcagcagcagaggaaagaaactgactgtcagccttctcgtcatgtgtctgtgccacagtgcctcagtggtcaagggcagctttagatgcagaatgtctctgaggctttggggcacaagatggactgagttttctgtatgtacacaatcagttcctacaaagttggaccatggcttatattactttcaatggcaaaaactgcaattactcttgcaccaacctaatacttctctgttctccatggtgcctgcactgggatgggcatacagtgggtgctccatatttgttgaatgagtcatcattcttgtctttgtccagcttacactctaactgggaaaatgaaacatttctccaaggatcaccaaacttcagagacattaatagactacacattttcaagtgttaaataagaatttgttgaccattgagtaaatatttggcagtagggcttggggttggggaagttcagaaacaattcatggtagccaagtctggtggtctaggctataaagaaaaagcatgtctctcttctctaagcagggctgtcattgcaacccagtgagaaaactctgtatctctgggggcctcaaacttcagttgaatcagaatcatctggaaatctgtttaaatctgcagctgctgagggctggcccaaagatctgattcagcagtcctgggaatctgcatttttaacaagctacccatttacttttgatgggagtccgttggggactatacacttagaaacactagtctaccccaggggcattcctcatacagtgaagcctctttgagccacataagcttcagggattgcaattcttaggggattcacaaatagttttaatagcagtaaggtagcctctgtggggctggcagatccaggaaccttgctttccccagcagaggagaaagcatcaatctagtcttttgttatccttcacttgtgcagccaggagacagattggctgagctccagtgtatggaatggaaagtgaggatgccctcacggatgtgtgaggtttacacacaggtgatgagggtgagctggcatttcagcaagccacaccatgggagctgtgaaatgcaccagaggatagagagtatccgagagatgacttgccatgttaggggatgtctttaaagacagaaaagcaaaactatttataagccaacatactttgcagagaattcagaaaaacccaaccaatatactgcactttctttcattctgacttttcctgctgcattttggctcttgggtgggtgttgaggattatgaccgcaaccttgacagtaataacccagagctgactccatacggacacagtgctaagccctgaatactccttgtctcatctaatcttcgcaatgaccctgtgatgtctgtgtaccaccactctccatttaacaattgaggaaactgaggcttcaggaataacaggtccagggatctatagctggtaattgatggatccaagatttgctgtcagtccctaggttggaaacattatccaaggaggagattcttttatttacctttcttctctctctcttgttctcttcccccatgtgccaaaatgtgcattcctctcccatccaatttatcctatatagcttctatttttggtaatttattataggacatggggagtggaaatgtaatagaaaatagatttttttaaagcatccatttgaaaccaaacctctcttcagcaagacacacaggatgagtacaggtttctacgcaggacacttgatagctgaaatcattacagaaaaacagagccttgatttgcgtggttgttagcaaagcccctctcctgtgattgtgacagatgtcttctgcttgatagattgctttccacgttagattcaaggattcttttctccccttcttcttggtgggcagagggacatgcttaccaacataaaattcagcccaagttttaaaggtgagatgcagagccagaaactgcccttctctgagacaggcccctgagtgagctgttgttggtttggggaagtgacagggtattagggaaggagctttggaagcagatggttcaaatcctacctctccagctcaccttggaccagttactttatttctctcagttgctgtgtcctgattcctagaacatggatattagggttttgaaggtagtggatgctgaggtacatccccaggatcccttcctcaggacaagccttcattccccagctgctttaagtattggcagctaagcttctccctaggaactgcactcagatataaaggattgcatagctcaaagttatcccactccctgggggcagcctgtgtccatgtcaagggtgaaaaggcctggccatcttgtctcaaggaaggatggatgcagagctccccataggtgggcatgtgcctctgttatggctgcagtatagcttaactcctgcctagccttcattcccacacaggagtttgtccttcagatactcccacactaatttacctcctacatgcacatttctgtctcagagtcctgcatatgcaactgaagacacctcacttacagggttttgtgatgattatatgagattattgatataagtgcctactctaggtcttggaaaacagtaggtcctctgaaaatgtaggttgtattttattagttttaaaatttcctagaaactcttagaccaaacagcttttctgtattttggaaaagtattgagtatgcagtcatgatcagggctcgataaatttcagcgaaaataggaatcctttggagctatgaaggaagccctcgtgtcgattcatgtcaaacttcattatcagaagtggtttgggacagtcagatcagctttgtgtaatggaattttattgtggtgatttttttctattttacaagaaatcatatactctctgaaggagaatcttcccagagatattttcacttataggaagagattaagcaaactaaatcttttagtgaggaattaatggggagaagaagtgttgtaaatccagtagctgggaggggtgtgtgtgtgtccctaaggatgtattggtggtttgttatttgctggggggttaggaaacttagtcgatggttaccagtgggaatggtcaggatattggaggctctgtggagggaagaggatctagtataccatttaaaaagaacatttcttgtaggtggttataaaagaagtagaaaagaaatgggaagaaatgcacatattactgaaatggataagttaaaaaaatgaaagaccattctttatccctgcctcccaacatgagttccattcctcagaggtaaccaccctcacaagtttagtccttatctccctcagctttcctctctacatgtgtgatcatatgcatgcaaatttgtaatatgggtatgtacatattatctttttgaaaataaatgggttccatcatgcattctactgtgtaatttgcttttttttccactcactgtattggatatttttctagatccgtatatatagatcgacttcatcctttttaatatttgtgcataatactccattaaatagctgcactaaaatttatttaaaatgaccaccattgcattaattcacaatagtcaaaatattgaaacagcttaagtgtccaatggtggctgaatggataaagaaattgtgatgtatatatataatatatatattatatacacatataatatatataatatgtattatatacacacatataatatatataatatatatcatatacacatataatatataatatatatcatatacacatattatatataatatatatcatatacacatatataatatatcatatacacatattatatataatatatatcatatacacatattatatataatatatatacacatataatatataatatatatcatatacacatataatatataatatatatcatatacacatatataatatatatcatatacacatatgatatatgatatatatcatatacacatatgatatatgatatatatcatatacacatatgatatatgatatatatcatatacacatatgatatatgatatatatcatatatatatcatatatagtatataatatatattatataatatataatatataatatagaatatatataatatataatatagaatatataatatatagaatatagaatatataatatatagaatatagaatatataatatataatatatataatatataatatataatatagaatatatattatatacatatataatatagaatatataatatacgtatataatatataatatatattatatacgtatatattatatataatatatattatatacgtatatattatatataatatatattatatacgtatatataatatataacatatataatatataatatatattatatacgtatatataatatataacatatataatatataatatatattatatacgtatatataatatatataatatatatatataatggaatattattcagccataaaatggaaggaaatcctgctatttgtgacaacatggataacctggaggacattatgccaagtgaaataagccggacacagaaagacaaatactgcataatctcacttacatgtggaatctaaaaaagttgaactcatagaagcagggagtaccagggactggcgggtggaggatatggcgatacgttgtacaatggatacaaaatttcagttataagctgaaccagttctggggatctaatgtccagcatgggtggtgatggatgtattaatttgattttggtaatcatcacattgaacaccttgaaaatattcaatttttgtttgacaagtattttaaaataaatagatgaataaataaataaacgatccctgatagatatccatgttgtttctagctgtttgatgttgtaaacaatgctgcaagtgaatatccttgttcacacatccgtgataccatttaaacatatgaccgtgacttccatagggttggatgcacagtaggtgtggagtcaataattgttaaattggattgaaggctatgtgcatgcagcttgctgagagaccaaaggggcatagctctgcttagcacaccactagaggctgatttttcaggagagattggctatcatgtagatttggacgaggaaagggtctggtgcactgaagttctcctgggcgagaaattgcttaggtctgatggtgtatttactgggtcttcttgtcattcttcatgtcacagaaaaccttttctttacatcaaagttagcctgtgcactgatgctaggagagttggtgttttcttcctttgtagttttggggcatgggctttgatctgagtgcatttatggatgatcacagggctgtcacccaagcctgttaaaatgttcacaggtgcttctggctttacatgacaagggggcctattcaaagataacagttggccggtgctgagcctccaacatgtaaataagcattgaatgtgatcacttacgaatagttaattttatgttgcatccagaacatgctctataacatagtagttgatccacagacccattaatgcatctaagtgaggggtctggtttaatgaggctattcagcatattcatggtcctgcctctggtttaattctgtcactcaggaatccaagcaagcccagcaccatggatgctgcctgcacctgttgtgctttatcaaagagtgacttttaagttttttgtactatattaccaaatgttcagagaaggaagttttcatgagggccgtgaaataattggaacaactctttctaggaagtcatggaccatgtgagttcattctgtagcattcttattttttcaaagcactctgtcatttcttttgtattgcattcttgtgaagtaaggaaggcaggcattcccagccccattttacagatgtggaatctgagagtctgagtttagtggcttgtacagagtcacatgggccctgagacccaaggcctgagacccaagccctgatttcctgttttgtggtcattgcactcttttttgcaaataacaactcaatggacatgtcaaagtggtgtacacaaagactgagtacacttacatatagcacactgagcacacaatgagtttaatatgtgcaaattcctgagtaagagttgttaggatttagttttgatttgatactcaacagcccctctttactgccacacccgtgtttcaacctgttgctgaccattctctttaacagaggcacacacacacaaatatgcatttaaggatgatcacactgctcccacaaattaaataaaaagttattttggaagaaagacggatgatgtcattcataattagacccattattgaacaaatggctatcctgtgtaactctaggctggacatagagaaggccagaactttgcaaaagaattgtccctaccctgagaggctggcattgtagttggggagatgagaagatgcaattagataacacagggaagtgtgtaatcagttgtccatcatgagctatgaaaacctttatttccctaggattttggggaaagtagggtcactgtgggatggaggagtcaaggaagcagcatgggtccttaaattctcgtaacaaaggatcttaggtgctaggtggaatttggatgaagggaatgggaaaaggaagacgattctatcacactataagctccaaaaatttggggttcagagaggaaacatcagatagctgtaaagagaagggatccatcgtcttctgattatatttgttagtttccagaggaacttacagagtgcccaaatcactgattcctgggacgttttgcaaataaaagtcccaagggtttaggtataaaaggataaaagcctggaccaccaaatgtcttgcagactcaatactttggactttagctgtgggtgtcccagatttcctagttgtcattgctatgtcatcaccatcatcattatccacatgtgacatgtttgcagagctcttgatgggggaggttctgtggtattagaaaacttgtttccctggagtctccttaagaatataaaactgaccctaaatatgaatcagtattttaccaagtaattgccaaacagcaaacaagtatgagctcagagggaagagttaactttgggctaagatatctaggatggtttcaaagatgagatgggacccaactggctcttgacaagtatgtgggctcagcgtgttagatgaatgagtagaagatgaatggcaagaccattgcagatctttgaaaagaccttagaaaactacctttggagatgtgtggaagtaggaatatgatggcatgtttgggaaagagtagaccagcttttttgaagagccgggtccttgtgggatattaggtaaaaggaggagaaaggggctatgatatggggtctttaatgtcagtttgaaatgtctaagaatttagatacaaagtattataaaaccacaaaggtaatcaggaaattctagattgttggaaaatcataggagctaatagattttttaaaatatgaatgattctaaaagatggatgatttgctgttacctgttatggtaactgcatctggatgcaatgtgagctttgttctagtagcaattcattatgagatacttacagattattttctcacctagtcttgaataaaaatgtaataaatacccatccaaggggctgttgacaaattgcaaacataatatgccacagaccagaattaagtcaaagcattgcctaaggttgggcttcagagtcacaagtggttgcttggacgctgagctgtgattttaggagtgggtggtttgccctgagccatcggcattctgcttcctgatcactttgtgtaggaaaataaggtggcctgaggtgtgcattccctgtactggtcaggaagctttgagtgacaagtgaaagaaatgaaactcaaaccttaaccaaatgaaaaacttaactaaaaatccagcatggaagtagcttcagtcatggctggagccagagaggctcagtgtggttatgagtctggctttttctctctctgtttccaatgctgctttcctcattgttagtttcatgttccagcagactccatgtgatgggaaacgtgtgttctggcaatttagagcttgcattgaccaaaggagagtaggtatatattctctttctcttcctttcttcattttatccctgaaattgttgaccccacttggatcatgtgtctaccccacctctggaccaattactggtcagcttgaggaggcagaactctctaattgacagcctcatcagaataaaatggagtcgggagagcagtttccgaaggaagggacatgggccagactaaagtgggggtgggtagggagggagagatcaaagtgataccaactgatgctgactgtcacggggtggggctttatggtcttttggctttaggtgctctccggtccacacagccagcctcatgcctagaataaaaggcaggggctcagccttagcctggagtacaacaaaggatgtgaatatcagagacagggacctattggatctcacagccaaccacagcccaagctttttaagtctgtagaaagtgacttacctctttgaatttttattccgaattccagttaaagttattcatactgatagaagactattattgcttagccttcagaagaagaagaggttgaagttcttcccttagaagttaccagaatttaattcgtggaaagttttccatcttgcatttgctgtacttggactaaggctcttgtaggagataaaatccctggcttttgttcctatttactgtgagttctacctctctggaaaacaatctgggcctggagaaaatatacataagcaatgtttagcatttacctgttagggtcttataaaaatctcatagcaagtgcagttaatacatcctttccaaaccatttgtttggagaaagaggacaaggggtaggagacggatctgattttctccatttggctgatacaggaagtagtacataggagggttaagagattttcaaaggaatattagtggcaaaactgaaagacagaaaattgcactcttaattacaaatcagttttcttaacaatcggtctttgtcttttctgattctagtatgttatttcctttcaaaagggtagcaccttcaacagtcactttcactggagagcccattcaaatccattggtgagcccaacggatcgtagccaagaaatcatttaatgagatctagaccattttacaaggcatgctgggtttccatttattgtagtactgcattcaatgtgtgcatttctctgatttttctttcaaaatagaatgaaaaaactttgttttctgtagctttctcactgattgctaatcctaagtgcagtggtaatgaagggtgtagctgtctggttcaagagttcaggcaagagtagatattattgacaagaggcttctaagcaggtatcaagtattgaataaatttgttttgtgatttttttttcggtattgggtagaaaaattatcctttccagcactctgaacatcagtaatattttatttaattttggctgctattgttgatgctcatgttgttattatgtgagtttgtgtgaggagctggtaaatttcttttgtaaaagggcatattgtaaatattttggttttgtgggccaccgggtgagctactggactctgctattgtgtgaaagcaaccatacacaatgcatacatgaatgggtgggcctgtgttccaataaagctttatttactgaaacagatggagggtcagacttggctcatgggcagtagtgtgcagactgctggtgtatacagtctgttggattctgtctatgcggaccgctgtgtttgagcacaatggaaacacactgtgttttcatatggtttctgcagctgccatccagttcccttccttttcccttcagaactgtgttacaggatacaattaatatcactattactttttgagacctagtctctctttgtcgcccaggctgcagttcagtggcacgatttcagctcactgcaacctctgcctcccaagttaaagtgattctgctgcctcagcctcctgagtagctgggaatacaggtacctgcccaccaccatgcctggcaaatttttatgttttcagtagagatggggtttcaccatgttggccaggctggtcttaaactcctgacctcaagtgatccgcttgccttggccttccaaagtgctggaattacaggcgtgaaccaccgtgcctggcaggatacagtttttaagtgatgtttccaagagctccatttccaatgtttgcattttcatcttaagagctatgaaccttggactgtactcaggggcctgattttagttcttcagaagcaaagactgtaaaaatcttcctgttctggtgctggggttcaggtacatggtctagtgaaatggcactagacaaatgataatagagtgctagactgggtgaccctgagcaaaccacttaatctcactgagtctggtttcaactatacgaatatctagcttgctcattccacagggttgttgtgaggatcattcattcattcagtttctctttagtgagcacatacttcctgccctggcttttgctaggcattggagaaataatggcaaacaaaacagggaaaggcctacccttatagagcttactttcaagtgatcaaatttgttgatgtaagggagagaacacttcaaatcgattgattatacaagaagttagattttcctgaccattttaaacaaatagcatcccaaagtccaagggaaattttggtcattttattaagaagttgaagtctcaagaaagccagttggatggcagtttagataaaatgattcgggttgagggccagggcagggaaagaatgaaaaccaagtttaaaagtggcctgataggtcaaatggtatttctggttctagatcctcgaggaatcgccatactgtcttccacaatggttgaactaatttatgttcccaacaacagtgtacaagcattcctatttctgcacagcctcgccagcatctattgtttcctgaatttttaataattgccattctgactggtgtgagatggtatgtcattgtggttttgatttgcatttctctgatgatcagtgccatcatcctcagcaaactaacacaggaacagaaaaccaaacactgcatgttctcactcataagtaggagttgaacattgaaaacacatggacacagagagggaaacaatacaccggggcctgctggagggtggggggtgaggggagggaacttagaggatgggtaaataggtgcatcaaaccaccatgtcacacgtatacctatgtaacaaacctgcacattctgcacatgtatcctgtttttttttttttttttaagaagaaatgaagaaaaaaaaaagtggccttatagagctgctttctactaaagttcacttctgaaagaaatcagagaggttttcgactccatcagggttccaaacctgaggagattaccattaaagtcagctagtcaagggtaaaaattagagtgtaggaggattcattttgaaacattgtcagcaaccagctggaaaaaaatagcagcgactgtgattactaggaaatttcttggagggtgtagaagtgtatcaggtaatctaatctgtcacctacttcagtggcctttgggtggttggataagcatttcagtttagaagtaaatatcactgaacaggagggagaataacatggttatttaaaactctgaggccttttggccagttttggatttgttgtcagccagacctgatagctcatccaagtttccttctatgactttttttttttttttttagacagggtctctcactgtcgcccaggctggagtgcagtggcacgatcatggcttagtgcagccttgacttcctagactcaagtgatcctcccacctcagcttactgagttgctgggactacaggtgtgcaccaccatgcccagctatttttgtttgtttgttttaattttttagggacgatatctccctatgttgcccaggctagtctcaaactcctgggctcaagcaatcctctggcttcagcctcccaaaaagctgggattacaggaatgagtcaccatgccccagctgacttctacaggttcaactacaatatttacagagggagatctttgggtcctgggtgaggagggaaactggggatggggtagggatgggtaaaggggtcaacaaattagaggcagacctgcttacagccttctgaagatagactttctgcagaatgaatgtgaaaaggttttgtaaagtgtaatggaccaatttttccctagtactctagggaatgtgtgttccatccatgcagatccttgcatcgtgcctgtaaaatagcaaacatgcaagcaactgtggaaaggatcatctttgccatcttatgttcagtgttccagccataccaactcatttgcagatccccaaatgcactatgtgcctttatagatgctgttttggtgcttggcctactctccccctctactttgccttgctagctcttgcatcctctttaagagtgtacacaggtgccctttccttcctggaggttttcttctctcctcctccaccacaagtctggttcaaatgctccaccttaaccccctcttccctcatttcccaaccccagatatgtctattatagcccatgtctcaataaattgtagtcatttgtattttatggtggagaccaattcttggtaattgaaaaatttgtctgaactttaggggaatcattaaaaaatacataatgccctggacatattattttaacttaaagtttagagatgtgtatttatttgctcatcttttgatatgggcaggccttcgtttttttttttttttttttaattggtctgctgattagagttccggattatctttcttgtttaactcacatccataatacatcatctatgatttccagtgcccgattttttttttcatggaatagaaaccaactgggaaagcaatttaaagactctagattctccctactcccagtattttatacttttcccactcacaccgaattaggttcaactacatttttaagtgacttacctttatcaggtctttgcaaaacatttaactaaactttgacagaagcttttattggtactcatcttctgttgatttacatattacttaattaaacaatgtaattataatgacatgtaatgacaatgataaatggttttgagaatggacacggttggctcctgtaaacacatacctcagttgtgggagaagcagtgcttgtgtatatgagaatggaataacaggtgacccgactggtaggagtagcatgaagtaggcatcagaagcaatggagaatcccagttaatccagcagctcagtggagcacaagttaagggagcaacatagattgagctagcccagtgcctgttcgagtggatattcaataatttgttaaataaatgtgagaatgatccaggaagtcgagaacttctggggatatgagcttcaggaccactggatttgaactcgtaattggccatctcctctacctagaggggtgctgggcccgagtcaaaagcctagaacttaaccactgtctgcaaaatgagactgtgaagagaaatctctctccaataacagggtgcagatttcttgccgaggctgctagctgttgctgacgagtgagtatgaaagtctccctccttgctccctggatgacctctttgccattccttcttgtttaagctcctcttctttggctctgaaacctgtgaaatgtttggagactagagtttcttttgtttgtttgtttcttttcttcttctttttttttttttttttttttttttgagaaggagtcttgctctgtggccagactggagtgcagtggcaccatctcagctcactgcaccctctgcctcccgggttcaagcgattctcctgtctcagcctccggagtagctggggactacaggcgtgcaccaccacgcccaggtgatttttgtatttttagtagagacaggctttcaccatgttggccaggatggtctccatctcttgacctcgtgatccgcccacctcggcctcccaaagtgctgggattacaggcgtgagccactgtgcccgggccagagactagagtttcttgagagatatactactgaaagaagctatctgtattaaaattcagtatgtgtaaactactttaatgaacctggttccaccgtagcatatgggaagtcagatggtaaggggtgcgatgtatgcatcagtgtccctctcctggtatagtcccacttccctgtggataaatttaccttacctatagggaggcactcacaagaagcttatgcacacacacatacacatatgtacatttatgtgttttatttatacctacataaacatgtatatgcacacatacataatgtatacatgtacatctataagctataggtctataatgactttttcttctaaacgtgagaagaaaaatgattttttcttttaaacgtaagtgtgggcacgtggaagattgctgtggttgcaaggtcagctcttgcaatctagggactgtggagagagacagagactaaagtttttcatatgtgtgtggtattggagtgggggttgcttaaattaataagttaatggagagaagtgtgagctatctgaggcatcgcatagagacagggcagtcaggcttatccacaagaaggagcagtgggaattgagtccaagagccagaaaaacatactgatgtagtggctaagagcacgtttcctagtttcaaatagttgtgggtacaaaatctggctctgctacttactagctgtatatctaggcaacttaccttagtgtttcatggtttagtccataagaaagagaataataggacttccttcacagagctggtatgataattagattttatatgtaaagtaatatacatagtgtcagccattcagtaagatacttaaaaatgtgatattcttataaatattaattgtatctggggacagcacaggaacctgctatgggggcactttttggtagtaattgagatctaaagaccctcactgaaccagactctctgattaacactgagtagtaaagtgtagttccaggtactttggggctagggggaatcaacgaagtagatttcaggaccaccacaatgcaggtttgcatataataggagagaggtggccaacatccatagaaggaggacctgaatcacattcaaggaaaatatataaatgaatatcaacgatgagatcctatcccatgcaggggttgagataccctgggcagtttgtttcacctgcctttaatcactgagattaacactcaaaggctgagagctagttaaaatgtatctgcctcctgcctatttccgaaaccagaatagaatgcctgttgcttcccttcccccatccccagcccactccaagcctgttctttatcccttatattaggaaggatttgcccatgacagtcttgagacctaatgtcagatacacttgggatgcagatcttttattgaagagaaggttggacttgacagtgagaggggttgagatgaatgagtttccattgtatttatagaaactcagtgcaatatctctcaaggtataaatagaacaatgaagtgttgacaaaggggctggttttctgtaactgtggaaaccctgcaattattcctggaactacactcattgtttatctgcatctgaattttaataaacagggctcttgctgcttattcatgaattttcaaatggaaatatctctcccattattatccccttcttgtgagtcaggccccatcttgcaaatttgcagctgagtaaatatacggaacattagcagcaattagataattggtgccccggatcagcccacccacagctgtgaatgaatatgggctgcatgagtgtcacctggtgcagccttcctgatggcactgcatgccaccacagtcttgcaattaagcacagaattttaccagccttagtcctggccctcctttctcccaagagacccagactagcaaggtaagtgaggttccctattcttccagctgtcatcatacaatgagagatgttaggccaaagaagttggtaaagaagagaaagtccatgtatcttcgcttagctgattgctaaattgcttctgataacttgtttggtgcatatagccagcaaaaattcatgtttggatctgggctggggagttgggtcataaatcctgtttttctgtaaatctcccaaaacttgctagctctgggctggccacatttcttcccccccatcatcagttttttggcctctggcattaacttgggattccttttagcagccatattttaatctctctttcctttggataatatttcttccaggcctcagactgcactgggtgcctttgccagctcatgctttgctcctgttcctcaggcaatcacaaagcccttttgaggcatatagattttgttttttaattgctagagacttcaggaaaacagagtactattgcaaaagggaaagtggcaagagggctgcgcctgctattatgacattatgatggaggctcattagcgtgcagtggagccacttcttttcctcctctgccttggccacctggcccatctcctcgcttttgcttttggttagacagcaattctgtctagccctccagtctctcacactcattctccagcctcacactccctggaagctttcccaggttacttctttccttttttattgcatccaccttctgtgtgtttgggaggaggcgggtagagagggagttggaaatagtgaggtagagggggagatttgggttgggtgtttggatctgggaatgcgtcacatggaattcattcatctcctggagatccttccaggccacctcactgtgtccctgcatagcaggaatgtcatattgggcaatgaacagtggtctccaaggaaagctccagaagaagttgaagtctgggtgggattttgtgccaattctcccctgtttttttgatatgtaccatccctttataggcatgggatacattatcttttgtttattattagaatttttttacattgctaatatttaacatcattcatgtaatactaaaagtacatttcctgtactgagcacctactctgctttatgtacaattatatatcttttcagcaccccatgagattaatcttatgatgtccatttgacagatggggaactcagattcagagaagtttaggaaacattacaaggtcacaacagctagtatgtggcaaagatggagtccacacttaggcttaactaattgcaaagcccatactctgaaactgtgctaaattgcaggactcaagtcattttgggatacaattaatgtctgacttgttctttgcttgagagtgagatgttatctgtatagcctgcattttggttccttaaataatgtgtccaatttggtgaagccattaaaaacacaaactcaggcagtggtgttggtttttttttttttaattaaaaaaattttttttaacctttgctgaattttcccttctagctagaaactagttttcccagtactctcttggttcttactgctgccaacacatcagatgtatcaaccacctgaaattgggctgcaggggtagaatttatttgcaaacattttaatttccctggtgataagcaaattaattttgttgcaactctttaacattctaatcgaatgatggaatgtcactgaatgtattttacagatcaaagacagccaacgtcttcccatctttcagaaaaaacagagctgagacctgagtctgcattttcctttgccctatagcccaacccagcttatcctcctgagcttgagaaaagtcatttgactgaggctgtcaaatctgcaatccagccaaagtgctggcagtcacctgtgctggggaaggacctttgcttcatttattcatgtatcacatatttcttaggtgtctactatgtatgtaccaggcactgttctggctcagtagtgaaaaaaacgggcaagtctctttgctgttctctcagaggaggcagaggataaactaatgaacaaatgcaatgtacaatccatgaagaagagcaaagcaacataatacatacagaatactggggttgctgtttgagagggcttctctggggaggtgatatttgagaaaagccagaatgaagtgacgaagaacatttcagccagagggaacagcacatccatgaggtttatgctcatcttcagatcaaacccccacccccacctcatccagagcaatgaattgtcctgaactgaatattctgtagttgtccattcttgtggctcataggagctttctccagaccaacttctttggaaaatgcttatttcatctgagttcctctctcattaagaagtttagggaaaagtagacagcatcaccataaaaaggcaacatgtgaagcatgaggaggaggggacagtaacatggatttgcaatttctgcctctgttggccaagcagtggcatttgtgagtagatggaacaaaatgttgggagattagatggacgtttccaggatcatccattgcaaatatttatcaatttcttattatgtgctagagcttgtgagatgaggtggaaccactttggtatgcaagtcccttcatcaataatttattattgttattaatttatttttattgaacaaatcttagctgtcattattcttgagcacttacaatataccaggtactgttctaaccactttacatgaattaactaatttaatcctcacaacaggcctaggttcttttattgtccatgttttatgattgagaaaaaggaagcacagagaggttgataattgcccagggttgcacactgacatctgatccaggttttaaacttggacagtctgggaatgaacatctgtaatttactgcgggccatgcactgtggtgagagctgtcagcttagtgcttttaagtggtgagagctgtcagcttagtgctcttatctttacatgagaaaactgaggctggaaaggtcaagcgtcttactggaggccacatagttgggcagctgcagaatccagaatctaacatgaaatctaatctttctggccgtaaggctgtgttttaagggctctgttaagctacccttcctagcaatccagctcaggccacactcactttctgggagtgcagggaggaccagagctagctcctgccttgggcaatttcccagcaccaagttgtggcccctcctctgccttgcatttctgcatagagacagattcaaggtgagaactggcctctggggattatggtggagttgtactggaaggacttttggaagcatcacaggctactgagtccagggtattgtggctctgggacaccttgaggaaagttcagagttggggatatttgagctaagggtgttgtcctgtgagttctgtgcctggaggacataggaagggaagggaagggaagtgaaggaggatggaactagtttatgccaagttaatcaccactgcctgccccgcttttccatatctctcatgatgtttctatggcacccttccaataaccaagttaccattagttttcaggtttttgttcttattgtactggatcctcagcacataagtttctcccctttcctactctcgtgattcttccagataataacaacaatcaaaagtagcaacaaataatttggctcattcttcccactttacaaagtactttatgtatgcatcatctccttgaatccggttaacaaccttgtgaaatatcattatttcagacctgtaccagtatgaggaaatgggggttcagaaaggttccttgacctgcctgttgccacacagctactaagtaactgccagagcccaattctagttgcttaactcttcccctttctgccacgcagcctctccaaataatttcctaattagtctatttaacgattctctgtcaagctggcttcagttgcccttgcaaagacaagcttgagtgaaatcaaatgatttcactgctgaatgaaaacatttgcatgatgctattttctaagccatcctcacatgtgagtctcttggctcaggaagccaatccaggttgggggagagctgtagaggctgaggagggataggattcctttcttgtcataggtgagctagttagaattcccagagcctggcagcgtgttccttgaagggccagtatgtctagggaaggaagagacagaggaggcctccatcttgtaacaacagtaagtgttcctcttgctgagaaaatgctcacagctgaaggatagctatggacctactgcttccaacataggaaccctctttccaagtggtcttggcccctaagtaacccagatgaggacaaactggataattcagtcaaggaaaattaacaagcacctactgtgtgatggggatatagcaatttataacccatggtcttgaggggtttgctttccagtgggtgacagtcagtaaacaaaataaattattccgtatgttagaaaatgctatggagaaaaataaagcagggtatggtatgtgctatgggtgggatttcagataaacaggatttaaagtaactgggcaggttttatttattttcaagatgtgcattcagtttattaaaaaaccccaaacacgaaaatttgcacagggccaggcagtgcaatataccagcctttctcaagtgtgtgtgcgtgtgtgtgtgtgtgtgtgtgtagtgtgggtgcgtgcatgcatataaaatgaaacttcaaagtgacaagaaagcttttactccaggcaggtgctatgtcacctttcctcatctgtgctcttcccaacacaaggttgtcatctttgttgcatgtgggtggtggtaacaaagaagaagtcccaaccctcctcagcctcagcagcctcctgtaaacctgagggaaaaatcagctttcaccttttgtccttttctgtgggatgtttttctttttcttagctcatgtcatcatgctagctgtacgttttttgggtagatattctttaccaaactgaggaagttcccctctgtttctagtttgctgagagtttttatcatggtagatgttggattttgtcaagtccttttcccacattgattgatgtgatcgcagggtttttcttctatagtctgttgatgtagcggcttacattggttgattttcatattgaaccaaccttgcatatctgggataaatcccatttggttgcattatataattttttttatatattgttgagttgatttgctaatattggttggggatttttacatgtgtgttcatgagagataattcgtctgtagttttcctgtcttacaatgctgttatctggtttgggggtattatagaatgcttctgttttctagaagagattgtagaaaattggaatcatttctttcttcagtgattggtagaattcataggtgaaagcatcaggcctggtgatttcttttttggaaggtttattattgactcaatttctttaacagaaatagggatattcaagttatttatttctccttgtgtgagttatgctagtttgtgtctttcaatgaattggtccattttatatgaagtatcaaatttgtaagcatagttatctgtagtagtaatttattatccttttaatgtcagcagaatccataatgatgactagtcttttatttctgatattggtaatttgtgtcttttttctttttttcctggttatcttcatgagatatttgtcatttttattgatcttttcaaagaaccagcattaggtttaattaattttctctattgtttttctgttttcaagttcactgaattttgctcaaatttttcttctttctttttttctcacctgctttaagcttaaattactatttttcctctagtttcctaaggtgtaatcttaggttcattgattttatagctttcttattttctaacatatgcacttaatgctatatttttcctgttaggcactactttttctgcatctgacatattttgataagttgtattttaattttaattttgttagaaatatttaaaaacttgtcttcatttttgacccaaagttatttagaaatgtgttgtttaatttccaaatatttgggaatttttacaactatctttttgtggttattggtttctagtctaattccactgtggtctgaggacatactttgaaggatttctattcttttaaacttgttaagatgtattttattgctccaaatatggtgtatcttggtgaatattccatgccagcttgagaagaaacacatattctgctgttattagatggtagattttggagtttcatgccagttttagattcagatcaagaccacagacttccctgcctttctctctgagcccatacaatgctgccttcccagtagggaagctcccagcatggttgaaagttaaatgagggtaactttcaatcagacaagcaaccaagtcacaggcattattaggaagaccagagtcaagaggacagggaggagctgggtgatgggtcataggctaaattatatgtggggttgggaggaatgagtataatttaagctcgtgttgtattaccacctgtgcttggtactccataccaattattttgtgtaagctaccttagtactctccaaagtaggtgggatggctaattttgtgtgtcaacttgactgggttaagggatgcccagatagctgggaaaacattatttctgggtgtgtctgtgagggtgtttctggaagggaccagcatttgaatcagtagactgagtaaggaagattccaccctcaccacggtgggtgggcatcatccaatctgttgcaggcccaaatagaacaaaaaggaggagaaagggagaattcactctctctcttcttaagttgggacatccatcttctcctgtctttggatgttggagtttctggttcttgagcctttggactccaggagttacaccatcagctcccctggttatcaggccatcagacttggactgaattacctattggctttcctggttcttcatcttgcagacggcagatcatgggacttctcagcctccataattgcgtgagccaattctcataataaatctcttcatatgtatctgtatatcctgttgtttctgtttgtctggagaactctaatacagtacagtacatcgaaggggtaggtgaaacactagatcttctgtttttgtttttgaatctcattgttttactatttctgtttctaggtgtattttaaaatgtatggaacatagtagtagaaaactataaagcagataaggactagttcttatcacctccactggtaaaaccctggtgtagtcaccttgatctctcactaggattattgcagtagccttagatctattctccctgatttcagccttcttgcagtgtgatcacaccaggtgattctcttacacacaggtcaggccacgccaccctcttctctggctttctggtgtatgccaagtagagccaaagttcttactgcttatcttctcccgtgctgctctcacctctctcctgaccacccatttacaggagtctccttgctgcttccacctcagagctcttgcagtggagttccctctgcctgaatcctctttccccaaatctattcaacttgcttccttaatttctttaagtcttttaaatttgtaccctgctgcatttcccagtcccccttcctgcattatttttttctcataacattttcactgtcggacaggtaatttacttatttattttatgtattgattatctttcccaaactagaatataagatacacgaggacaaggtttttgttttggtactgctgcatttctggagtctgatatctacacggaaggtcctcagtgaacatttgttgactacatgaaagaataaatattgcaggagatgttaaactttgttgagtgatggggtgcataatgaaaacattaggtagcctaagagaagtaaggctgagttcatgctgctgctagaaagagggagagctgagtttcaaattcagggcttcctgatgccaatgctcacactaatccaagatgccatgggggtcggggagggggcaagagagagagacagggagacagggagtggggagagagaagaatgaggatgagaatatgaatgagaataagaattgaacttaaaagaaatcattaggaccaaggagagcaaataggacccacgtttagtcagcaggcagttcttttgggacaagaaatcatcttaattcctccaggacctttaagatctggttgtctgcggaatgttttggggttgggggagagtttctttatctcctgcaagttccctgaagttgagtctcaggtcagtggagacagatctccctccatggtggaccattgtcatctctatttgtagggtttcacttagtgagttagatgtcagctggcactgcagttctgactggaagagagaaagcacttgaagagcttccctaccattgagggagaagtcatttttctaattgtcttctccaccaaaaaagaagtatattctagccttgaaaatggcagcatgggccaggcacagtggctcatgcctgtaattcccgcctttggaaggccaaggcagaagaatatcttgagaccaggatttcaggaccagcccaggcggcatagcaaggcctcttccctatgaaaaacaaattagtcaggcatggtggctcacacttgtaatcccagtttcttggaaggctgagatgggagtatcacttgagcctaggagtttgaggctgcagtgaattatggttgtaccactgcactccagcctgggtgacagaggggagaccctatctctaagaaaaaaaatgtaaaaaaaaaaaaaaaaaggaaaaagaaaatgtcagcatgcagtaaaacaaaaagaaagagatgttctgttttgacctccttcaggtttccttctgttctccagttccttttcctactcagagcattatttcttcctttccagtcccggacacctagagctcacccacaaggcgcccagcattgttgcctgctgtctgtgtgagctggtcttctccactgggctctttgtgggtccttctctttttccctttcagttgctacctttgtttatgagtgtcttctccctgatgatcacatagaaaaccctggggcagtgacaagtaggagacctctgagggcaccacctgcatattgtgcttgtgagatagtcacaccatccaaggaaaacaattacagcagaaaacagagggtcagagctgggcagtttgatgaaatttaagatttaaaaagcctcaggatactgaattatgttaatcataagtcttagtccatttgggctgctataacagtataccacagactgagtaatttataaataagcaaaaaaaagtgtatttgggccaggcatggtggctcacgcctgtaatcccagcactttgagaggccgaggcaggtggatcatctcaggtcaggagttggagactaacctgtccaacatggtgaaaccccatctctactaaaaatacaaaaataaaattagccaggcatggtggcaggtgcctgtaatcccagctactcaggagactgcggcaggagaatcgcttgaacctgggaggcggaggttgtggtgagctgagattgcaccactgcattccagcctgagcgacagagtgagactccgtcctcaaaataaataaataaataaatgaataaataaataaataagagaaagaagtgtatttggctcaagttttggaggctgaaaagctcaagatcaaggggcccctacctggtgtaggcctttttgctgtgtcatcccatggcagaaggtagaaaggcaggatagcatgagagagcaagagagggcgaaacttgcctttataacaaactcacccttacaatgatgaacccgttccctccataatgacattcatccattcatgagggctctgaccttcatgacataatcacctcttaaaggtaaccacctctcaacactgttgcattgggggttaagtttccaacacatgtgctttgggagacacgttcaaactgcagcactgtagaagaaaggtttgtgtaggggggtgcctctgaagtacaattagagtctgagaaatctgatcccactctgacccttccctatggtatctactgcaggaaataaatctggagcctatccaaggaggaatagattgcagtaatgggcccctgctttgaggaattaggtgtgttgagtgtgagaatttcagtaaagaccataacagaaggaaactcagttctgaggtcaatgtgatgaacaaagtaggcccgaggaactggaggaagtccaggaaagtgggagaaatgttaggaatatgccattatggaaatgactatttgtctacagttattaagaatgttggaaaaaagaaaaattctggttttatttcataaaaataaagaagggaactgtctaagacagtgctgtccaattgaaatataacatgtgccacatctgcaatgtaaattttctcatagccaagttaaaaaaggaaaaagaaacaagtgaaattaatttgaatgatatattttaatttattcaatatatccaaatcttatttgaatgtgtaattactataaaaatattaattttatatatatttttcatactaagtatttgaaatcttgtatttgacacctaagcccatctcaattctgactagccaccttccaagtgctccgtaattacatgtagctaatggctgccgtattggacagcacgggtctagaaggtcctcttttcttttctaaaatcctgattattttattccttcctcattataagcataccctggttttgcttgtccttcatgcttcagtgtctagcgtgtgtgtgctgcatgtggctttggttaatggttgcaggggtataggtttgtcaatgtgattgaatataagtaattcgagaatggagctatgtctttttacttccgtattccttgactctgaaagaattcctcgacttctgtattcatctgaaagaatggaaaggttgtggagaatggatggtggatgcccagggaaagacattactccatatctctatctgatcttagactaaattgcttcgcttctctgctcttctccttctccgttaaatggggatggtgggatcatttatacctgcctccaggattgttttgaggctaaaggaacactgaatataaaagacacttggaaaaacaccatgcatgtatgtgagggtgtatttattactttaagatcattgaaatcagctggtttgtctctctctcttcatgtgacggtaatttctttgccagcaggaaaccatgagaattatgtgaatgagaattatgctcttgccgagattggaagtgtgtgaatgtatgtgttggggtgagggggaacaaatggatatggatctgaaagttgtctgatgaaagatttccccactttgtgtgtaagtccatgttagaaagctaattagaaagccaggtgagctttctgctcataggtttttttttttttatactttaagttttagggtacatgtgcacaacgtgcaggtttgtgacatatgtatacatgtgccatgttggtgtgctgcacctgttaactcgtcatttaacaataggtatatctcctaatcctatccctcccccttcccccgaccccacaacaggccccagtgtgtcatgttccccttcctgtgtccatgtgttctcattgttcagttcccacctatgagtgagaaaatgcggtgtttggttttttgtccttgcaatagtttgctgagaatgatgatttccagcttcattcatgtccctacaaaggatgtgacctcatcattttttatggctgcatagtattccatggtgtatatgtgccacattttcttaatccagtctatcattgttggacatttgggttggttccaagtctttgctattgtgaatagtgccacaataaacataagtgtgcatgtgtctttatagaagcatgtttataatcctttggatatatacccagtaatgggatggctgggttaaatggtatttctagttctagatccctgaggaattgcctcactgacttccacaatggtcgaactagtttacagtcccactaacagtgtaaaagtgttcctatttctccacatcctctccagcacctgttgtttcctgactttttaatgatcgcccttctaactggtgtgagatggtatctcattgtggttttgatttgcatttctctgatggccagtgatgatgagcatttttccatgtgtctgttggctgcataaatgtcttcttttgagaagtgtctgttcatatcctttgcccacttgttgatggggttgtttgtttttttcttgtaaatttgtttgagttcattgtagattctggatattagccctttatcagatgtatagattgcaaaaattttctcccactctgtaggttgcctgttcactctgatggtggtttcttttgctatacagaagctcttgagtttaattagatcccatttgtcaactttggcttttgttgccatggcttttggtgttatagacatgaagtccttgctcatgcctatgtcctgaatggtattacctaggttttcttctagggttttgatggttttcggtctaacatttaagtctttaacccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccattgatctatatttctgttttggtaccagtaccatgctgttttggttactgtagccttgtagtatagtttgaagtcaggtagcctgatgcgaccggctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtattctcttttattttattgagcagtggtttgtagttctccttgaagaggtccttcacgtcccttataagttggattcctaggtattttatcctctttgaagcaattgtgaatgggagttcactcatgatttggctctctgtttgtctgttattggtgtataagaatgcttgtgatttttgcacattgattttgtatcctgagacttcacttaagttgcctatcagcttaaggagattttgggctgagatgatggggttttctagacatacagtcatgtcatctgcaaacaggaacaatttgacttcctcttttcctaattgaataccctttatttccttctcctgcctgattgccctggccagaacttccaacactatgttgaataggagtgatgagagggggcatccctgtcttgtgccagttttcaaagggaatgcttccagtttttgcccattcagtatgatattggctgtgggtttgtcatagatagctcttattatttggagattcatcccatcaatacctaatttattgagagtttttagcatgaagggttgttgaattttgtcaaaggccttttctgcatctattgagataatcatttggtttttgtccttggttctgtttatatgctggattatgtttattgatttgcatatgttgaaccagccttgcatcccagggatgaagcccacttgatcatggtggataagctttttgatgtgctgctggattcagtttgccaatattttattgaggatttttgcatcgatgttcatcagggatattggtctaaaattctctttttttgttgtgtctcaccctggctttggtatcgggatgatgctggcctcataaaatgagttagggaggattccctctttttctattgattggaaaagtttcagaaggaatggtaccagcccctccttgtacctctggtagaatttggctgtgaatccaactggtcctggactttttttggttggtaagctattaattattgtctcaatttcagagcctgttattggtctattcagagattcagcttcttcctggtttagtcttgggagggtgtatgtgtcgaggaatgtatccatttcttctagattttctggtttatttgcatagaggtgtttatagtattctctgatggtagtttgtatttctgtgggatcggtggtgatatcccctttatcattttttattgcgtctatttgattcttctctcttttcttctttattagtcttgctagcggtctatcaattttgttgattttttcaaaaaaccagctcctgtattcattaattttttgaagggttttttgtgtctctatttccttcagttctgctctgatcttagttatttcttgccttctgctagcttttgaatgtgattgctcttgcttctctagttcttttaatggtgatgttagggtgtcaactttagatctttcctgctttctcttgtgggcattcagtgctataaatttccctctacacactgctttgaatgtgtcccagagattctggtatgttgtgtctttgttctggttgatttcaaagaacatctttatttctgccttcatttcattatgtacccagtagtcattcaggagcaggttgttcagtttccatgtagttgagcagttttgagagagtttcttaatcctgagttccagtttgattgcactgtggtctgagagacagtttgttataatttctgttcttttacatttgctgaggagtgttttacttcccactatgtggtcaattttggaataggtgtggtgtggtgctgaaaagaatttatattcttttgatttggggtggagagtgctgtagatgtctattaggtctgcttgatgcagagctgagttcaattcctggatatccttgttaactttctgtctcgttgatctgtctaatgttgacagtggggtgttaaagtctcccattattattgtgtgggaatctaagtctctttgtaggtctctaaggacttgctttatgaatctgggtgctcctgtattgggtgcatatatatttaggatagttagctcttcttgttgaattgatccctttccattgtgtaatgacctttgtctcttttgatctttgttgttttgaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccagtttgccagtctgtgtcttttaattggagcatttagcccattttcatttaaagttaatattgtgatgtgtgaatttgatcctgtcattatgacgttagctggtgattttgctcattagttgatgcagtttcttcctagcctcaatggtctttacaatttggcatgtttttgcagtggctggtaccggttgttcctttccatgtttagtgcttccttcaggagctcttttagggcagtcctggtggtgacaaaatctctcagcatttgcttgtctgtaaaggattttatttctccttcacttatgaagcttagtttggctggatatgaaattccgggttgaaaattcttttctttaagaatgttgaatattggcccccactctcttctgacttgtagagtttctgccgagagatcagctgttagtctgatgggctttcctttgtgggtaacccgacctttctctctggctgcccttaacactttttccttcatttcaactttggtgaatctgacaattatgtgtcttggagttgctcttctcgaggagtatctttgtggcgttctctgtatttcctgaatctgaatgttggcctgccttactagattggggaagttctcctggataatatcctgcagagtgttttccaacttggttgcattctccccatcactttcaggtacaccaatcagacgtagatttggtcttttcacatagtcccatatttcttggaggctttgttcatttctttttattcttttttctctaaacttctcttcttgcttcatttcattcatttgatcttccatcactgataccctttcttccagttggttgaattggctactgaggcttgtgcattcatcatgtagttctcgtgctgtggttttcagctccatcaggtcctttaaggacttctctgcgttggttattctagttagccattcgtctaattttttttcaaggtatttaacttctttgccatgagttcgaacttcctcctttagctcggagtagtttgataatctgaagccttcttctctcaactcgtcaaagtcattctccatccagctttgttctgttgctggtgaggagctgcattcctttggaggaggagaggtgctctggtttttagagtttccagtttttctgctctgttttttccccatctttgtggttttatctacctttggtgtttgatgatggtgatgtacagatggggttttgttgtggttgtcctttctctttgttagttttccttctaacagtcaggaccctcagatgcaggtctgttggagtttgctggaggtccactccagaccctgtttgcctgggtatcagcagcggaggctgcagaacagtggatattggtgaatagcaaatgttgctgcctgatcattcctgtggaagttttgtctcagaggagtacccgggcatgtgaggtgtcagtctgcccctactgggggttgcctcccagttaggctactcgggaatcagggacccacttgaggaggcagtctgtccgttctcagatctccagctgcatgctgggagtaccactactctcttcaaagctgtcagacagggacatttaagtctgcagaggtttctgctgccttttttttggctatgccctgcccctagaggtggagtctatagaggcaggcaggcctccttgagctgaggtgggctccacccagttcgagctccctggctgctttgtttacctactcaagcctcggcaatggcgggtgaccctcccccagcctcactgccaccttgcagtttgatctcagactgctgtgctagcaatgagcgaggctccgtgggcataggacccgctgagccatgcgcgggatataatctcctggtgtgtcgtttgctaagacctttggaaaagcgcagtattagggtgggagtgacccggttttccaggtgctgtctgtcacccgtttctttgagtaggaaagggaattccctgaccccttgcgcttcccgggtgaggcgatgcctcgccctgcttcggcttatgctcagtgcgctgcacccactgtcctgtacccactgtccgacactccccaatgagatgaacccggtacctcagttggaaatgcagaaatcacctgtcttctgcatcgctcacgctgggtgctgtagactggagctgttccttttcggccatctttgatccaccccagtctgctcataggtctttaaagtaaacaagtctgtcatcagaggcaaattccccttatccaagtgttcagtggctctgaattccaagagctcacggcattgtgttactaacctgtacccaggagaatggacaccttcccctctgggagccttagaggaacatctggtcttgtcttgtcctgagtgttcgtacttggcctttcttcctatgagggcacttgtttgtaaatggttttacactttattaagcaatcagtttttgcttggaactaaactcgtgctaatttacctggattaatgctgtaggccaacgtggtgggtgatgagggttgggtaaggcctgcgtgtgccatgagagtggggaagtctgacctaaaccccaggaccaacccaagcttctcatgtctcatgcatgttccatgtggaaggcatttgtgccatcccaccatatgacgacccccagggggctctccgttggacacctctttattccttttctccccatctagtttgctcaattgctgttccaaagttgctcctcctcagaaatcttcaatagctctctgttgtcactgggacttcagaggcatctgcaatctggttcctatttatacatcctgtgggtaaaaaactgccctattcccactgaatgagccttgcctgccccatctccattcctctgccctttttttccagagcttctcccccagaataggaccagcagtcccagttgacctgggactagggctacttgggatgcaagacttccagtgttcaatctggtatgttccctgctccaataccatctctagttattgacatttgcctgtttttagggtactgctgaattccctgttgggcctctgtggtttagctctgattgtctgtccatccatatggtgcaggcattgccttttgccataagtatttgtgttcactcattgtctcccaatctgaactgtaattaatttgaggatgaggatcatgtcatattctgtggattctttcaagcacctagcacaggactttcatgtggtagatgttgagatattatttgctgcatgaaggaatggtgaataaattaccattgaataaattacgtagttgtaatgagagaatgtattgtaactatgttgatggatttttattgttttgttgattgcaaaagaatatatattcattgtacttttgtggaaagtttgggaaaaatagaaaagcatacatatatctcttgtaaacccactatccagaaatacataactactattaatatctttgtgtgcatccctccaacgtcttccctccttcctatccttctgtttgtccagtcatcatctgcatatttccatgtctttaaaaaaaacttggatcttatagtacatatagttttgtatattcttagaagggatatatgtgtgtgtgtatatatatatatatatataagatgcatacacgcttacctatatattcatatacttatatatatacatatatcccttctaagaatatacgtgtgtgtgtgcatctcctttttaggggtccccaacccctgggctgtagaccagtatcagtccgtggcctgttaggaactgggccaggtagcaggaggtaggtgagcggtgtgcaagagagcattactgcctaagctctgccttcactcagatcagcagtggcattagattattataggagcatgaaccttactgtgaactgtgcaggcaagggatctaggttgcatccttcttatgagaatctaatgcttaatgatctgagatggaatagtttcatcctgaaaccatcccccaccccaccttcccatcgatggaaaaattgtcttccacaaaaccggtccctggtgccaaaaaggttggggaccactgctttatatatataacagttctatctatctatctatctatctatctatctatctatctatctatctatctaatctatctgtcatctcttttgttccatttgtgtccataccatcaggtttttttttcttttttaaccaatccaccattgttgaacatttaagtttgtttcagaaattttgctcttatggctctttgttccatccctcattatttccttaagataaatgcttagaagtagaatttctgcttctaagattaaaggcttctgagtgatttttaagattcagggtgctgcttgtagtttgcaggtcagcttaacctgtgatcttgcaattctagtgctgttctaagatttgggcagtggaggtttgaggagacttagttctactgcagggctgagaaaacctaggcaagactgagaattaacttggtttatggttgatctggattctgggagtttgtgtgtgtcagggatgataataggaagttgattgaagccaagaaaatggttggaaaccaggttaggacagtgagagtagaacgattaggtgatgtcaggacaaagacctggggatatactgcactaaatatgaggaccttgaagctgggatgaatcctgcctcaggctcaaggccgtttacacttgacctatcagaaatcaaaggataatttctgtgatggggctctcctagggcctgcagacccaaagagcatctgtatataacccctggaaaaatcctagtatctggctgatcttttctagctctagattttctgagctcagcaaatgatggtggaagtccaggctcactgagagactagtcctataagtcacaaacctggggtagattaggaataatgaatacaaatgaccagttctggtgacccagttataagaggactccatctgccttaagtctcttaatctcaacaattacatcccaggccagatgtcacactataatgtaatataatattgctagtaatatttcaggaaatcattgcagagtgggaatgttctgaaagactggagacaagcaattattcctattttcaaaatagttttatgaactcagattcatgagttagtttaaaatcctaggcaaaagattctataatagattatttaaaaaatggtatgtgtaactttggaaaagcaaatagtagtcactaggaatcatcatgggataaacaagaagcacatgttgttcagctaacctcattttctgttttatggtacacgtgtatatcctactttcagcaagacatttgaaaagtctctctagattaccccaggctcaagactgagacctttgggctggatcagttattcatggaatgatatgcccagagtacatttttaatgaagcaatcttaagccagatacaggtttccagagttataaagttctattcttgatcctgcattgttaacatttcctttaatcaatgacaaagaaagaaatatgtaggtgacatgaagatgggagacacaatggatatgttggatgaaagacttcagatccaaaatgataagttcaggcttgaagaaatgaacttaatttatcaaaatgatggttaatagggtcataagctaggttttatccttgcattaaaaaagtaaaacaactgcacaaatgtgtgatagggaggtttggcgtatccatatttcagaaggtattaggtgtcaagtgctgtatgtatcaggctgcatgagtggaactacagaacctgtcatgatggagagtcctgccctggcactgcttctaccacgcctgtcaggaggtgactcgttttgggcccagaacttggagataaaacaaaaggcagacagtgtgctgtaggggaaagcacatgacaacttccaaatctgccaacagactatgtgtagcttggggagtgagtgtacttaatctctctgagcctcagttttcttatcagtaaaatgggccaagagaacttgaccttatcaagttttctgagaattatgtaatttatgagcattgcttagaaaatcaccttgctcagacttggtactcagcaaatcttgaatttcttttggttgtccctgctattgggaatgaacaagattctaagagtcaaaattcatgttaattgaaggtttgcagtctggagaagagtggacgtcagagcatgtgagatgtatgcatatactctgccagacattattctgaacaatttatatgattctctcatttacctttctgaatagtccaatgaagtatatactgtttgtatcggcattttacagattaggaaactgaggctcaaggaatatgtgccacagctaatcagggacacagctgggaccagaacctgatcttctgcctccccgtctgtactactgtgctgcatctcttgcattctagaagaatattgaaaattggcaagtgttagaggaggtgtttgtggtgaatggagggctccatctgggttgattcctaggagctgtcagtgtaagtcctataccagccactgaccagataggacatctcttttcattccctgcttctacctcccgcttttctctccatgttttcctcagctgggcccttagggcatttttgtgaacaactgctatattagtcttttctcacgctgctatgaagaaatacccaagactgagtaatttatacagaaaagaggtttaattgactcacagttccacatggctggggaggcctcaggaaacttataatcatgttagaaggcacctcttcacagggcaggcaggagagataatgagagccaagcgaagggggaatccccctataaaaccaccagatctcttgagaactcactcactattgccagaacagtttgggggaaaccaaccccatgattccattatctccacctggtcctgcccttgacacatggagattattacaattcaaggtgaggtttgggtggggacacagagccaaatgctgagtttaggctttctgttctaccctgtggatcaccctatggtctggggccagggggccaaggttgaattggatgcagagtgtatttatcatggttggaagggcaggtactgagtagggtttaactgcatgagtgaatgcattcccaaagagagccagaatctgtctggttgtctggtgtctccgctgagcccgcattcccttgcctagtttctgctgacatgaccttcttgtgaggaccctggagggagcttttgagaaacaccatcaccctccattcattcacatatgctccagacagctacttctctggcatggggcaaaataaatgatctttggggatatcatggctatcttttcgaaggtttttcttagatcccagcccgaggcagagatgcaaattgatgtgtcttcttaatctgcatcttcatttactgagtcatgttccttctgggagaaagagcagggcttgtgatttaactctaaatcatctctatcccagaagtcactgccggggacacttccagaagaggctacctaatccctgactttcccaactctgacattccccttcaactttcttgggaggctcagtttccctgtcacctttagtctaccttccagactctaggctttggatcacactgccttgcccactgtgatgtgtctccatgtcctctgtacatctggaacttacatgcttttccagtttacaaatcaaccctgctccatggagctgcccaggttattgagcctgtgtagatttaccgagctgtgagtaacttaaggacaggaacactcatccctgtatctagaatttgcctgatgctcagtagacactgttcaaagcatgagtgaggacaaatgaagggaggaacatcaattggcaccatttagcccttcattcatctctggttgtttcatggtggtgacattgatcccaccttccagctatgggctcagaagtcagaggcctggttccaaatctcagcccttccagtaacttgggaacatttggtaaattctctaaacctcagtttctttaacactggggaatattttatagggttagaaggaataaatgagattatggacacaatacccttactgatcacaacaaacattccagaaatatgcgttagctctcgtgtaaatatctggaggacagaacatcatcttatattactgctgctggtttggtgtttaattggccctcagttaagtccatcttgagtgcttattggataagagctccaacatgtgcaaagtaagcaagaaagggcttaggcaagggggctgccacatttataatataacaggattgtgctagcttggaggcttaatagcagacattttgtgtacaaaatgagaaacagaagcatgaggtcagggccattgttacatcagtgttctctgttgtctttgaacacgatgttcctaaaccgtagtgcttgcatttgaaaggcaggtcactctaggacgacactgcttttaaagattataatagatgctggcaagagaagaacactcagaaccaggctctgcttcaggaagttaaaaatgccaaatgccagtgcctttgctgtgcccccaagggggtgggggcagtatgaaatttactagaaagatgaactcccatgtcagtctccttaaatgggatgagcctctgctcttgcacgcgtgcatgctgctgctgctgtttaaaagcttttatcttgggctaaaatgtgcatattgtgggcagagctatctctccacttcgctgaaaaaaatcaccatgctaacaggcagggatgggaaaggggtctgccacagcagtgctttaacatctagatggcctatttagctggggagcttgtgtaggtgtgctgggtatagcctggtgtatgtagaatgagggtcagcctaggggtgggggtagctggacccatgtaggctcagtcctcaggggagaaggagggcctctttcaggccccattcatggtctctggtatctgaaggtcaaggggctgagcaaacagtggaggtgggagcccagtggcagagttggggcaatcagcttacagtacataagctgataaatcagtgatagatttgatttccatgcaagaactgatgtagattgtcatgggcataagcaaaaaaataataacccgtgaacttacagaatgctttatgctgctgaaaatgctctggggcccatgagctcctctgatgcccccaggagccctgagaagtggggaaggcatgtactactctcccttagcagaggtgcagagagggtcaagggacctgcacaaggccaccaagctagttctcaaatagctagacctgatgtccatactaatttctgtgatttcttcatttgtgcattcactctttcatcaaatctttgataatttttttttattttttagagacagggtcttgctcttgcccagactagagtacagtggcaagatgagagctcactgcagccttgaactcctaggttgaagtggtcttcctgccacagcatcccaagtagttgggactatagatgcgcaccaccatgccctgatgattaattttttttttttttttttttgtagaaataaggtcccgctatgttgaccaaacgctttgagccattatttttggtgccaagcactgagttaggtttaagaaatacggagatcagagacttgccttcaaagtgatccctatagtttatgtgtttaaataaagcagctttggagtgtttttccctcagctttcctctgggaagctccaagtttggtgctttgctgtgaagcccaaagatttcattttcttttttctcaatcccctgttttgtggtggaggagaaggccaggagccctcttgttgagcaaacctgcaaacctaagccaatttatataaggctgttcttttttcagcatcccctcggaacgaaaagatgggggttatgatgtttcccagtgatgcctttagatgcatgatggtgcctggacagatcataagctttataagggtcctgatgtcctgtttgttttagcaatctgccctcatgcaataggaggcattcagcagacaataactggattgaggtggttgagatattactattttaagttatttgtgtctctgtgtgtgtgagtagatgtatgttgggttggcttaatctaaaatgtaaacaaaatttgtctacttttgtggtttgtttttagggatgctaggaagatctcgtccctagaaatatatcccattacctagctcagtgtgctctaatttttaccattagagatgcaattctttattgtaagggtgaatatctgtagtcccgcacatgttagtatgaattagtcagtggtctttccttttagctctagaagaaattacagtagtaagggggcctggagctctagaagagagcaaagggcagagaaagcaacagcaaagctcaggcaccaaaggcaaactgctgcttttgtaatttggctgagagaggaccttagtcctgtcttaagaagattgaaagagcttcagagaccaagtatctgtttctccctgagaactaattaccaagtaccaagagcacagacgacactgtgctggtgcacaggactttgcatgctattgttactcaggctgtgggtcctagtcttgtgcaggcatgatggctttatcaatcatcatagtgagaatgagtcatgagggatccacacttggacagaagggcttagccctgaaatccctctccatagcttgcactgatagtgttctcttttaacgggagagaccatgttttgcaatgaaaatacatctgcaggctttgggtggagctagccagacctgggtttgatcctagctaaggaactttatagctttgtgatcttgactgaaagatttaatctctctgatcaccagagataaaattaacactgacctcctacatgtgatgggagtattaaatgagatgaagtatgtgcagggcctgttattaacttattactaatacatctaacaagttaggtatctctttttttaaaaaaccattttttattgcagttaattaaaaaaaatctaccctttaatgtatttggtttagaaattatttccccagaacagaatgggtagagtgtaaattcaagagtcagtaaagcacatcaagaaagagaagggctcccagagggggctgttccctgccgcttgcctttcacgtggctctcctgcctggtgactgtcggctgggcagggggccgggctgctcccagggaagctgtgctgctgcattgttcttggcacttatgccagccattcagggctctcaaaaaattggcttagaaaatagtttgaaagttattacttgggattcaggaaactccaggtggcttttgagagctgcccccaaatgcagccggagatgcgtcctcagctgttcactttcaggactttcattatttttcatgtttatttcgggctggagccagagctgcggtattcatgagctctcaccgtctgtttttttttttttttttttttaatcaatccctttgtttctttaggagagaaagaagcttgctccccaatcccctctgccccaccatagggttcaaggaaactggccctcataattgtaaattacctatgaaaaagacagagcccttggctcccttcctggcgaaagcttcaagatcagcagtgatagcggaaattaatgaaagcggctgctgagcccctggcctgttggtggctgctgagatgaaaaggcagcaattgaagtcggctttggggatgagcattccgataaggatttttgtttgggatacggttatgacctgtagcatgggctccagccaggacttaggtttcttggaaccggttctgatttgctcactaacaacagtctgcttttctttcaaaatataacctctttccctctaatctgaccacctcatcccccaagaaaagaaatgcagccctccaaacacaatacagtagtagcccaaggtgacgccaaatgtctgaatctctccctcttttctttttcttcttctttttagtagcagaatgaggctcagttgaactcattttctctttcatctcggctcatcccccttgggctggtgttaaacagctgtcatacaagggctgcccaggaatccagttatgaaacaaaccagccagccttcttaattgtcctcctgcgactggactaaatttgtcatcctaattcttgagcacttgagttcctgggctgcaggcttgagtgtcattcctgaacttggccagttgtttgccctccgtgagaccctcttgtaaactgattagatggcactcaggaggccacggcggggcgggttgaggggggcaggactgagcttgttataaacggagatttcttatttaggtggaaggcaaagttttctccttactgttccactgtcttcctgagagaaattaacactcaagtggaaagaacacattccacatggtacacggacacatgtgttttgttgcacatgagggctgggtttttgactgtaagtgacacttcattctgtcaagatttagaagtatattttaaattgacatcaatgaatttaaccgtcatggttttggatattattgtcagcatcccccaacatctatggcattatagtaattttttgcagtatattgtactaaatggtttttctgttgtctttttgggaagtgagtccttctgaaatctgtttcctttatattctcagcaggtgaaccttttcttttcttttcaaaatacttcaatctcagagtctttctttgacttcttcttttctttcaaaggcatgttttctttttttttttttattattattatacttaaagttttcgggtacatgtgcacaatgtgcaggttagttacatatgtatacatgtgccatgctggtgtgctgcacccattaactcgtcatttagcattaggtttatctcctaatgccatccctcccccttcccccaccccacaacagtccccagagtgtgatgttccccttcctgtgtccatgtgttctcattgttcattcccatctatgactgagaacatgcagtgtttggttttttgtccttgcgatagtttactgagaatgatgatttccaatttcatccatgtccctacaaaggacatgaactcatcttttttatggctgcatagtattccatggtgtatatgtgccacattttcttaatccagtctatccctgttggacatttgggttggttccaagtctttgctattgtgaatagtgccgcaataaacataagtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttactgatggccattctaactggtgtgagatggtatctcattgtggttttgatttgcatttctctgatggccagtgatggtgagcattttttcatgtgtcttttggctgcataaatgtcttcttttgagaagtgtctgttcatatcctttgcccactttttgatggggttgtttgcttttttcttgtaaatttgagttcattgtagattctggatattagccctttgtcagatgagtaggttgcgaaaattttctcccattttgtgggttgcctgttcactctgatggtagtttcttttgctgtgcagaagctcttgagtttaattagatcccatttgtcaattttgtcttttgttgccattgcttttggtgttttagacatgaagtccttgcccacgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccaattttcccagcaccatttattaaatagggaatcctttccccattgcttgtttttctcaagtttgtcaaagatcagatagttgtagatatgcggcgttatttctgagcgctctgttctgttccattgatctataccagtaccatgctgttttggttactgtagccttgtagtatagtgtgaagtcaggtagcctgatgtgaccggctttgttcttttggcttaggattgacttggtgatgcgggctcttttttggttccatataaactttaaagtaatttttttccctttcttacttgatagttcagattttaaatgtgatcattttttctttgttcacaactcacccacatatccatgacattttatatcgatccagccgaggcactttccagaaacaggttcttgattcatcttgaaggagcagtttatggatgtagcctcttagaaatacctggtaatatcagaagatcctggaagtaaatgaaccagtggtcttctcccatttgccgtttctttctttatagttggcatatcgtctttaggggactgtggcagaattgcagtatctgtagctgctttgggacagatctttatgggttccgtgttccctcctggcatctcaaggcagaagaatggacgcacgggctttgaggcagacacgtgtgactgtatatagaaggaaaccaacagaccttgggaaatgaaatggctttcaggtcacagacaaagttgggttcatatggagaacaattcattgttgagaactgatagcaacttaatattttcccttgagacgcaagggcttcccagtactcaaggtctgaagatataggagacattccttgacaatatacagattccctgccaatacccacaggtgagtcagctaactctcttaatcctacctcctcccaactgtggcagctggaaggaaagccagaggaacccaggacatgagctgcagagatgaatgtttcaaggttttctctggtggtctctttgaggcatttgtgcatctgatgctctgcaagtcattagaaaacacaaggaagccattggctatggctggatccagactcaaacatacacaaacctcagcctccagcagcgcctgcccagcacaggtatcatcacttttgtctctgctgccagctgcctcagggccatgctgatctggactgtctgtgtctgagcgatgtcaagacactggagacaaatgaaaagaccatcttggttcactctctccaaatgccggagacaagagaaacagaagttgtatttgcagaatagtaaatagggatcttcaaaataggtcaggcaaatgggtcaatttctttctgagtttttttctgctattgtcacatagaagttcaccacctcagggcaaattcaggcctgtgttcatgactgctccagctctctgataagtctgaccatgttgcccagtgccaggttctcctgaatctgtttctcccaggagtactgaaagcactcgggagaggtgataaccctgttatctgtcttcatcaccaacgagtcaagacactttagacagaggccatgtctacaactcatagagtagggttcttcacagtagtccctgcaacagggggaggtcaacagggctttctggagttcagtctcagatgctcttaaattgaagtcctctcctcaggcttctggctctgaagatccccagcatgtctgaaggatctggagtcactgctgtgcttttagtggggcaagtgaaatcacacgtgtccccacatccttctatacccatttcacctactcagtcatttgattggatttccattagaaagccaagcaaaataagacaaggaattcacccacctttgtaggatgggaggatttctgggtgctaattttcaggttctgtgtgtattcaaccaccaaacagaattgtacttggtacctcttttgtgtagtaagtatgcaaggagatatggtatgtttaatggtgaacaggaaagacctggaccacaaaatattagctggtctttccttttacaaatgggaagaattttctttattttgttcatagaacgtatttcttggcatgattaaaacatgcaaaaaggtatgcatttacaattttgcagtgcgtactaacaaaggcaaactcagtgatatttttattacataaaactgaaacagtcaaaattaattatttatgacaaattccttcaaaaaatctgcctgtactgtgtagtcctagaaatttgtggccccctttctcctcactcatgtactaccgagttaaataattaatttgcagttttgtatcccttgataaaatgaaggcttctcaaaagtaggaagttatctggatcagattgtgatcaaaatatgtagaatacatgtgagtctctgctgtcgtctcacttactcctccttctgtgtactgtttcgacgcacctcctctgggaagtcttatctgatcttccaggttaaggatccccttgtttatgttctcatagcctggctttgtccttcacagcacatattaaattgttgctttcttagtgtctatcttccagataacctccataatggcatgaactccttgtttgcttctcaggaagggattccagcttcagggtgtcacctaatgcattgctcaatgaaaggttaatggattaacattcattgcacagaggttttataaaagacacttatttttttgtttgtttgtttccttgcttctgtgtgtcaaggcaaggaaagtggtttgtatgtatgtatggagaaataataatgtagaaggggtgagattctggggatttgagggcttaattttcttctaggatcttatctattagttggccttattaggttaacataaagttaatctttccattagcaatcattgtagcttctcatcttggaaatctcagttttaaagagtaaattaaggcctttcctctcccttttattattattattattattttggagacagggtctccctctgtcacccaggctagaatgcaatggtcctatcatagctcattgtaaccttgaactcttgggctcaagggattctcccacatcagcctcccaagtagctgatactacaggtgcattccactacacctggataatttaaattttttttttttttttttttttgccagggtcttgctatgttgcccaggttgttctcaaactcttggccttaatcagtcctcctgcctcagcttcccagagtactgggattataggcacaagccaccagggacaatcagaccttttctttttaatcaccagaaggcaatgctgacatttgttgcccaaccatcataacagcacacttggccgttgtggtcctggcaggcgtatctgtctcattagatattcacagttactcggagcagaggcctccaagaactgatgtgcatttcttgggtttatcctgtatggagtttgtcaagctgcttgaatctttagggttgtgtcttttgtcaaatttggggaaatattagttattgtttcttcactctactttctttttctctccttctggaaatcctaggacataaatgttaaagctttgtgtagttccctgatgctcttttttttttcagtccattttctctctgttgctcagaaaaataatttctatttttctgtcttcaagtttattgtttctttcctctttcctttccattctgggttttttttttttttttttttttttttttttttgcctagcctttgagtttttaattttggttattttatttttcagttctaaaattgccagatggttctttttttatatctcccatttctttgctaagactttctattttttcatgtgtttcaagcgtatgcataattgctcattgagacatttttatgacggctactttaaactccttatcagaaaattccaacatctgtatcctctcagtgttggcacgtattgtcttttctcactcaagttgggattttccttgttcttggtatcagtgtttttttaaaaaattgtatcctggacatttgggtactgtatgactctggatcttattttgaccttctgttttagcaggctttctcttatatcatgatagtggtgggggacaggggaggggaggtgctaccttgttactgccaggtgagggtggaagttagtttagattgacaccctaagaggttccttgctactgctggacagtggcacatgcagaaaggctgaaaccatcatctcttgaagtttcccagaaaattgtttttgttcatctccttagcagaaaagatgtgcaaagttttgcatttgtaatccatttggtgctgggtgacaagtcataaccttagtagtgtgctgtgtggaagccagcggggcagcatagaagggggtctctgagaagtgtgaccagcctcctgaatcacagtgtttaaggatctatggaaaagtaaggccctgtttgtcctgacagtgacctctaaggagcttgggtagaggaggataccagtaggtagtggccacactcattgtccagtgggtagtggtaacatgactccaggaatttgactcagtttgatgcaggcccaaatttgggcctcagtcaacaacattgggctgcagaccttggacagctgggcctggggcctcaagaggtattaacatcagagccaggtctgggccccatccagcagacctctggacactaaaaataagggcaaacatcttgacaactgaaccagtcaaagagtaagtgtagcacagtaagcgcagggagactcagggcagtcagtggtcctaaatctattggatggaacagggctccatgttccattggttggaactgcactgccatgattgacttagggctgagactccgtaagactggccacaaagagaccaggagcacttattattattattgtttattacttagttcacattctaggaatgccctgtgtgtaagaagcttggatataaataagcattaataattcttgaaatcagaatggaaagcattttatatgcattaccttttaaaaaatttcataataatcctgtggggtggatagaacatgtattgttattccatttcctgaggaaaaatctggagctcaaagagatgaaaatgcactatacaagtgagttagggaacttggctcttcagactctaaagtctagggctgtagagggatatgctgagtgtcagtctctgcagcttccagtaagtgccaggtgtttgcataactcagtctttgcatctgtagactagagcaaccatgacctagaggactatctctgccatagcggggtgaagttgcacctagttttacatgtctcagaaaactcactgatgctcctacaagctgctaacaatcattcaggaaacatttattaagcattcactgtacgctaataactgatgttgggaatgcaaaagtcttctttgtccacatggtttctcggctcaatggtctcatggtccagtgcagggaggccaagtttaatgcgttcctaatgtagtagaaggcagtgggggagatgtgccttgggaggcattcaccttctgctagggttcctggaccagatggataatcttgggggtaaaggaggtgaacttctgggtcccttttaaccatgcctaagaagttcccttctattagtgggtgttactgacccactctcaggacagcctgtggactgagttcttgtctccatattctcccctaagccccctgtgaacctgtacgtgctgctgtgagatactaggctggagctggaaacacaggaatccgccttgtctgtaccgatgtggatatgaggacttggaagcgaggttaggaacaggaaattaaaagcatccttttattcaggcatccgcttaaaggctaaagctacaataaaaaggcttcagaatgggcctccctaaatcttcattcattaataacgattatgatcattattctaacaacaataataatactaaactctgataatgatctttttgcatttacccagttcatcacctcatttgatcttcacaacactgtgagatggacattatcatctccatattgcagatgaagaaatcaacccttaaaaactcggtgggcttgcccatggtggctggcaggagaatgatggagcagacttctcattctagagctcttctcctttgcctctgtcatcatcttccctttgaacccagtcctctaaaacagctgcttaaaaaacaataatgaagaacaaagaactgacaatgaatagactgtcagaagacacctttgttctgccttccctcccctatggtgctctgggaacttttgacatgctgggcctccttgatttataccagtgaatctgttgaatgagatttccagttgtaatagtaatttttctattataataatggtgattattattaattataatgctatttttattaaagcacaggccatatgtcagcaatagaaaagcatttgatttttcttgtataatcctcacaacaatcctatggagaacctgttattatctccactgttacaatgaaggatctaaaggttatagacatttgaaacttgcttaaaacaaaatagttaataaggggcagaaccagagtttgaaattaggtctgtctgtttctaaagcccatgcttttaaccccaaaacctaatttcctcccacactgatgctaggtttgcagaatctggactccgcctccatacccagaatgtgtcacgaacactaagaagtaaaggacatgctgaatcttctcccttcagtttccctcttgcctttgcttctctgcaggttgctggttgggtgttgtatgcctgggacccattttaagtctgtgctgtctaagatatgagtggtgtattaaaagtgaagacacgttgtttgcttcacgggcattaatcaatggcaaattagaatgcaattgatatatgcataagacatgcacattaattccaaatgtgtttatcgtaattagtgctgttacaaagaataccaaaggaatcagggaatgattagctacacttagtatttgttatggtttgtttaaaaaagttaaacataacaattagttgaggtttgaggagcgatgttccatttgcatggtgaacgtggctacaagccttgggtctttgcgagtttgaaggtttgaagggggtttcctactcaagattttaccaaaaaaactgagttaatgaggctatcatcctcaattaatgctgtggttttcctttcttaatcatttgtatcttacagctgttttctactgtcacatctacatcaaaaagcctatcaattgagaaagatgaacagaggggatagaaaagtagaccaaaacatctaaaaggatctattagtatatacttatatagaagtatacttttgaagaaactagcaagttatggctgacatacaaaaagcggtacatattttaagtatgtgaaatatttaatgacaagttaggaaatagtgtacacccttgaaaccatcaccataatctatgctataaacctatccagcacctccgagagtttcctcctgccctttttattagttattattattttgtaatgagaactcttaacacaagatctgccctcttagcagatgtttaagtatataatagagaattgttgaccacaggcactatgctgcgctgtccatctctaggatttattcatcttatatcactgaaacgttgtatcctttgactgatacctcccacttgccccctcatcccagcccccagacaccagcatttcactctctgcttttataagtttgactattttaggttcattatataaatgagatcatgtagtatttgtccttctgtgtctggcttatttcactcagcataatgtcctccaggttcttgtatgttgtcacaaatggcagggtttcctcttttttagggctgaataatactccattggatgcatataccacattttctttatccattcagccatgggtggacacttaggttgcatccatatcaaaaggataagtacatacttatttgggggaagaaattatgacccaatttattttgaaggtggtgttttaattgacaaataataattgtatatatttatgggtatgatgtgttgttttgataactgttttcttttttttttttttttaaggtggagtctcgctctgtcacccaggttggagtgcagtggtgcgatctcggctcactgcaagctccgcctcccaggttcacgccattctcctgcctcagcctccccagtagctgggactacaggtgcccgccactacgcctggctaattttttgtatttttagtagagacggggtttcaccatgttagccaggatggtctcgatctcctgacctcgtgatccgcccgccttggcctcccagagtgctgggattacaggcgtgagccaccgcaccagcgataaatgttttcaatgtgaagtgattaaataaggctaatgaacaaatccatcatctcacatacttaccattttttgtggtaaaagcatttgaaatctattttatcaattttgaaatatacaatgcattattatttattatagtcaccattctgtataaaaatcactaaggcttattcctccagtctagctgaaactttgtaccctttgatcaccatctctcctttcctcatccacccgctcccccaggttctgtaaccctcattctactctctgtttctatgagctcaacttttttagagtccacgtaaaagtgagataatgtgatatttgtctttctgtgcctggcttatttcacttagcataatgtccttcaggctcaaggatcagtatatacttttaaaggacatatgctgcattagccaggggtaggatattcatatgtattgacattgactatgtcctggcatctaatttatgtgatcttcatttaatcttcagaatgactatgagaaacaagtattaaaatgagaagactgaggctcagagaggtttatttgctcagttacacaactactgggttgagggcagggattcaactccaagtctgtgtgaattcacgttcatgcttgctctactaagggtggctcacttccttcaagtggctgaatgcctagactaatgatgccaattccagagaacgttggtccattgttctgtggtcagtctgaacctcccccatctggctggtcacctccaggatggatggaaaataacatggtttagcacaaacccaactctgctgatgaaccagctgctcaaagtgtttgtcctaccatgatttctgttttttgaggatgggcttctagggaagtaatcagtcacattaaggagtccattcaacaaacatttgttgagcatattgggaatgctgaacaacatgggtagaatgagggtctatccatgttgagaatgcttctcagctctagtgaggtagatgaacagtacagtcacccacatgaattcttataattaaaggggagtggatagacatactgatacttccaatacgctgagaaatctatgacagatgcatggagttcctggagagttaatgagaggctaatctaacctgtagattgcaaggaggcaagaaatgcttcccatatgtggtgtataggttgaattttgattatcgaatgcctgcttgatactgtgctatgctctgtgcattatcctataactctggggagtcatgttctttaagagagacactgctcggaccattctcagcacctagcacagttcctggcatgtaggaggcatcagtagaaaatatgtaacaactcctggaaggcagtctcctgcctctgccttagcacttccacactgagcatgtcagctggaacaggagaccagctgtgcaccttgaacagcactgggtttaaagcctggatctaaccccttgctagccatgaaaccttgggaaagttcttcctttattccctgagtttcttcatctttaagtgggaataatagtagcccaacatgacatggttgttgtgaggattaaatgagttaatgcgtgtaaatgcccttagagcagtagctagcatgtagtaagcacaataaccaatattggctaagtttgtcatgaggtctcaatgaatcttctcagaaaagtctctgttttggcaaattctggctttcctctgatgtcatgtggtctgaatctaaaatccattctctttttatagatctggatgatatattttgatggcatgattctataatctctttcttagagaactttactgagtcccgttcagtttgttctagcaaataataaactattagatcttattttggttatttatatcagccacagcagttgtagcaatggacagaaccagcccgataaaatcagtattattgttttccattattatcagtatatcagttcagtttattttcctttcttttaaaattaaaagcaatgggaaccgtctggaatccacttaaggaagaaaagaaaatttaatggaaagatactgtaggtatttcaggaaaaaactgagcctcaaaatggtagggatcaggaaaaatccaggcctcagggataggattctctagactcctgctgggtgcagtggctcacacctgtaatcccagcactttgggaggccagggaaggtggatcatctgaggtcaggagtttgaaaccagcctggccaacttggtgaaaccccgtctctactaaaaatacaaaaatttgctgggtgtggtggcgggtgcctgtaatcccagctacttgggaggctgaggcaggggaattgcttgaacccatgaggcagaggttgcagtgagctgagatcgtgccattgcactccagcctgggcaagggagcaagactccatctgtgaaaaaataaaaagaattctttagattctccttccgggtctctaccaatagtgtaactaggtttccagcagattcccagaagagggaatccagttttcccagctgtggtcaggtgtccaccattaagccaatctgctgagaccaatgggcagagtcctgaagcaggagcatggctatgagaaggtcaccactccatggggggcaggcaattccaagggaaggggcttttgggtaacctgcttcatgtctactgcagttaatttttgtgtagcatggagagttgtgattttacttcttgttttccaactctgaggattaatcaagtgtggttactgagcagtgaccatgtaccttgttctgtgcaaagtatagggtgtgtgtgtgtgtgtgtgtgtgtgtgtgtgtgtgtgtgtgtaatggttacaacgaagcaatttgaaggatcttgtccttagaagtgcaagcccagaaccagaccaaggaatgctttatcactttgaacatgattgtgacttctgcatcagctgttttcctagttccttttctttttaaatctttatgtcttcttcatatttcatgcttcttaaaaattggggcatctttggctcaagtgttcaatataaagggtggattttaaagggaagcatgtaaaatactatcaagtttagtgcgttcttattgtatgtcaataactgtacaaattcattattttctcattgaatattcccagccccctcagcagaggcactaggataatccatatcccacaaatgagggagatgggccttgaaaagaggaggtaacttcctcaaggttacaccactagtatgaactgaacaaaagcttctgaattcaactttgctgactccaaagccagtgcaatggacagggccagtcatgtcacttttcattttgtttagtaaattatttttcatattttgcatacatttcatatttttcattttatttatttgatttcctcatggaaagatttttattttttaaagccgtgatctcactggtatttcctgagtctgtactatttaattatataatagattccttgcaaaaacaatgaaaatgagcattattctttgaaaaccaacaaatgataaaaattaaattattaaatggctatataactaattttttgatcagcatcagacacattttaaaagcaatttgtttgaaaacatgtgcaaagacaaggtgtgtgcagtatcagttagtgggtagtactaacttatattacatactatgatgtttgccatgatcctggaatggtgggcttgaaaatgacccagggaaagattatagaaggggctactaagataatgaagaggaggtgatgatcactgggactgcaatgagggcttggtgcaagcaattcatgctagcataaatcttactgctttcgtaagggtcacagacttattaggtagaaaaaaaaataagcagaatggacctcggcaacatatctgaacaacttccttgtggtatctttgtggccaatatggaatgtatttgtatgtaaggaaaactgatgggttaataattggccaaatgattatactcaaagtatactgaccagtggttgaaagttaacctgaagatagtgtcccaagtagccaactttagggccctgtccttggtcctgccctccagtctacctaagagatgcaggcttcacttttctcaggttggtgaagatactgatggcaaattgtacccagtgcacaaataatacgaagacaggatgggacagtgaatactaagacagaaacaggatataaaatgatatttatagactagagatctgggccaagtctaacagaacaaaatgtagcagggataaatgtaaagttctacaaatcccaaaattaaactgcacaaaataggatgaggtagatgtttcagagaattagtagcatgagtaaaatattaaatagcttgggaaccagtaagctcaaggttcactatgagtcaattctgtgatacaataagcaaaaaaactcacaaagccttaatctattttaatagacctatattctagaatgagaatggggataatttcttggaactatgcatttcttagttcggaatatcgtgtctataatattttaatttagaataatttttctgccttggtgggtacataatgagatatggacaaattggaagacatacaagagagggagaagcacacagcaagaaagagagggcaaaaaagagacattatagcagcctttagatgcaggaaggggtgtcaagtacaggagatattagtattgtttaatgcagtatgagattgtggaattggtgctaatctgtagcagccacagagagataaatttggggtcaaaataaggaatacatttctaataggaatgcctggttataagttttcctgggaggtactggactctctcttatgggagattaaaaatcctgggttggaatgtaatgtaggattggtctcaaatggcattactacagattataggtgtgtcctgaaatggggatactctaaacattttgagcagatgagtgacaggattctgaccatcctgcaagagatgggccagcctgaagtcagggagactagttaggaggcaattgctctcatccagatgaaacaaaacttgattggaggtaagggttaagtagacactggagagtttaggataggtccattgctccaaagcccttgcaaggcacggtgagtgaatgagagatagctaaagcttgctgtgcatctggggcaatcatttaatgtctggggtctgtattcactcagctgtgaaatgagaggctaaaatcaggatccctttcattcatgacattctgtgatgaaaacaagctataataatcccatcgcagggaaggtgcatttatagctctgtgtctgctcacttaagtagtctgatatgaggagggaaatggaggtggctcctacccagagatactctcccacaatgaccttgtactgtggctgggattttgtcactggggtttttattcaattaagttcttatatgctcacttaaaaaatgtaaatgctaataggaagcatatatatatatatatatatatatatatatatatatatatatataatagtttagcagcaggaatgaggttttctgattagttgcctttaaaagctctgttaagcacagtcttaaaactttttttttttgaggcagagtcttgctttgtcacccaggctggggtgcagtggtgcgatctcagctcactgtaacctccgcctcccaggtttaagtgattctcctgcctcagcctccccagtagctgggattacaagtgcctgccaccatgctgtctattttttttgtatttttagtagagatggggtttcaccacgttggccaggctggtcttgaactcctggcctcaagtgattcgcctgcctcagcctcccaaagtgctaggattacaggcatgagccaccgcacctggctaaagcattatttttttgtgataaggaaaagagagagatcattttggagcatgggacactgcttggattgcaaagccaagtaaggtgccacagttggcaaacttggcaagggaggggaatcaccactgagggtaagccttgcttgtaaaagagtggaaggacttcaagggcaaatttaagtcacttcacagttttactgtgggctgggccagctcagaggctggaccacagatatatttagcctccctcttccatttatttgagaagacgatcttagggatgttaggcgtgtcccattgtgattgttgttacatctgtgcagtgattaaaatataacttcctttcatcagcgcttgattcctttaaatggaattcattactctcatctgaacattttatgttaaaaacaaaagatcatagagcagtctgaggaggtatataataattaagttactgttgaggttctgatagttactatcaacttaaaatagagagtttaagtattttctatatatcctaaatgcctgtagacagatttttatcgttggttattcaacaaccttggaaagggtttgttggaattcatggggcttttgaagaaaaaccaaaccaagccaaccaaccaaccaaccaaacaaacaaacaaatgaacaaatggacaaacaaactttcatggaaactgggactttggcttcaaaagtaattttgaactaaactcttctagtaatttatcactgaagtaggagtatgttcactctattgactgaccttttaattaaatgttgtacctggctagctatattttaagaatttggcattgactttggacaaccatgggtaatctatccaaatgagatttacttgggtcttccccacagaagaaggtttagggcaccttctaatttgttaaattatgagtaaggaatccatttgatgggtggaaccagggccaccttcactgtttgagaaaggttaagtgatatttaccagcacattttcttgaatgttcgtgtcaagaaatataaaaggaaaagtgatctacattcatgtagaatgattgggccaggttatgtcaagaggagaatgaatacactaaagacccgaatgaaagtttcccttaaggctggattctgaaagatgcactgaatataaaatgtttgaataaaggaagaacaggaagagtgttaagtatttactgctagcaacacttagcttttaatcaagagctcttttcctaatactatacgaatgattaactttgataatagaagtgtaaggatcctaatttgtgactttgttgatggtttttccctcctttctaaacgtagttttaaaatacactaactttcattaccttatagtaggctttttcaaaggacttccttatcctcaatcttatttactagtgtgacattgtccttggggtttatgttatggcaccatgttatgaatgaggcagcattattgtgacattcttcagagatcaatgaccaaaaagtccaaggctgacctatagctacaagaattttgggctatcattatgctgaccatattttcagaagcctcaaatgtactatttattttcctagttgagaatgtatatatctggaaggtttaaatcatagttacatcctgtaaagagtcttaatttggtagacctaatataatttagtgaaatttgcactgggccaggcagtctgagaggtagagttcaggggccctatttgggctggtctagttactaaaattctgctatgtgctaggcactgcgctactaattttgtgaatgtttggtgcttaaatcaaggttaagcagcttacccgtttgtgataagtgacagggctgggattttatcccaggcctgcctgtgtcaaaagcacatgctgtttccatcacactgagtttctctgctctctaccagtttgtcatatgggtctgctacatcaaaatcatccggggcccctgttaaacatcagattgtcagaccccacgcagggcctccagaatctctccagctgtagctagccagctctccaggtgattggattgtatggccaggtttgggaatcatgggcacctttgagcatcattgcttgcccttatactgtaacctttagagggcaacacttttgctgcatacctataggtatggcagatgttagacacaaagtccagaatagggggggaaaaactttacccccctggcgtttttggttttaggtgctattaagggagaagttgagagagacatacattgaaagatagataagcttccctgagacttggagttgagagcagtgtttgggcttggggccttgcttcctgttctaggacatggaaatttacttaggaaatgattctcatcaagcttgtttgtaacttgggatattcatcaataaatgaaagctgattatagaaatcagtccctgctggggccctgctaggctacgccctgacctctgtgcccatatattgacatcttgtttacttgcatctataaagatttattccagtcattagaggatggcaatttgaaccctagaattacaccctattcctgccagctgatttatgtgttttctccttttcaccaagcacagaaataatccagatggagtcagggtgggttggagggggatgccaaagaagaaattaaattagaaaaggtgcaattgaaataacccagctaatcttagcagagctctgtggctaatgcattaccggtgaattccttctggtcgactgaaaatagtattaatagtgtataaatatatgtgtgttagtttgtaatagggaggagaggaggcaggcagaggatagattttgtttggaattattgactaacagttgaaacctgaccaatgatttggtacattcattcattcctttattcaatgattcatacagctgttctgcaaggagatattcattcattcaatcattcatacattcattccacaaaaacatattcagtcactcattcatacattcattttgcagggagatataactgagcactcactatgtacctgggacttatccatatgtgaattttcttgagaagagaacttgggacttaacattaaggaatttaaaatttagatcagtaataagattgcatgagagttgaataaggacataagaattgaacaggaaatatcataagagacaaactaagtgttgcagaatgaaagtggcagagtagttaaggaaaacctagatgaaaagaataatcctgaagaatttaggattcaatttgatacttgagtttctaagatgggatagatttacataggagtgaggacattccaggtggggagaatggtgtgagcaaaaacctagaagcagaggtatgctgggggcattgacattcaggccagccaagttttgatcacagggatcatgtttgtgaggcagaagagcaatatgagtttcatttgatgatgtagaataataccatttttgcctttcctcatcacagttatcacacagaatcataatgatcaatgttcctgtctgttttctccattagattgaaagtccttaagatcaaggactgagtatttttttgtgggggcttttaagtacccttaattacacaaagctgtgcacccagttattgagtggagactgactagggacatgtctggaatgaggcagtggggagccagcccctgcttccctttcttgctgcctgttacatgttgaacattagccaaagtggttttctcatttataaaatcattaagttattatgtggctcctcatccatgtggttagaggaagtcgaggtcactctgagcctcgcaacactattattagagttaggccatcagtgaactgtgagtaagaggatgcatggtggtgaactaatggacagctgtttaccaaggatttacttctctccacacctatgttaaatactatgggggcatataaaaagtgcatataggatcacataagagcactgtccttcagaagtatacagcatactggactgatgaggttcctctacacgcaatagaaataaaagaatgtctgaatagtccatggaacctgccttggtttatttttatctataaagttggactggatgatctctaaggatcctttgagtttgaagctgatggagagctcaaagagttcagcaggggtaaataactaggaagggcaggcaatgcttattcagcaccttcttcataaacagagtttgtaggcagggtaagggtgggtgaaaggtggagctgggaatctatcagctggggtttgaatgggagtggagaaagcatcccaagagtggagaaagccacagcaaggggcagaacctggaagagcatgcagaatggaggctgcctgtggcatccaggcgggcctcagatggcaccgatcctcagacagtggtcagggtaacactttcaagacagctcccttgtgagctttagtacctctctttagaagttgctggcagtgcattggctgggatcctgaaagttcatgctctgtgctagtgtatggggaacattctgatacttgggttagtgatttctgggactgaatattaaggacttgatcttctgtccgttccacctgctttcaggaccactggagatagtcccttggcttctactgaagctggaagatctgtgtccatgtacaagatcaacaaccattatctccttggacttctaactcactccagcattgaacagctgctgttttccaagttaagggtttttttttttttttttttttttttagccaattatagctcacaaaagtttgtgcttgctctgtccaggtgggtctgccagaggccccctgacccaaatgttctgtccccacatcatgtggcagcacaacccaattagaggtgaccagggcagctgtccacataattgtatgcagttaacatctaacccttggctttcttggcaaagcaaaggcattggccttttggcttctgctggtccggtcagcaattacccagttattaaaactaaataattgccattagctcttgtcctcagtgcatcctgagtctcactgcaggtggatcttcatctcatttgcaaagctctccaatgcaaggcaagggatacttgtccttcagacactaggcaggtacaacagcagagcagtctccctgtgtgccacagtttccagctgcttttgcgtttcgaggtgttactgtgaattttgcgcttctgccacagagccgatgccttgtgtgtctgtgtgcttgtgtattcagagggctgctgttttattgttgggttggggggattttcctttgctttttcttagctggatattgccttttggtggtggcttgaaattcagttcgggggtgtgaactttctcttcatttttttctccttttctttctttcgagttctcatttctgaagagatttctgttcttaaatcctagcattaaatggaggtgttttcattttctctgggagaagtttcacagcacaggtgtgtgcttgattctctacttgcggttccccactgccaccacccccccccccacacccgctgccttgatgctgatagtggctgtctaaagtacaaagggaaagttaagcttacaggttgtccttctctttgattgtattcttggctgtagcttctcagccctttgcaggaggaactcacatcagtctggaacataaaaacaggagaattttcagccctggaaataattgcttcttggagtagatcctttgggagcctccacactgaggaatgaagtttgactaagccccagcaatgaataggacttggatgaggagaaagggtctgagatctgtgtttcgaggcaaggaaaattctggcaggatccgtttgcatatatattgaggcctaattaggccctcggtgtgtttggaaactgctttgttgcggtgggtatgatattattccattttaagtacttccagagggcaatgatctttaactcagattcattcctggactttatttttgcaggggtgggtggagtgtaaccataatgagggttactgcattttgtctttatggctataatctcactcatttattcctttcttcaactatttgatacatgtttatcaagtggtcacccagtataaagtatggcacagccttgaaccatagattaaggtggtagggagagtctgtaggggccattgtctaacttctcattttgcagagggggaaactttgtctccatttttctcatctgtttagtgtctctccaagatcccgggcctttgaacattctagctttgggatgtctcctttcctggatgccctacacttcatcactttaaaatgacagctgagaccttgcagggtcattgaggttattaggtgatctagctggtactttgggatattgtggctcctcgccaagtaggaatgggctcacatctctcttttagtccttctcccaagcagcttctccagccccagagttcattctttctgtgctccctttttagcggccggacagggctgatatgcctccacagttctgagttgacccagacatgacttcactctgaagaagtagatcctgttagggaaaccggtttcaaacatgaggtcttgtatggcttgaattgtgtctccctagaatttacatgttgaaatcctaatccctggcacctgagaatgtgatcgtatttgggaatagggttgttgcagatgggattagttaagagaatgtcatgctggagtagggtgggccctgatccagtaggactgatgtccttataaaagggggaaatttggacacagacacatatagggaggatgccatgtgaacattaaggcagagatcagggtgatgcagctggaatgccagaggttgccatcaaacaactagaagctggccagaggctggaaaagataatttattaaaagataatcccttaaaaggaagcaactctgtccacaccttaatcttggacctcatcctccagaactgtgataagataaatatctgttgtttaggccacccaaactgagtggtactttgttacagtagtcttagcaaactcatacacagaggatttgagagtgttttctggaatctgcagagggccaaataatcccctggggaggggacatgactgaagagggacttgtctctctctcactgccattccaacagaacaggggattcttggataatattctgctgagattgcgtgaaggttactttagtatatagtttcagcatattgattatatgtgaccttttatctggaataccctctgactttttttgcccaagttttatttttctcaagtcactgtttcagatccggctcagtcctcacctccttgggatatctttttctacacccaggcttgggtaggtgttttctgctctcctttgctgtaacttacctcgttgtattctatttatgctgatttgctgattcaccaggtgttctgtcgaggatctgtcacggcctggtgatgtcctgttggttctgggtcagtggctgacacagaggaggtccctgtgcttgaggagcttgtacagaactggggtgaatggatggtaaacacgctagtggacagaataatttcagattctggaaggttctagagaaaaaacaaaacaaagtaatgtaccgaggggaagcaagggacagctagagatacggggcccaggggggcaatagctgagctgagatctgaaagaacaggagtcggtcatgcaaagatctgcaaaagaaaatcccaggtgggggaagagcaaagtgcaaaggcccagaggagggacctgtcctggtgtgttcaggatggagtgcttggagaatggcagctgagcaggagagtcagtggtgaggtggaagagattagcaggagtggggtcttgtgtgccttgtctcagggccagactgtgaacttagcatggaaaggattttgtaacttttgtcactacagcagctggcacacagtcagtgcttaatatatgtatgaataaccataaacacttgtatgtatacctgttaatcaaacattattaaacaatacctcatttatctaagaattgcttcttaggcaacctctgctagccagggtgcatcaagaagcaacaaagaaacaaacacaattcagagacaccaagtcaagatgtcaagagttttatgtactccaagttgaacatttttctcagagaatactgactttggtccttgttcagagcccagtaactatttctttatatactattatagtactttctttgcatattattgtaataactttgagtgttaattttctcagttcctagcaaatttagagcaagaagttatcattgggaaggaagtaggaattggaaaattgacatgagaggcagacactgtgatggcaatatgacgtgacgacagacagactgtagataggaaggaaacagctaggacttcagaaagctcatcagtatgagtctcttgattcagagacaagcagtcttaaatatcacagtaagcctgagacatcatgtatgatagcttggtaaaaatacatgctcttaacaatgaggattctgaagtactgcaggacagattacgtttttttttttttctccatttgttttatcgaagaaaacagggaagtagagaccattctagaataatttccatttgaaatggttaaaattcaaaaacagatctggtgcttaaggataagcttcatttatctggaaaatgtacttctatggaaatcctacctccttgaatgatgccaaataaatgaaaatgtgattgtttagccctttgatcttcaaaagccttagtacaagtggtagatgatttcctgtgacctcccaatcagaccaaggaattattatttctgttttttctccttcctaagagcaaggtagaaaatgacgagcaaacaatgacattactacagtggcattttaatgggtgttcagggaactaaaaagtcagcagaggcactgtatgaaatattcatgggtatttttctattttcttgcctcttctcgctccagatacaggaatgaagtgtatctggagagagaagatacataccatatctggagagagaagaggcaagaaaatagatacaggccaagtgttctgagtacaggaagcatgcagaaatggctcctgcaggcctatctttgacctttcatgggagggatagacaaggctcttccatcccccaccccaaaccttaatttttattttcctgaaatcttgtttttccagtaagctgagatccctctgcttcttgcagagtatccaagatcctgaatggatattgacagtctaatctccccttgggaattagaggaggattttgaagatgcaaatttccccactaaaggcttctgggagagggtgaatgtgatcaaacagattattgtcattgaagtgagaaaatgggggctggatggactggtctggggtacctcttaggtactgcctgtaaagcgttgacatgatacaaagtcaggagatccctaggaagcactttcagggttggggtggtatcttatcagcaagctgcagttgcaacattgcctgcttttgcctgttaatgattcttaaatataagcttggccactatatgggcctacactgcttgtgtgtgcttttctatggagacacattatgtgaaattctaaacttccgaaaccaaatttcatggaaacactcctctaccacaagaatccttctcttaagcacgtgcagtcccctcactgttcccacctctgaacatgaactcatgttttcacccaggtggatagccttcattctccacaggtcctattaattcttttggtccatctctggccccacctcctccagtaagtcctccctgttcaccccagtttagtgggatttcatctcctcatcttttgtggcacatgttgcctgaccatttgtggtgtgctggtcaatgttctctaggtggagggggagagtcctgatttgtagcatttaccaatttctgtagtgtaaatacttctgccatgggttatttcaagctaacaatgtggtgttagtgaatgcagagctgggaagcaggaaacgcatttgcttttctccaacgatgccagctggctgcggcatactactgcgtggagggccctggaactgtctttgcatgtctttcttatctcttcaaccaaaacctaagcctcagtgttgcttaactctgacttcacattagaaacgcttggtgatatggtttggctctgtgtccctgcccaaatctcatctcaaattgtaatcctaatgtgtcgagggaaggacctgatgggaggtgatcagattatgggggcagtttcccccatgctattctcatgatagtgagttttcgagagatgtgatggttttaaaagtgtggcacttccccttcacttgctcgctctcctggtgccatgtaagacatccttgcttctcctgtaccttccatcatgattgtaagtttcctgaggcttctctagccatgcggaactgagtcaatgaaatctactttctttataaattgcccagtctcaggtagtatctttatagcaatgtgaaaatagacaaatacacctgggagtctgtgacaaatactagtgctcagactccatccccagagtttctgagtcattggttgtggtagggacccaggcgtaagtatttttaagcagctttccagttgagtgtgatgtacagccagaagtgagaactgctgccttaaatgcagggaggatatttttttcagtgtttctcaaagtgtggtccctggcacgtgatagaaatgctaatttttggttcataccccaaacctgctgaatgagaaactcagggtgggagattagaccagtattctgcggtttaataagccctccaggtgattcttacgcatgctagatttgagaaccactgtcttctatcttctgaatacttatgaaaactaaagacagttataggcacacagctgtgcccaatcaacacttgttgattaaaatctatcagggagtacattttcatgaagcaagctattttttcctctttgtgagaagatttagtacagagtaccttaaaatagaggtttctttttgcagattgaatcatgtggcttacaaatagtcaaggatctaggatttactgttcattcagctatgtggaaacacacctattacattaaacaaagtagagtttattcattccacaaatatgtattgatagctgggaataatttgttattagtccatcttcccttatgatggccactctccatcagggcagaacaggcgtggacttctatgctccacttgttacttacaagctagatgatcttgtggccaacgcttctttagaccatattttttcaaagttattaattgatattgtttggctgtgtctccacccaaaatctcattttgaattgtaatccccataatcttcacatgtcaaggaaggtaattgagtcatgggggtggttccctgcatgctgttctcctaatagtaagtgagctctcatgaaatctgatggtttcataagtggttggtagttcctcctgcattcattctctctcctgccacctcgtgaggaaggtgccttgcttcccttttgccttccaccatgattgtaagtttcctgaggcctccccagccatgcagaactatgagtcaattaaacctttttttttttttttaatgaattaccagtggaaggtactggtaattcattaaaatgaaaatggactaatacattaattttacatagttttctgttttggcttgatgcaggatatctaaaaaacttataataaacttcataaataatgatgaaaatagtgatacattcttattacattcagagcaaaaaaacctgatacctttactacttctgctttttcaacagtagcagtgctatgtttatcaaactttaatgtgcatgtgaactcctggggatcctgttgaactgtagattctgatgaagcggtctgaggtggggcttcagattatgtatttctagccagcttccaggtgatgccaatgctgctggctcatagaccacatactgagtagtgaggctttgagattctagctgatgcaataaaataaggaaaaggaagaaagggtatgagaactgcaaaggaaaattatttgcaaaaatgattgcctacagaaaagatttacaaaccattaaaactaataagaattttatgctttacacattctgaggtgcccagctgcctggtgaggtagttgtagggtcaagtgatagtaatttgtaaatcataaagtattctagatgcttgagccaagaaggtaatgaagtattagcttctcaaagcatggttaattgcactacattgcctggtccatagtactggggtaatgtttttttcagaatgcttaactatggttcacccagcaggctctaggaatatatttttcacctgtttcctgtgtcatatgaatcagttccctaagtagattattccagttttcagagacagggagtttcttaaactccctttggcaacgtggtgaagtgaagaaatgacaaataggttttatctggtagtcaactctgatggattgtccaggatttctggagtctaaatgctgagattatttgtgcctgaaggcatgagtgctgtgatggatcagtgatgtctgccatcacagaggtcagggaaggtggtgggctggtccctagagctggactaacttaggtttgaatctctaccaacagccagagactcctattattaagctctgagacctctttttaggtctgtgggagtgccctatatttacgtttctttcctttggaccccgtggaacctagtcttttctctctaccttaaccatacttcctctgtcccctgtaatttctctctccttgagtgtgatgagacaggaagacagtttcctcaactctccttttcctcataagccccttgcccttatgggcctgactcccagtcttttgtagaaacaaacaaataccaacatgaagaaatgaggaggtttatggagccttacaaagctgtatggtcgtggagctagtctccaactcctaagtagtttaggggaatttctgagtccctgtctccttatctgtaaaatgggaggtaattattttgacctctcagggttgttgagagattaagtgatgtataacgtacatgaaaacacccagtggctggtacacagcaggtattcagtcactgttggttccttcttccagccagccccctgtgcactttgtcaacaaggctgacatagagtggacgttgtgactagatagctttcttggcatagaatctagatgaccttcctacatgccgttggatggggagaaataacaattatttttatttaataaaaactcccaaagctctcgcactatgccaggaatagttcaaagtgcattgtacatattagctcatttaatttttttaataactataaattgggtgctatttcacagatgaggaaactgagccaatgagaaattaagtgcagttcccaaggtcactcagctaataagtgtcagacctgggattcccacccagtgagtctggctccagggtctgtgtttttagctgccttactatgttcccacatctaggcctgtgtggggaacatcttggtatccacagctactaacttgccctttggggctagagaggttagggatttgctttgtttcttgggggattccttatcttctggactttcttgaaacaatacttcttcttgactctggcattattctgctgcattcagcagggttccccaaatgacccaggaaaaatgtcagcatgggagagaggggagttgggactaagtctgggacagacccagtgaatctgttaaatcagaccagagtgaactgccagtgtgaggccatggtctgactgctgtggtattcatgagcagagctgagaaagtgattgaggagagtcttggtggaacagagacagtcaccacatctgtatttgtctctttggccaatactgaagccttcactctcactcccacgtgtggggttgtgagaggaaccattgcatggagcaaatagtggcatctgtacttacctctgtccaggcacattgcattcacagtgcttgtttgcttgtctgtgtctcatgtgagctttgtgggaagaggaggggctgtgtctttgtgttcactcttgtatcgcaggcactggcacagtgcctagcacagagcagtaaatgaatcatgaatgaatgactcattcaagaaaaggccctccatactgctgactgttggaggatgctgtcctccttcacagtggccagttgagcattcacattgactttctgttgctgccactgtatgggccatgttggagacaggatttggaaaagtggtagatggaaggaaaagcagagagcacacactgggtccaagaagatgtggggccacggtacctctgaatgtgctgtgtgtggtggagtataattctccattgtaacttgaattgtttttgagaaaatggcaacttcctttctgtttccacccaaagggtgcatattggccttctgtgacatattgtcccattatcttctcccccatgactatgtggtttgatttaacataaatattatctgcattccagtattatagacaaggttcatttatccctgggtaatgatcttttaggtttctaatgtttcaggggttagaggaaggatgggaaaagtggttgttctcagattcacattccttcaatacttctggtgactagcctcacatccccaagttctccttgccttctgattaaatgtggttctgactctcaacatcttgttttcccagcttaagtgtaagccctctgagagctgattctgtgacttgtgctgacacagctcaggatttacatagagaaaatgatcagtaaatacttgagtagtgggcagtgtttgtccacttaatctgtgctgcagcaatggaaaaaatgaccttctcaagagggtggcaagtcctgctttgcaaatcactgagtaaaggaaaagccccgaggagccttgggactgctagcctacctgctcaataaagttccaccttaagatacaggctaagccttacctcctgggcctgcagtaacaacatattttgtaatgctgattccagaggacttgactgtggcaagcttgggtaagttaggtatcagtacatgtctttggaaattgcagccttctcccccttccccctttcccttcctctccctttcttgctccttgtttttattcctcccccttcccccttccccttttccttcccccttcccctcccacttccactccccgttccccttccccttctccactcccttccccttcccctcccacttgccttcctctccccctccgcctcccctcccctttcctctcctcgctctctttctgcttccccttccctttcccctttcccttccctcccttttcccttctcccttcccctccctcttcttcccccctctcctccccttcctcctactcttggtttttgataaatttatgagtctattagagcttgctggtagtataaaacatggtcaataggtgccactctttgaatagttttactgtaggcattgctcatcgtactccagtacagtgcatactaagggatctagaacccagatgtttaacagaataagcagaattggcacttgagtcaaatgttttctgaaaataaacctctaaatatattctccttgacctgggtcagaactgtagagcagagcttctaaaggtatggttcacaggagaactgccttagaattacaattacctgtcttacttgtttaaagtacagcttcttgagctccaaagtaaatgcacagaatctaactccatagggaaggcaccatgaatctgcactgttctgggagctccccaggtgattcttacatgcactgaagtttgagaatcatttagagcagtcacttttccttctttagagggagataagtaggcacattggattggaattcagtattaaggaggtgaacaacagatagtttttgagacatctgagagtttgttatactgaaaaaactgtgtcctactttttttttctaaattgtattttataacacaaagtatatttaaggagaagttgtggttgagacggggccagggagaatgggagaaaggaaacaaaaaattagataagcaaaaagatttttttctgtctattgttttcttcaatggtgtggtatccattaccatcaaacagagcacctgtaataagtcaccagggctcttgaagaaattggtgaagcttcattctcttgcagtgcttattagtgattcagtgtttgttcagcttctgctgatggagaattttctcttcagaagcttcacaagtcagaggttaccccttgctccctccaacccaattttctatgcaagaagcatctactttctctgcctaattagagacactcctcctcctgaatgacactggagtgacctgtcatggaggcaaaatgagagcacatagagagtgtgggtaagtatgtaaagacctgggcccagagggaggtacagagggcaggggcgaagtgtggagctggctatgcagaccgaatccaaatggccttagagagtagctccactttccagcaccctctctgcagaatattgacacaggcttcactttgtttcttccttgcttctgtgtctcccctctcccaccactctatcttccaaaccttccacctctcctgttttcatgagtggaagaagagagggtcaaagaactgccaacttacttgcatttaagaaagtggagccaacatgtagtgtgagaaatgtgtgggctcttcacaattgcacagggaagagcagagattcaggagaaatgacactccttccaggggctctagactgctgcatgttaggtccctaccagcccacagccagaggaaaagccagggtgaggccacttcacagggctggctctggaggccatcccagatgctgtgcccacggaggtgttgtgggctgtttctgtttctggaaacagtttcagaacctgagtatctgaggagatatccggaggaccacagtgaacattcctactccttgaatggaggctggccatggtccttgctgtggggaatgtgcctaggtttggggagatgcctgctgaggagcttgggacccaggtgtaagattcagcatctgatggaagaagctggcaagcattacctgcatcctgttctggtacctaaagggaggggggaattttcaagacttgttagagccaggggagatccaccaagaattaatgcccagcctccaggaagtctgagacatctgcttggagccagggacatttagctgctggtgtctagggtgatgctgtcaggagtgagcactgactctgaggcttaagtgtcccctctctgtgtgtgcgaccttgaataggactttccctgtatgtgtcagctccttatctgcaaaatgaagggtttaggcatgctgagccctaagtcttggcttagtcttataaattatacacttttgtcagatgacttttcttttgggggccatttgggataatgataatgatgactgttatggcagtgttggctgcccgagagcgaaacaggctccctatgaggtcatgagccctttgtcactaggggtattcatgtagtcatcaaagagcacttatgagtgatttcaagacaatttcatcaggaatatccaactattaaaaagttagattcctgggctgcaacctactctcaaggactccaattcggcaggcttgggatgggacctgggaatttacgtgaggaacaaatctggatcaatgtgctgctgtagggaggacatgtgagattgggagccctgtccactgtacccctcagtgcaggttcacaaagtgcaggagctgaataaaggttttgggaaacctcatagagatggaatctgtttgcttttgattatctcagtgtttccagaattgagtgtgggacttttgtgtataagtggaaaaggggactcctatttcgaggccacagaagcagttccatggtatctgtggggatgccagttttgtgggttttactgtatttcatgggaggatctgtggcagcactgcttgatagaagtacaatgagtcacatatgaaatgtaaagctttctagtcatcacattaaagtgaaaagaacactgggcataggggttcacacctggaatcccagcactttgggaggccatagtgggcagattgcttgagcccaggagttcaagaccagctttggcaacatagcaaaaccccatctctaccaaaaaaataaaatatatatatatacataggctgggtgtggtggcacacacctgtggtcccagctactcatgaagctgaggccggtggatgatttgagcctgggaggttgaggctgcagtgagctgtgatccagcctctgcactccagcctgggtgacaggaagaagccccatctcaaaaaaacaaaacaaagaagaaatgaaaacagttgaaattatttttaataatttacttaacctggtatatccaaaatactattttaatgtataatcaatataaaattattgtcatctttaacatttttttcccactatgccttctaaactgccactatgccttctaaactggtgcatattttgcacttgcagttcatctcagttcagactggccacaatccaaatgcttgatagccacgtgggctgatggttgccatgttggacagtgtaggtctatgagatgctttttgctcaacgtgtggtccaaaacccagcagtgtcggcatcacctgggagcttgttggaaaggcagactctcaggccccactcctatctactgaatcagaatttgcgtttagcactattccaggggattctgcacatgaaattgagaagtgttgtgtcagatgctctcttttccagtttcaagattttctgttccttgaattctgtgtggatgttgttagctaataagcagtgctgatgtgagaaagatgggcccctgtgtgcaagagtagaggtggctcatggaatctctgcttggcccctgaccctctaaaagggccctgggatccctgggcagaagatgtgcccatcacagtgtaatgaattctaatttgaatcttggccagggttcatcctcgggacctcagtgtgctgaacttttggggtggcaggctatcactgagacagcctagccaggcagcaggaggaccttgagcatgagatgatgtttgcacaggcatggcctctccttgctcactatgccgtgaaggtaaaatatcctacttctcagatagagggtgcaaagtttggtacaagtgccaatgcactcaaaggataaggagtagtccaggaccacaacagggattttagacagtttctcatgcatgccactggtgctggttgaccccttcaagcaacctgcatcacactagatacaatgagaaggacgatgggggagggaaagtgagttgaccaaggctgactccaggaggttctcctcttctcctctgagagccctagccttggcttcctcttggatcatgtgttccgactgttgtctttttccaattggcctccttgaaaggttttttggggatgcttagattcattctctgagttaggaatgtgtatctgggtgcagggaggggccaatgcttaggctaagacttgtgtttcgataggtggggcttgggtgtggggatgaccccaggatgggcgtcttgggtgttgcaacctggacgggaacactccctgcctgtcatctccacctcctttccagaatcctctgtcattgtttcttagggagcttcttagaaactctgcttctaggggactggtggggtggtggcaggggattgtgcagcaggggtgggtgggcaaggatctgcatctgcaggtctccctggacctcacctgtccactgccctggcccttctcacactcccagctgcttgctctcccacaacagggaccctgtgtctcacagttttggcattgatcctaggggccagcttccttgcttctctggtgtctctgattaagttcaggaaaggagcctcagcaattccaccaggttggctgcagcccaaatctctgtcattttcttgttactcttaacaatgtctgctgggtactttgggcactgtggggtttcattcatcagcccagatcaagccgtttttcctcttggattcacttattgtctcacatgacgttattcccccgctttcccttgcattcaccctctgttcttctttgatccagcctcttctagtcttcaaaagatgccatgatctttgccatcacagtacctttgttctctgccaggaaagacctctttcctccatttctccaaatcctgcttgtccttgaagactcagattctcaccttttcctggaagccttttctgatcattcctggccttgccaatctctttttataccagacttctgttgcatgtatggtcagtcaattcatcaaaaagcacatattggcacatgagtcaagggagatgccaaggacacagagatgaactagacctgacctctgccttatggtttagggaggaagacatattcagtaaaccattaccaataattagtaaattacttgcaaatgtgaatgggctggaagaaggcatgctgggtactgtgggggtatctcatggggagatatagtatgaggcaaggcttccctgaagaagcagcatttaacatgagcattgaaggagtgggtatctaaagcaggggagcagcacacatgtgagtcccgaggaggtcagtgaggctggagaggtgacagtcatgcagcagggacaggtgcacgagtatctgagaccacagaggcatggcctttccttgcagcatgctagcatgtgtgttaatctttcctagtccttctagttaggctatgagttccttgtaggcaagggctgcaccaagagcccttggaaactcggattcattcccagctgcagtggtatgctgttgcctagtgacttttagagctgattgataaattgtcagaaattctatgagctgtttaatgcacatcagttgctagaaattggccatgatgagaatatttacactatggaaattggtaaatgctataaatctgggctcttctatttttcctttcagtgagctggtgtttaaacatttaccagcacaccactgccagctgacgcagggctaagcatacagagcagaaggcagcagggtggaggaggaggaactcagaatagggaggcagacactgctgtgtgttgttgggaaagttagtcaacttctctgagcttcagtttcctcatctaccaaatgagacattgggatatatgtgaaaggatgtacatgagaaagaagtgataagaactgctcaaactagaagccccagcttaggtcagcagaatcagtccaggctggtttcctccacctctgttattcaagtgtcctcaagaactggacagtgcaggtctctgagatatttgttgctcaatgtgtggtccaaaacccagcagtgtcagcatcacctgggagcttgttggaaaggtagactctcccaccctattcctatctactgaatcagaatttgcatttagcaccattccaggggattctgcacctatcctctgttccttctggattgtttttgagtattgttttaaattttaccttaaaaagtgtaatattctctgttgtgtttaatttcacaagccatctcccatcctttctggatgaagatgggatacatgccttcctataaaacataaattgtgcatatcctgtttacttgcagtcatcacccctgacttcctaccccaaatctcgcagctgtcagtgggacatcagtctttacttttgcctgaatgttctatcccagcccttccctgggacagcaggaagagggctttcctccttctagaggctctctgagattcatgactcaactttgcaaggccatgttgttaatccccatgcctcagaggtattcagctgcaccacagccccttctttctctgcaacctgtgtcgacgctgccatttccccgggggaaaggggaagcagtgttgtcccttgcatggtgtctgccatgtgttgattacttaaggataatatttctggcagtggagaaaacgaggtgggaaatggctttcgcgggtgattaattgttgagatgacatggcagcttctgtctgtggccatgactcccaattacctgacaagaaagatagatttgaccaggagttcctcttcgagccttgtttctgagggctgcaggtagtgagaaataacacccaggacatttagaactggaatctgaaaagaaaaaggggtcatggagtgatcagtgtggaatctggccctgtcattgataaaacttgacgtgcaaacttgaccaagtcattttccatctgcaccttagtttacctctctagtgaaaggatgggcttgaactagatgatttccagagtccctctcagcactgagattctgtgattttatgaacttcaccaacgagctgagacattcctatttaggcttgttttatgttctaattcccaaggacatatttctcatggactgtactccagagactctaattatttcttgttagtcaagaataattttaccaagcatctgtaagctatgaggagcctgggatgtgtgtgtgttcagttttggagtgttctgggaattcagtttaactcaagcatttattgagtgttcacccttgggatgaaatatggtatgcaacatgggatttgcagttggaaacctgagtttcagtctgagatttgctgttagttagctttggccttgggcacacagcaatttaagttctctgagtgttagtttcttcacctgtattttataggtgaaggcacagagcctcttcattgaggaataaatgagagaatgtttgcagagcacacagcacagtgtttgaagcaagtaagtgctcagtaagtgttatttctttttctacactccatgccaagtctttgttaggtgttaggaatgcaaagatgtatataagtcaagggcttcctgcttgcaagacatctgttgactttaggcacacagacacccagtgatgatgatcagtactggcagtaagaaaatgatgatttggtgcataagagatgatatgttcagctcacagagtactgaactagaaagccaatggccagtgtgctcctgttgacaatcaggacagaaaaatacagtgcagctggggccgttctataaagacagaatgacagactccagcacggatttgagtttggggatggcatttagacagtccctcttggcagcaccatagttgaaattctccagacagaacatcattggcatttatgtttctagagctggactcacaccatgggggtgggattctaaagcttagaagaaacagcccttgaaagccaggggtttcttgcttttctggaagacaaagcatgcttacttgaatagcaagaaggtagaagcagagaggcatagctacatctgacccctggcaagtgcttgatgatgtgaacttttccctcctgcccatatttctttcctattcttttattaaagaggcagaaattgaacacttgttggtgttgagcactaagggtctagaagtgaatgaacctggtatttgcctctggaagattccagtgtgactggggagacagacatgtaggcaagtatactcagcaaagtattataggtgctaaggacgctgggagagggtacactgggcagggggagggaggtgaaaggtactaatattccacctggaggtgaggaacatgtggttgtatgaagatatctacagaaagagtttctgtgggtccatggtggtctggggaggttttctggaagaagcaagctctgagctatttactaacatctcccttcaggtcacagagctattccctaaagctccccaaggttggggaattcttatgtgtattttgagttctttctgctaggccagctcaaatgttgccagacattgcaagggtagtcggggctggcgggaagccctcatctaaaagtcaattacatttgcctttggaaaatgggacaagacatttatgcttaatatttgggtgtttttgttgttggctttaaaaaatttctttttcaggtcacactctgctagtgaaataccattaatttcaaatggaattaaatgtctgttctgtgtagagcacccttgccaaataattacatcaaatatatagtttgcaaggaagattgtctatttatcttttcttaaagggcagtccagaatccagacatactgcatggccccctccgagagccacccacagccttttctttagtcttttacccaagatcgctgtatcagctcatccttctccaagaacctgggtcaggaaaaattgtaatactcagagaacttttctgtattatcttcactaacggtatcagctttaataaaaatacaagtacccaagcttattcagcagcagggaaaaaaaaaaaaaaacctcacaaagcccctcatagttttactttgttatgtgatgacaggcagacaggcagagagaacaaaaaaggtacataagggggagatacagttgcttctagagtgagggagatgggggtggtggggggtggaggctttgggggcatcctacatgcccaggtcacagtggtacctcttgcgctgcaggtatctgtggctattccctccttctgggaccccagaattaagcatccttttggcctcaccttctcatagttgggagagttggctggaaaatagtgaacctggaacttgaggtgactctgaagatattcctgtttaatgtcatcattttgcaaataaggaaaccgatacccagacaagggaaattcagaccctgctcacagtttactgacaagtgcatgagtgaatgagaacctggctgtcctccgggggtagctgcacagttacacactgagctgcaggcaagggggatgagaccccaacatgcttaattcccaggctgtgcacttcccactgccccattccaacctgctgtagctcagtgaggggtgtgagcagagcaaagactgggactgcagcaggcaatgcctttgccctcgcaacctattctttcctacctcccatctgggtggtttttcaccaggggcaaattttgccttgcaggggatattcagaaatgtctgaagacatttgtcacaactggggggagagtgctactggcatctagtggttagaggccagggatgctgctgcacatcctgcaatgcacaggacaaccctcacaacaaagttatcagcccctaaatgccaataatgctgctgttgcaaaactgcctgattttgtgtgtgagtgtgtgtcgggggtagtgtatttgaaagagattagggctcagtgggactgcagtgagggtactgatatcattttaagggtgatggattaggttcctgttttacaaacttgcccacgcatttgagttatacagatagcttgttaaaaaagtatcaatttttactggggtgagattatatctcatagaggtagagagtgaaatggtggttaccagagactgggaagggctaggggagggagggttgaaggtaagctcattattgagtatgaaaatacagttagatagaaggaataagatctagcatttgtacaacagggaaattatagttaacagtaatatatggtatatttcaaagtagctagaagagaagaattggagtgttgccaacacaaaaggacaaatgtcttagacgatggatatcccaattaccctgatttgatcattgtatacatgtatcaagatgtcatatgtaccctcaaagtttgtacaaccattctataccaattaacaaattctaggcccggttccatacatgcatctccaggggtgggcctgggaattggtattgttactctgcttcaaaggtgcttctgacattgggcctatttggggaaataatggattcaggtgcagtgttggttgaacatttgttatttgcctattcagataaatctggattttaatgtcagctctgtcatttatcaactgtgtgaccttgggcaagtcacttattcttccagcctgcattgtctcattctcaaagaggaatgatcacatccacttcatggtttgcagtgagcatacaatgagataacatgcatcaaagcaccagctcagttcctggttggcagtaggtgttcattcctgtcagatgagtctggtagtgtgttaagttaacaataataatgagacccaacggtcgtcaaccactaatatcccaggcaccgtgttaaatgcttttataatatcttttctccttagcttcacagcaaccttgttttatagctggggcatattgtaggtacttggcctgtggtaggctgagtaatgcacatctccaggcattactggccttacagatgtggacctgcaaaaggtccacatctccactcctggaacctgtggatgttaccctatgtggcaaaagggacttcctgtggatgttaccctatgtggcaaaagggactttgcatacatgattaagccaaggatcttgaggggggatcattttggattatctgtgtgggcctgatctaatcacagggttcttcataaggggaggcaagtgatgagaggagacagaagatttaacaatggaagccagtcattgggtggcacaaggaaggaatcatgagtcaaggaatgtcaccagcctccagaattgagaataggcaaagaaaggaatgcttccctggagcctccagacagagccagccttgctgacatctcgatgttagttctctgcaagacccattctggacttttgacttctagaactggaagaaaataaggttgcgttgtctttaagctccatgctgtggtcttttgttgtagcagccgtaggaaaggaatactcttcctctggcctcatatccagagatgctgagctctgtgccaggcattgcagagtgacacaaggaagttggacacctaccacctgactgatgagaggacacgtacacacaactgaaaaaggccagggaatttgcagcaaggaacaaatgaaaatatacgagagaaaatgttgagagtaagaagatcttccacaccaggacttgcagtgtggacatccagggggactccacggaggaagtgtgaaggctgccggcccctgaagtatgcagttcatgccttgtaaagacagcttggtgccctggaaacaatgacttctctcctgcccagtgatccattggccccttagatgttgatcctgcacctggtctcctgccctctccttttccacgtggtgcagtggcttctgctgctgatcaacatattcccagagctgcctgtacctcccggtgactatgaggatggcaggtgagggcctcttcattccccatctccactaaccacgcaagtctctactctgccctgcctcaccccgcgcgctccgccatgttgattggtgagggcggtgtatgtcagtgctgagtaacgtggttattagaagtatgaattatttaaggagacgtgcacatcattaacctgtcattcatccgagggaggcttgacatgtgaattagccatgcacattgctattttgcttatggggaggggaagggaggtggaaggtggggcagcggggcaggagtaggggtgacgggtggtacaaataatcgaattggctgcacttgtgaaggattgggaagaattgccctgagaggaggcagtttttttttttttaagccacaacggagcaatttgatggcagagtatttttggcttcaagacactgtgaattggaaatgcaggagaactagcacgccacacgttcagcggcatctgtgagcatacataccaatatgatcactgtaattataataataataaatgttctcttgtggtgtgacttgtggaggtcaccctgagatgagaaagtgaagaggaagggaggtggaaagggaagctattaataaaccttagacacagccttcagctttcccttacccctctcctacactgaaccacgcatactcggccccctggcccagactttggtgacatatgagcccacctggtctggcatcatgaccccttggtagctgttcactcttccaaatgggctgctttgttagatgaacaggtcagttctggttattgcccctgtttggatctgcaggggcctctgctccaaaagcagatgctccttttgtgagctgctgaggtatgaaaccagatctctgggtgggatgggagataaggaccatttctgctagaatatgctgaattatggctctgaaaccaattacctttagagggagaccagccctagagttgttcacaactgggaattgcctgtgtcttctgacaatcatcaaatatttgtttagtgtctgccagatgatcctcttctttcaggggacatggaagtgtcagagaaaatctctcctgagaagtttaccatcttcttagggaaagactaataacacataggtactaactgtagaatattgttattattactatttccagcacagctaggaataatattctctaatatcagagagtcatatttttataagatgcattatattgctttattggctactggtggtaatagatggaaagtattgtcataccagtatggatgtgttttgcacagaaaatgaggaaaatcactggtgattagatgatagacaactctgtaggcaggtgtagtagtaatgctgatatctgacatctgcagaacgctttatagctcagatctcacctttgcaactcatttgatctttacaacagttgacagcaagtcatctgaagccagagaagttaaggagcttgtttatgtcatatagcttgtaggtagaagggctgggattggagccccttgtgatgccatggccaggacttgtcccaccccaccacagctgctagcatcacagaatgttatgtatttgtatgtggtatgtgtgtcacagtgctctatggtttcaaagtcttttcacatcaatcacctcctttgattctcacagaggttgagtgcatgaggtaggttcagttttattctggccatttcaggggcagtgggtttgtggaggattagccttgaaccatctgctagctgatgtgttagtagagcatgttgactcctggagaaaacacacacaaatatgtgtacacacacacacttttcaagaaacaaaaccacacagaacaaacaaaaaatgataatagaaagctgcaagtgtaaagtatattaagtatatttactgtatcattgtgccttgctaattaccagataacagttatcctttcttggattccataatgtaacagcataagatgggcaggtgcccccatatcctgctgctgctcatcaggcctgatttgggtatttatggttgtcctggccttttggtatcagggtgagtcttcctgctcttcagctctggacacctcttggtctgccctattgttctgccatcatttgctcactgtgttctcctttagataaaagaatggagatggaattaagatggagttacggagctttacagctttacacactcctggtttttgtatctacttatagaacggggtgtatgtgtgtgtgttttggtgtgcatgtgtacccacagacacactcacaaatgtgcttgggctgaacttttcctccacacctaataacttggagcaggatcatgccattgtgtgcatggatcatttgtattaccggttctaaggcagcattattattttaaacctcacttatgatgtttccagtgactgacaggcactgtcataaatctacctgatactcctgagcctggagttgttgacgtggcttaggatgtatctcccggttgtctagcattgctcacccatgctgagcctgctgttcatttcagctgacctgcttccaccaagagaaggcagggagcttgggaaccaggtgaaatgggcagtggtctgccctttgttgaggctgtgttgcttcctagagcaggcttccctgagcatcctgtcactggaacctgggaggatgacacagtactgctagcaagatgtgcaataagattgcaaagatgtctagtctagttcatctttcttatcagtgcagtaactacaccttacaaaggtcatcagcctgttcttggatacctacagaatgaggagatcactcctattccaagggaactcattctgttgtagagttagaacactcttcttatgtttggccaacatgtggtgagataggaagtgccctgggccaagagtcaggcatgagctcattcttctcctgactcccttactgataaactatgggatctcgggaaaatcacattatctttctgagccccagtttcttctgaccgtgaaatggataaattgggtttcagatacagctctgagatgcttggggtttctggaagattcctcaggtgttgcaaagaagattaaggtgatggtcaagtgttgggcatgagtccaaccatactgaatgagaattattatgattttgtgttttacatatgcagttttgagtcaatgatttttgtagctaaacaagtttaaaaaacaagactagatccttcaagattctttccaggtctcatattttatgatctttgaaatctgtagaaattacaacaatctacttagtattatagagtaatactattttaaattcactttgcgtggaatgattctaattcctcttataagacagccttcctaatatccttgaccatcctaatgtccatatgtgcggattgtgatgtgaatattaagacaggtctgttttggtgtcctctttccttacttcctctcctgtattactctcttttctactccaagtgcttttgctgtttcctgttctcaatagactattggacctggccagctctcacaggagaaattgtctgatcacgttaccctggaagaagtgtttgctgatggtgatttagagttttgatatcttccaaaatatttgggacttctgaagcctgaaagtctaaacctcttctcaaaaaatgaatcttggggccgggcgtggtggctcacacctgtaatcccagcatgttgggggaccgaggcgggtggatcacctgaggtcagtagttcagcctggccaacatgatgaagccccgtctctgcaaaaattcaaaaattagccgggcatgatggcaggttcttgtaatcccagctactcagaaggctgaggtggaagaattgcttgaacccaggaggtggaggttgcagtgaaccaagattgcgccattgcactccatcctgggcaacagtgcgagactccgtctcaaaaaagagagagagagagaaaaaaaggatctaggatgatgaagttggaggctcaaagatgaattgtgtatgggctgttctcttacatccttcagctgattcttcttcatcccttcctcaggatgtgtttgccctagaggtgtatttgtaattttgccttacacaagtgtttccaaaagttaatcctgtggaatactaatcctaaatgctctgagataaaaggattctgtggccagatgcctttgggaaaatactgtgtattatgttttcctcttggagattcacaatgcaccttgatctgtttcaggatctgaggaatccatcagggaagagtcctgtttatctttgtttaattccaggtttcacaaactatttgaccacagttatcttgtttttctctaggaaataactagaaaagaccccagaactggtgttccccagagcatagttgggaaactctagagcagtggttctcacctcgggtgattttgtcccccaggggacttttggcaaagtctggagacatttttggtggtcacaacttggtggtggggtgggagggtgctcctggtatctagtgagtagaggccagggaggctgctattcaccctgcaatacccaggacagtcacctccaaccaagaattatctggcctcaaatgtcaatagtgccaagattgagaaactgttctagaaataggcaggtacaaggtgtgttttcaaacatcccttgagccatttgtaacagcccttcaaaatcaagctttgaagccaattcttttgtgaccaggagtgttttccggacaatgcagaaggagatgcacccagatagtaattccctgaacataaccatgacaaattcagaactgagttctccttcaagtgcagaggcagcagtcagctccctgactctgcaggatgtgggctgggatgaaaggccccttctcagtgcagagcgtctggaatcaaggctgacatagcttatcaccttgttcttgtcctcccttcctggaatcaagtggtttagcaccattataggaggaacctgttttcctagcttgtagattgggccttatttctttctttaatcttgcctcaagcctcttttctttttcttgggctgacagggctttgcagctcattctggagatgatgttgacttggtgaaaaaaaatgtgcttgctattccacaaagccgccattgtcatcctggcccgttctcaatgagctgttgggcacacctcccagacggggtggtggccgggcagaggggctcctcacttcccagtaggggcggccgggcagaggcgcccctcacctcccggatggggcggctggccgggcaggggggctgacccccccccacctccctcctggacggggcggctgcaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtccaatgaccctgccaaatccccctctgtgagaaacacccaagaattatcaataaaaaaataaattaaaaaaaaaaatgtgcttgctgtcaagcacaagagtgtttctgggatagggattctttaagtcttggtgatttctctgtttccataaagcagagcagtggtgcttgttagtcaccagaactcacacctgcagtcttctccattcaatcccattccatctcagggagggcagtggggattgttctagttctcgggtgttctgattttctaagttagtgaacgtgaagttccttgggggcatggatccctttgagaatctggtgaaagtggtcaatcttcttacagaaaaatgcatactgatgcatgcacacgattttacataagagaggtagcgcatggacctgtggtgttagtaatctcagagtttgacatgatgagtttacaggacacttcttggaggctgtaattgcttttgtgaatctatactgaatatcaacattagggtgcatgaggggaggatcctctttagtccctgatctctgagcactgctattcttggagattcacaacacaatgaattactactttcttgtgttttggctcattcattcattcatttatttagcgcttatttagtttctatatgtcaagttctgttttaaccactggggagtcaaaggtagacagtcttccttgatcttgatgataaactatataggaattggaagccaaaaaaaaaaaaaaagtgtagtggctcttgcctgtaatcctagcactttgggaggccaaggaaggcagatcacctgaggtcagaagttcgagaccaacctggctgacaaaaccctgtttctactaaaaatacaaaaaattagccaggtgtggtggcacgtgcctgtaatcccagctactcgggatgctgaggcaggagaatcgcttggacccgggaggtggaggttgcagtgagccaagatggcaccactgcactccagcttgggctacaagtatgaaactccatctaaaataataataataataataataataatagtgatgatgatgataaaagaaaggaagaaagaaaagaaaaaaaaaagaaaattaaatcctgaaggcagaagctgagaggaatggcttcaggttcaggtgcagagcatgtgctgggtgagaacaagccattcgagaccaggtccttgcctctgtgggtactggctcccttggtctgtgacccacctcctggaattgaagaattgtgcaggatcaggcagagttttctttggtgcctggcacttggttctggactgaagcttggcttaagaagtattttaagaacactgtaggaaaccattcagaaccttccaccaccccaaggcagcactgcccactcctgcttttcagtgccctctgcagaatgctatggaaattccacctgcccatcctgccccaccaaaagcatcagatggctaagctagacttgtagctaggctcaaagtactcaccagtgcaaaccaacagagcagcacagtcatggacagtcaccaagaatgatggccactttggtgacatcccatagatgttatatgcaaggagcaggagcacacagagtcctcaccttgggattttaggatttgactcatcagttgtgatctgtttcgccaaaggaggaggatgtgaggcagctgggggtgggattggggaggataatcatattcttggctcatggctatacctggtagggggtaaggttgacttttctgatcccagtattcttattgatgggtgctcactgatgctggagtctctgttgagggcataataataattttgcagaatgatgaagacctttgcaatgaatcatgttaatgccacagttacttctgttaggtctgcattgttgagctccataaggaatcataatgaatccactgaaacaactagatatctcctttatagttaggactcacattttaggcaacctggggagagcatgagctggtctgttagtttgtgctggggagtactttgaacttagctgcaagtccagcctaaccatctgatgctcttggtggagcagggtgggcaagtgggattttttttccagaaagaatttttgcctgtacaacatcatgatgttctcccatgaaaagggacaatgatgtccatagcagttggattcaaaagaagaaatcacttttccataattggtacctttttcattccctcttaaaaaatacccagcccgctaccctggccccgaatccccagtgaacttcagtgcagggaaacagaaatgcagagaaattacaattgtaaccaggtaatgagagtcagctacaagcagacggctctctgcctgtgaaaacagggcttacaattgcagatttttatgactccattttctgctttcaacatagcctgtcgacatctcaaattgagaagcccatcaatgtggcctgggcagcctccttccagctcctgtgtcaggagagatttattattcttatagactctacttggagccacttcttccagattggcctagagagggaggcttttatttaatttaattttgctgagaactacaactctgcagagatgcatgttctctctcctgaggtaggtttctgagtctaggtgaggaaggtggagtaattgaatcaggcaatggttgagttgaaagaaaactaaaacggagccaaaaggccatttattgttgcattgtgggttctgaggagtagaaagataactgtaatgtctgtcagtgggaaactggttaaatcagttatggtgcatttatagaatggaatactatgcagctgtgaagaggaatgcaaaagatttatttcccctgatcaggactgatctccatcagtccttaatgtaaaagaaggaaaaaaaatacggtgcagtatatatagtatgaatccacttgcataaaagtgatgtgtaaatacatactttgcatctacaaggatgatctctgggagagttcataagaaacctgtaatcctgtttgccactaaggaagctgttgttgagggaaaggggagccagaaaagcttttcatagaaaaccctttagtgcttctggatttgtgttttgttttctattatgtgtttgtattactttctcaaatcacttaatgttaaaaatgaatttcagatctaatagtggctagcaaggcttgcttttggaaagatgagcaaattgtggtttgaatgtgagtaactgaagctacccagaaatgaaaagtgtctccaggaactctcattattatgtgggatttatcactgctaatgataagtaagaactagaacctgtcggctgaggtacagttttaccttcatttatggggatgaattgagtacattatgggccacataaattgcatttacaccacaccgatttgttatgtgccatctgttagaagctggaacttccctcctaatgacatctttgtcttcccccacctgggctcctagcttcctcttccagtggctggttattcttcagcagggtgaggggggcaggagtcaaagagataatctctgtgtgtggaatggccaagtgggagcaagtgagaagtggtgaggcctttgatgactagtgtggtgtgtcccttttgaaaacagtcaaattcagcttaaaaaaatacctgcagttcataccttgttcaaggtccaggcttctaaatgcctttcttgaacatttccaagaggtcctgtcctccttctgtaatgcccagccttgggcatctgataggtgccttgtgagtcagaaagcactctcctgggcattggtgctgggagtctatgggaggaaaattgaccggatagccagaggcagctcagctatttgcgtctgagtgcatttagcctcaaggtccttaaaaggcatcttgtctcctgttttggacatcagattcctggagggcagggatttattcatctctccactcagggcagaggttaacacatctctccctgggcttttcttggaaaacccaagtcaggcagggtgttactgggttctaacattacaactgggagaccctcttctcaggatgtagttctctgacaggaaatgtaaaaactacaattgctaagaaaagtaaatgaatggatgaattcaaaaataaatgaatggatgcaatggatgcacaatgtttagtcagaaaaaaaacttgatatgcattcagtgaaaaattgttgttctttgaaagtgtagctgtatgtggggatgggctctgtctgtcctacttccaaaccctctgccaccacccaccctcacataaagaacctctggctgtgtgatcctgggggcactgtttcccctgcctggtttttctggctggctgggatgttggctgtcccagtgtgcaactttgttggataattcaggactttctcttcctcagcctgtcttttcttaatggtgtggaatgactcaggattctgtgccaatgcctccataactcttctcagtaactaacctatacaggggtgtcttccccaggacaaaagcaggagagcctgtccaggatctataactgtttctttccccgtgcagaagcaccaaggtgcagaccatatctaaaagccaccacagtactaaataacatgatgcagcagaccctggttcctataaattactgaaaacagtgctgaaaagataatgtaaggtgcataaattcaagtatttagccagaagcgcattaacttagggcagacaaaaagaaaggaagaacattaacaaaccacttcctggtaagagttttcagtagatggagaagtaagagaagaggggaaacaaaaagtcagccatattggaaaggtggttagagaaaaggaagaaaaagtgtagagatccttttccagatggtggcagaaaaccttctggtcctgagttggagctcccaggtggattgattaccattggaaggtcccatctctgcagtttagcagttttctcatctagtggctcaaatatcaccttttccctgaagtcttctccaatgctccggatgaaaacaaatctctctccaagatttattctgttgcattgtttgtctcttagtgctgactttctattctggtgatgattatttgtgtccatgttttttttccccctaaaaatgtataagctctctgaaggcagagattgtgagttggtgattgacaattcagcagctattctactgtttagtatatgccaagctcagtgctaaagggacataatgaaatgagcaaaacatggtctcaacgctaatgacatttacctttagcagaattgagtacagttctttgcatagtatatgagcaatcactattgaatgaagctggctcaaccctctcttctttgttttaaggatgaagaaattgaggtccatgactacttgaactttataagataacactcctgctttgcataaggactaaaacaggcaacacttttttttctctctctatttgatagtctacaagcagcatcattcccttggccagttgtttcacagatgaataagtggggctgggagaacctggaggtagccttaatcccatagttgggaatgcaacttccagggttcactgagagctaaagaaagaacgtgaaagaatgatcaaagcaaggccagtgggggtgtgtatgtctgagaaaggctagaaaagccgaggagggggcctgtggtggaatgggaggctagatcttggggcaggctgaccctgggctcagatggctggaggtgctatggattcagagccctgtaaacaaacatatcagttgaaacttagcttaagtcagtcctttgttgaactcgacaaacagcctttccttttcctggttgctgtgcaggttggttagagctggaagataacttaggaagctgtcgggttcagcctttatgcaagtaagatattgcctgtgtttaacagatgacttaaaagaggctcggtgaggttcaaggatctaagaccactcaggagagctctctagttgatggcagcccagtggtgatgagtggagtgtaaacttataaaccattgtgaacattctttctgattaaatttcagcagaatcaggctatgtattcaagtgaagctcaggctctgcagggactaaggatgcctttagccctcagcttggagcgtgggaatgctgatgtctgacaccttttcactttggctgcagtgtggatgactgaggatgacttaaggtgcctgtgcttctctgagatggtctagagctggagcagccacaggcacacagaatcatggggcctgtctcctcagtgcttctccattcataagcagattagttatgaatgaagagggttcattctcaacagaaaaattagttcttctgttgacccctaaggatcatctagggttctctgcaactctgggaaattgggagctcattttaattgggaatctttagatagggtggtcatagctgatatttatgttttatgtacctcttttttttcccctaacaaagtcagtagttaaaaatcttttgccaagatcagagttgttatatttctattttggaaaaaaatcagaaagaaaagaaggggttagattggaggcataagtatagagggaagcctgggccagtgtctaccttctttgcaagagaaactcatgtttttggggtggttctggtctgaattcaaaactcagggcctgggaaagacagttatctgacaaactcctacaacaccatgcatctctatcctggtagatgtctctgggcagtagggcttggtagggagatggtggaagatctgtagtagggcttccacactaacctggctcactgctgcctatttgtccagtgcagctttgaggccatttacagtctcattcttcagaaccacattgttggtccctctttgaggccgtatcccattctgctttgcttcactagctaagcatgttaatgactttgtaagaccatttggtccttcaaggcaatgagtgttttattccccttggattgctcatagcgcttgcactatttctggcagttagaagaaatgcaatgaacatttatccttatggtctttggaacatttcctgcttcgggaagtaaaattttaagtattcttggtatcaaggtggctaaaattcttctactttactatcattattttctttgaaagattttttgaaagaagcctctttcataaaacttatgacttggatttacgtgggtttactttctctaacttcctacatttttgtaggttgtatatcaaacttattttttttcacattcttcctccccaggaagactgtgggagtctcattcttcctccccaggaagactccttgagtctcacacaatgtctgtgttcttactttaagattaagttattttggggtcatggatttcccaagtttatcccttgataagtggtctcactgcaccaatattatggttgggcaaagaaggagaggagccttggaatgtgaatcaggcaagtatgattcccattttcatcatcacaacaaacctgggataagcattgttatctcaatttttgagaaaaagagattcttgtcactttaaaattgagtcattttgaatgtcagataacacaacccgatctcagaggtgattatttttttttcacttagagtagcagaataggaagttgaactctgtaaaatacacagactctacaattagggtaattaaaataatgagtctatattcttccttttgcccaaggtcatacagccagtaacccgtgaacctataattcaatcccaggtctgctggattaaaatacttctagttttttatggttgaaagaaaataatagaatttatgcattgtgcgtgactattgaaagcttgttggggagctaaaatgaaatttgacaatatgtgtcttaatagggtgacattggtaggatgttggggagggtgggtgctgtgagaaggaaagaataagttgaggtctgtggtattacaatattccaggaagaagattatggaaatctggactgaagttgtgggaatacaggggatgggattgttaggacttagcaatgattgaatgagttggcaaacaatgaggtcagtaatatggcttttagtatttttctctacatgctgggaagcacagtgacaccatgaaccaggacagtgacacagacagagcagcaagtgtattatttagcaagctgaaaggaagaagaatgagtataattttgacatatgattgaagtatacctgtagttctaaaggttggtgtcttccaggaggcaaatggatttataggtctgaaggtgaagaaggacatctggatggcaggtggaaattgtggatctactagcatttaggtggcaatgaaaccgtcagagtcaacaaaatttctcaggaatggaatggggtgggaggctaaaatggaatttcgggaatgaccaaaatttaagaggcagagtgtggcaggtcagtgatggcaaagctgagaagaggccagcagatttttaggagaatagggactggcctttctctcatctcagttttcatggcagaggaaagtcgcaggcggctgctgttgtctttggtggcttcctctgaagagtttctaagatctccccaacagggtcattcatctttgaatttctggagcagtcacgattccaaatactttgtactattgtcagactctatacccgtatttttgtcaggcctcgtgtccaggtttttggtttggaaaatatggcatgtgtgtcactcttcagctctctggaatgaagaatgagatactccccagtgagcctgttttccttcaagagttgatggctggggctttttctattatgaagccaaagtgatgaagagccaagtggccgctgtggatgggaaagacaaacagcaatacagggagtgctggggcccagagcagatgcctgtggaatggagcagagagtgtttcaggatcccagaggaagaagagctacagtaatccaggggaaatggaccagaagagcctccatcagaaggatttaaacagacaatcaaggagggatatcaaggtagatagggtgtgtgtgtgtgtgtgagagagagagagggagggagagagagagagagagagagagagagagagagagagaatattatccagcatagtagaaaaggaagagatttagaaggttacttcagtggaaacatatagcatatgccttctcacaggttttgctgccacagcaaagagacttctttggtagcaagatttaggaggaagcacatcagaaacaaattccttggcgtaaacaccctttccctcgggatagtgtagcccaacactcacttaaagcttgtagaggaggagtagcctgctttcctctaccctaagaaaagccatagatggtctcagtgtggtaaatggagatgagtaagaaccagcacaataggagctggtctctttagcattctattcttaggtatatcagacccagtttcccgtttttataacaaatattttgaaacactcacttgacaatactgaaatgacattcaaagacaatgtaactttcctacacacacaattaaaatcagcataatgccctaactataatatgaagcagaaataaaaggggagtaatttataacaaaatagtatacatttcaataaatactcgggtatggctacacttgaagatataacgaagtcatcagatggttcctcctatatatagaatcaccatgaataagagctataaaggcagactgatcgatcagatgtgtgctattggcagttcaaacactatgaatggcatttacatttattatgtaatttaaaaaaatggtgaatagttttttgtaaagttcttcatagaataagttaatcttcctttaatctacatagtatttgtattcctagaaaattcagtccattaacactatacaaaaatattttttgctttatatgtaaaatgaatttaggtcataggcttggttcatgacaaacaggttcttccctacaagaatgtattgtgggatattttcaagctgtgtggaatgtcagacaatttttcatggtacaacatggtgtagaatgatcggcattcctgccttgtcactaaatccggtatttcagcaccctgtcagatttttcacatgccccctaaggggcagtagctttcttgttgataaccgctaagttggagttggtggtggccagaagagaccagagatgatgggagctgaagagctgcagttatcctctatgatcaattcttggtaccctatcagggagctatcctggtgctggttagactttggtacaatctaatttgattcccactgacttgaccaattccatgttccacctgcaaccaagattctttgatcttggctttctgatctaaaactctagttaccaactttagccttctccatactgtgagtcatatgccccctagcagagcgctttgccctgctttggacccaggaaccttcctgagctgtcatgtgtctttggctgcaccttcatgttgggatcaaaaggagaaaaggatcatgacttctaagtaacttcatatgaaagtcctcaaagagggattgcatgagttgtctcccagacgagtagagcacagttgtgttctcacatttgggtttaataggtagggcctgggagttccatagtttgttccggatttgtgaaagcctgtccatgctttacattctgtagctagaacgctaagtggtattttccagagtgtaagaattgttcatctagaacatggatatgataataaatagcactggctcatttgatgagcaaattcatcttttttcagtttgcttttaatccctttaggatatcaaggagaaaatttgagtttagggtagagtgtctttaacacattcctaagttgataatctccattttttttttttttccagaaagaaaagagcagacttcaggctcagagtccatagcagggagcagtattgactagaccttaatggcttcatttccctgcttcacaattatttttatgattactctgcatttatggcaggtgatactgtttttccattttgttggaaatatacagttttcttttaaagtcaattaattatagttaaaaaagaatagccaatttaaataagtacatcaaatttagtatacatgttacataaatgtagcttgtgaagaaggtggcacatgaataatttaagttttggaaacattgccattttgtatcattcaagaggcaggttcctgggtgtaaaacaagttctggggcagaggcagaccacactttcagggtattggctggttgtcagttcattaaattattagttttttgcacagacacactccagactatttactattcttgttgaagtctttgtccctggataggaaagcggcatgtaaatgcctcatataatcagtgatggatggcccttgcctgtcagtctctgacactttgagtgttcagtaatttcattatctacccatttctctactctttgcagcctagcacttacaacaaggtggcattcatccctaatgacatgggatgagccaggattctcaagaatcattctgcttttaagaaggatgaaattccttgaaagatgacatttcccatttttttcctccttggtttagaacaatgcaagactcggggctaagaatatttgcagttttaaaaattgacagaaaagaataattagcctaggtaagaggtctataaaatgaaacatttagtgactaatgatagtacttgaggtaaatgtttgttaaatcaaaatggagtaagtattttttccaaatacggtttttacaacgagctttgatatggcttggatgcccaccaaataaataaataggagccacatttgccattggtttgatgaagccaagctgtttgctcagccaaccttggccagttttgctgcttggagagtagcaaaaccttgaatctgaatcaaggctgatttttttttttttaaaagagacagttcataaatgtgcttgatacttacaatattgtttgtaattgtttgactactatgtgcctcacacatttatttcatctaatctttagagcaatgtctaaggtagctttggagaagttaagtaaactgcctaaagtcacacagtaggtaaggtgggaccaggctttgaatttcacatctcaagactgatctctatatatccaaagtccatgcttagctaactttttcttgaaaaatccatctagcctgagttgaaatattgtccccctcccttttaattgcaagacacttccaaagataagaatcttgggagattagagaaaaaaagtatcttgggtgctgaaaacaaaacaaaataaagaaaaacacatactcacatgcagttttctgggtcccagctcagagctactgaattagcatttttgagagtgaggcctcatcataagtctaacaagcccagaagtgttgttagtcatcagggaaggttgggagatggtgcataatcccataaggtaatttcaggggtgattttcaaaatatttaataactagtaaggactcaggcactcatcaattagaaagggctctggctgtagctggagcaggtcctgagactctctcagtgccaagccttagctcctttgatacaggatattaggaaaggtgggagctctaaggtacagctctggggtgcctgggtggtggtaggatacatgcagaacttggagcaatggcttgttaccaatgagccttggagcatgtcagtatcttaactcatgtggccgtataagtgagtaccagttgactatcagtcctggtaacattcatgtaagaaactggaagctggtgtgaagggtgggttttttttcttctataaaccccatatttctcaaagcctcaagtcatctgcataacaatcacagagaagctctttttaaaaatgcaaatttgatagcacaacatacttattagaattgtgacaatccaaaagaataacagcactaaatgctgatgaagatatggagcaacaggacctcttatttgttgctggtgggaatgcaaaatggcatagccaccttggaaaacagtttggtagtttcttacaaaactaagtatccactcaccatataatctagtgctcatgctccttggtatttacccaaacacattgaaaatgggatctaattaaactaaagagcttctgcacagcaaaagaaactatcattagagtgaacaggcaacctacagaatgggagaaaatttttgcaatctatccatctgacaaagggctaatatccagaatctacaaagagcttaaacaaatttacaagaaaaaaacaaccccattaaaaaatggataaaggatatgaatagacacttctcaaaagaagacatttatgcagccaacagacatatgaaaaaatgctcatcatcactggtcattagagaaataaaaaccacagtgagagatactatctcacggtcagttagaatggcaatcattcattaaaaagtcaggaaacaacagatgctagagaggttgtggagaaataggaacgcttttacactgttgggagtgtaaattagttcaaccattgtggaagatagtgtggcgattcctcaaggatctagaactagaattaccatttgacccagcaatcccattactgggcatatacccaaaggattataaatcattctacaataaagacacatacacacgtatgtttattgcggcactattcacaataacaaagacttggaaccaacccaaatgtccatcaatgatagactggattaagaaaatgtggcatatatacaccatggaatactatgcagccataaaaaaggatgagttcatgtcctttgcagggacatggatgaagctggaaaccatcagtctcagcaagctatcacaagatcagaaaagcaaacaccacatgttctcaatcataagtgggagttgaacaatgaaaacacatggacacagggaggggaacatcacacaccagggcctgttgggggttggggggctaggggagggataacatcaggagagatacctaatgtaggtgatgggttgttggctgcaacaaaccaccagggcacgtgtatacctatgtaacaaaactgcacgttctgcacatgtaacccagaacttttttttttttgagatggagtctcgctctgttgcccaggctggagtgcagtggtgcgatcttggctcactgcaagctctgcctcccgggttcacgctattctcctgcctcagcctcctgagtagctgggactacaggtgcccaccaccacgcctgcctaatttttttgtatttttagtagaggcgaggtttcatcatgttagccaggatggtcttgatctcctgacctcgggatctgcccgcctcagcctctcaaagtgctgggattacaggcatgagccaccgtgcctggcccagaatttaaagtataataataaaaaaagaaaatgtatgtctacacaaaaaaattacatggatgttaataacaactttatacataattgccaaaacttggaagcaaccaagattcctgtcagtaggtgaatggataaactgtgatacatccagacgatggaagccttaagaaatgcactattaagccatgaaaatatatgtagaaactttaaatagatactactaaatgaaaaagccaatctgaagaggctacataccatatgatttcatatatatatatatatgtaaaacattctggaaaaggcaaaactttggagacagtaaaaagatctatggttaacagtagttagcgaggagaggggaatgaatgggcagaccacagagtatttttaaggcagtgaaactattctgtacgattctacaatggtaagtgtcattatacttttgtcaaaaccaaaagaatgcacacctctaagggtgacccctaatgttaactgtggactttgggtagtgatgtgtcagtgtaggttcattgattgtcacaaatgtgccaccctggtgctgctgggatactgaaagtgagggagggtgtgtgtgtgttggggaggcgggtagggggtagatgggatatctctgtaccatcctttcaattttgctgtgaacctaaaactctgctgaaaatacaatttatctgaaaatagtaataaaaattcagcttccatagtttagccctagtcctagagaatccaaatatgggtggagtgagaaaagggtgacaggaacctgcatctgaaacaatagctccccaggattcctaaacacatggatggctaagaactgttgtgtgagaagattcagtcactggcagatcattgagcaaacacatttccttcccatcccaccttctccatttctggtttccctgatggttgggctgatcctctctttatatcactggttttaaaaactgctgcttctatgaagtgttttattatttagctagtcagcactgagtcttccttctcctaaatttgtagaaatcagtcactattttattgctctttttccatgtgtgtatgttcactttttctagcatagacaggcagctttattgtaaatggtaaggggcacagtcagatggcctgggatcaaatcccatttctgccactcattgttggtgtgacttagggaatgtcacttaatctctctgtgcccagactccctcatctgtgaaaatgggggaatcaagagggcctatttcatatggaagtttgggctactaagttagggcacagtcacttctattagttttctgctttctcttttctcttagaggaaggcagcgtaggggagtgggcaggctctgcagcccaacagatctttgattataacctcggaaaaattattaaaccttttagaactataatttcctcacttgtaaaatgggagtaagaatgtctacttatcagtgtaattttgaggaatgtaaaaatatcacctctcttaaagggccagctccccaccagccacagatgaatgctcaattgaagtgaatatcccttttgagcctgtcactcatgctgctgtgaacatagtgaggactgaatgagtgtgggaatgaatgatgcattgcggttcagtgtagatgggatctttgaaggtaagatatggatctgttgctgacatgatttttacatcttaggactttcatctagggatgtatgttttgaagcagggcccgaaagaaggaactgaagcattgagggatgcatttaattcttacaccaaaatcttacatgaatttacagatacgtaaactcttacagtgtcattgtagtacacagcaagggcaagcttcagatctgttaaaaaattggaaatttctaccacttttgaaggtcttaagtttaaacactgataagaatagaacttacaatgattctgaaagatcctggcttctttgatgttaaaatgggaattgtattctctgagacctacttcccattgccagctcactaagcaattgctcacattttctctttttactttattatattttaagacatttaaaatattttggtgagtcattcttcttggtaattagttgtagtgattagaatagcttttatattctaaggcattaagtttattttatacacctcaacattattttcggtaatgacctagaatttaacaacggttttgcaaagattctggctctctgaagccaagagatggggagactgtcaggtgataggaagggagggcctaaaatctccatattctgcttttattaggcaatcaagatgagaaaatagcaagaaagaaaagttgaaaagcagccacaacaaagatgagattttatagggtttatacaaagttgatttttcaaaatcttgtaatagtttttggaattgagataatacttttaaacctgaactgatggatctctttggaatttacagaaagaggtgctaggctatgatttccccaaaaaagtaattgacttatcctgggaatagccaggaagcagcaaagctgggaaagtggggagtgtgtaggaccatgaaatctggcttcctgattggatggagcaaaaacaaagagaggaaagatactcagtttcaccactgtgtggttcaagagtccagttaagacctattgagcatctacagaatctggttccctgaaaaatgaaacataaacagaatttgttgctattaaatgctatggacaacttttggacatcaaagaggtcaccattctggtagtggggcctggagtcatgtgctcagagatcttggagagagagcatagagagtaggagacaccaaattgagttttttcactcttttctctttccctcctatggccctgattagtttggagcataggcgaggcttctgttatcatgaaacccagaatgctgaagcttgaacaatatggagatttctttctctccaatgtccaggtgtagatgggtggtccagagaggggaggtagttctgctccgcaaggtcatccagagacccaggcttcatccaccttgttgctctaccaccctctaagtttgtccttttcacatagttgaagctactcattgtcacatgcatgctgatagggagacagaaatttcttttaatgaagtgactcagaaattgcatgtgtcactttcactcacatttcactggataaaaagcaaaacaaacaaaaacttagactcatggtcacttctagctacaaggaaagtagagaagtctgtagctgtatggagactgaaatttggtagaagtggttctgtttctaaaagaaagagaggggatgggtgagggaggagagctggtagtctctgttacagatcccaagactctgttaagtcagtggctttctgattctgctgtgaggtcccttagggttcctcagatttctctcaggagctgcctgtaggggaatggagaggctgtgggctgagcactgagcattgggattccaaacctctcctcaaccagctcaccttgattttacctgtattatgcattgggttttcacataactttcccttaaagaaggttttcctgggctgaaatatttttgaaaatcacttctgtaagcactttctataatcctgtgtgttgcccatcactagcactttttcccttctcccttattgccactctccctttctggctatctctgggttgctgtttatagggaatgcgtttaatgtttctatgtgagtccccaggctcatttattcactcaagctctcactgcaggtgagtgaccccattttttacttctgggttctcatgaaaggcagtattatttttctgatcattttctcctccagctcttccttggagagtcctctgcctcctccagggcccaaggtttcctttcttgactaaatttactgctgtcacagggatttccagctccctactaaaggctgtttcaagctccagagaaagaccagccccatcctcttttaccacacaagactgagacccaagtcagccctggagaactgttttggggtttctattcacaagtttgtggagctatatcatcctttgcctcctctaattaccttgttggcataaacggttctattattttaataataccttgaaatttcttagggcttttcaatttccacagctttttcacatggatcatctcacttgattctgacaagtgtccagaagatgagcatctctagaatgcgaattttgaagatgaggaggcaggtgctttgcaaagatgaaggaacctggcccaaggccatatgaccactaagtggccaaattaggatttgaatttcgttcttccagccttacatttcatgttcagaaactcttgactatatgaattgtagagagcatgaaacaggttgttgaaagtttcatgatttttgcttcataggaggggcccaaagcaaatgttagttttcttccttccttattctacctgatactttggtaaggtgccctcacttgcatgattttatatattcttcacagtagtcctgggagtaggcagggtggctatggttatctgcattgcaaagatacagaggccacgatagaggaagtgactctaccactgtcacacagttagcagtaaaacccatcaaccagggcatagtgcagtcctgttccatgagctgagctgcatcgtggaagtaggatcttaatgcatttattttgaaagttgatattcaatcttcagaagtcaacaaaactcctggcagagatagaataagatttggagatttgataccatttaggaaaccagaatagatgccaaattatctggcatgagttgggcaaacttacttgatttcaactggaaagactggtgatggactggctggttggtgtgagcctcctgtgtgccttaggaaagggtggactctagctagatactctgaggtttcattcattcacttgtgcattgatgttatctagtcactcaaataagtggagtttagataagtagatccatgagagaagacaaacgatgagtgtcacccttagttgattctcagatattgcatagaactgactcagctttctaatacacctcactcacacataatgaacacccatctgtcactcagtgagtcatcaaggggccataagccatggaccctgcacttcagttgcttacccttgagtagaaggaaggagacatgtacacaaataactaatacaatgagaatgttattggggttataggagagatgcagatgcaaattgtcttgagaacacagaggatgggagtaattccagttgaagggcctgggaagctttcatggaggaggaaccacatgaaatagcttgactaattttgagagggtgactgaaagtcatccaagcctcaagaaggaacatgagcacaggctcagaaatggaaaaatgcaaggaatagttaggaaatctcaaattttcacatgttgtttgaaagtggttttggctagaagagtgtggaagacattttttttaaaaggtgggttggagtcaatttcatgaaattggaggtggggccaaagagtcaccctgaggagtcaggatttaccatgggaggtagtagggagaaatgtcagtttccaagtggtgtgtgatagaatttgacaaggcttgaggatggataccagttgtaactactcttcttgatggtgggatctagggacatccagagtagggaagggacctgatgcaagtaaaagccacagcacccattctcacatttcccctgccttcaattcctgtcatttcccagccttctcatgttcttcatgcttcagtttgtggttccaggtttcctctcttcatacctcacactctctacccttgcacaaactctcttcttcctgttcttgctttcccctctttacttattcttttctttctttttctctttttctctcttgcgtgtgtaagtcgtagtattttgtaaacccctatgtcagatatcctgcttctcttcttacagatcatcctggtctgcattatgaggcccatggaatggagcaagtgttgggagataagtttggaatatttgggggttaatatttttggccacttttttactttctgtaaagtaagccaagttatccttagcttccagatgagaaagcagaagcacagagaggccaagtgtccttcctaagaccacatggctagtaatttagaaagccaggaatctaaacaggatattcctgactaacctatactacgtctttccaccattctagctgtctcctctgagtgtccttcctttgtgcccagagggtaagtttaggcatagagaagtttgaagaccagttacaggtgacacaataggattatggatagtggcttcaaaaaaacagcagcataatgtctctgaatgtgacttatgatgctgtaagttctagaaccctcttcagttggggtgacatgagagtaatcatggtagtggcattgtaaatcaaaacaattgctttggaagccaacgttgcaagatgtacccaaagccacaacattgtttattacctttgactaagtaatattacaccttggaatttatcctagggacttgttcaaaactgaaaatatgctaaatgcataaaaacacattaaaagggaaataacgtaagttttgtttcataataacaataatgaccattttgaaggctttgtggaaaaatgagaatatattaataggttagttgtcaacaaaaaagtagtttaaaatggtatatgtacttgatcctaactctgtacaaaggtctacattttgtccaactacaaagaaatcataaagataggaacagttgtaagaggctagtgtgattatgggtgaccttttctttctcctacaaattatcttggatgttttgtggttttcataatgaaacacatggaagagaactaaggggtgtttgccgttttagggtttagtctgagctgttgagatctccctttccattttggatgatgacacattctggaaaactttctggaccttggggaatttttgggaagaaccagattctttagagtacatcctaatgtagcccaaatgttttcttcttgcattcagaatgcctctgggaaaatctaggatgtggattcccaggaagcattttcagacccttgtggactgttgcttttaagaaatggtctgctctttataatctcttcactaagctccttgctctctgtgtgtgtgtgcgcatgtgtgtgtgtgcgtgtgtgtgcatgcatgcgtgcgcatgcacatgcattttgtacaaaaacataccactttttattccattttcagctgagtgacaatatggtacattctgtttggggattccttggcccatggagaggtcttgaggaattcatgaacacccagatatgaagtggaaatttttatgtgaatacattatatatttctttggagagagtatctaccatttaatcatttcctttaagagttcttaaaacctctaaatttaagacaaacatgaactatcagggcaaggtaaaaaatagaggttactaaactggaggacattggaagaagaaaagagatgagtggctttctagaagtctaagaatcctacgtttagagcgtctcaggttgtgggggagggtggagcagcatccattctccaagtgctttcttcacctcttttctctttatttttttgaaacgtgaggctgatttttgtagttgaacttcttgaatatgagggtgacagctcaaaagctaaaatcattctgtggcttccaacacttgctgctctcccagcttgtaacagatggatttatagcgatgattccatagaatgtgatgcatgagggagttgtcctcacaccagaaaaaaaggcttcgtaatttactttcaaatctggttttgagtgagggctggaaggcctgcctctgccatgatatgaaatggattcccaggaaggggtatggctcagttgtctgacctttacagcatatttaaatgtatattatggtgttcacagtcgtaaataatatagctaaggttatgcacaggggagagctgagggaaacatttgcagtaaagctgtgggctgccctggcgggaagacaggcacttggctttgaactggaatttggaatctgggtggggggagtgagagcaaatattttccaaatggttgccagttgctttggcaccaacagaactaggacttctgaagcagaagaagcaggatacgttctgcttttgtgagttggtgaaggacatcagagtggatcttcatttatccatttaccaaggatttatttagcaagtactatattctggacactaggggctgaggatgtaaagacagggcttttgcttcaaatagtaaacaagaaaatagtggatagaaataaataaattagtataatgtgtaatacaggagaagcatgcatagagcacagagatagcatgaaaaggaatggctgactctaaatgggggcaacagggaacaatgaaaatatggaggtaaatgtatgatttgggttttgaaggataggcattcacctgtaatggatgatgggaaggacattcagatggagggaaaaacatgtgtgaaggcctggaatcaaaaaagagaatgaggcattgagtaaaggcaatttgcagttgtttccatgtaaatgagatggtggaaaccatcagtagataaggagactggagcccatcatgaagaagctctatcagccatcttatgaaggtaaattaactaacatctactgagtatttacatcagttattctactgaatactttgatgtgcacaatcctatgaagcagatactagaattatcccattttacagttaagggagtggaggctcagagaacagagaatgaagtaacctgtcaaaagtcacacagcagaaatggactgctggtaacttgaagacgtgctggtgatagaaatagaagtaaatggatttgagaaatatttcgacggcaaaatcaacccattgattgcgttggctatagtaaaatgagggagaaagcaaggaaagatttaagaatgatttttcattttttgtcatataaaatgggaaggatagttacgccattcacagaacagtagaggttttgggaggtagaacatgggttcagtttcaaatgtcttgagttttagatacctttaggatatacaaataggatttaaaagctgaaatagcctatttgtcattcatctcccaagacttagtgtcttaattagttgcctaagcgttctgtgagttggcaattttggctgggctcagctgatcagttgttctggtcttggttgggattcctcatacatttgtagtcatgcccatgccagctaactggccctgctcctgggggttggctggctgtcagctggggtgctagggaagccagacatgtgtctcatcctccagcaggctagcccaggcttgttcttgtggctaggcatggttctcaaagagcaagtagaaacatgcaatgtctctggagacctggactcagaactgtaacaccattgtttctgtcatattgttttgggcaaaacaagtaaaacgccaacctatatttaaagcctggggtgattgactcttgattgaagctcaagttacaacaggaaatgagtgtggttgcaggaatgtgtgacatcatggccactgctgcagttggccacacctgttctccaagcgggactgctttatagtttagagcacatcttgtaccaccttccagctcttactcatgatgtctccatcctcatttaatgagcattattttgtcgtctgttgtgtgggatagctactctactagttgcttggggatacagaaatgaataaaacgtactcccagcatatgaggttaaggatggtcatgtagcctgttagtggtgaaagtgaagttgctcatcgagccacagactgtacacagtgtcctttatttgatgttctcctgatgtaaccatgttgaagcctcagccccctgggataggggctgcttcctggagctttgcatgaaatgtgtcacccaccagtgggttggactatttctgaacatgcttccgacagaaagcatgttcttgtttaagcagagccatatgccacatcttgaatgttaaaatttagccaccactgagtcatctagagatgaaataaaggttatgagattttaaaagcagaaataaaggattttcacctctatttttataatagtttttttctgaatataaaagaaataggagtatctgttgtaagaaattagaaaatctgaaaacatatagtgagggaaacagaaatggcctgtcacgcactggagattatgttaacatacgtgtacatttattttgtaaaattagatgaacactttatataaagatttatatttaacattgtcatcatatagtgtgtatattttttaaacacttgttaatggtatatgtactgttttatggattgcattttacacttaacattatacaagtagacatttcaatattgtaaagtaaaatgtagaaatataatttcagtctcatcatattaagtagtacagtttaattatatgattatttggctgtttatgttgtttctgataatgtgctattataaataatgctttatgaccttcctgaaacctaaatcatgtgggcatctgattatttctgctgtacatagtcttagaagtggaaatactgggccagagggtataagtgtttttaaaagatttccgatagatattgggaatttactttgctgaaaggtggtatagcagttacatacttgtcatctgattttctttgccttgagaactatctgggtggctattgtggaaactttcctagcaaatatttgtttatttattgtttccttcattcacttattcatttattcagtaaacatttatagagcgatagtgcctagggagaaataaaaatgtctgagacagatggttacacaatatcatgcatttttcaaaactcatagagatgtataccacaaagagtgaattgtactgtatgtaaatttaaaaaacaaaattctaaaaatgattaagaaaagcccattgcttcaaggaacttaaaatccagggaaagagataagacatgcacgtaataattataacacaaaacaacatattaaaagtaccatataggaagggaaaatatttactggtacatttcgtgtgccaggaactggaccagatattttacacattcattcatttgttcatttcctggcaatacaaagatgaaaaacctgagtgcctgttctcaaagaggtcccagcttcatgggagtgggacctgcaaacaatcaaccaccaccaggataattactctaagttgcacatgcaagagaacagaacttgcctgagggagttgaggctggtttctgagaagagagggaacttgccaggagacatgaaggaacacagtgctttgcctcatttactcctcacagttgcctggtgaggcagagctttcacacttattttacacaggaggaaatggaagctatagagcttaagtgaagtgtcttgccgaaggtcacacagctgaaaagtggcagagccacaaattttgcctagatatgtgctttctgtcctagtcactagatccctagaaagggactggaatttaggataagcattgcaggatggggaggaagtagctctggagtaagccaagagcagcatctcatggggagaggttcatacgcagggagtcaggtcagagaccagaggctcatttagcggagcggtgcagggcagatgatggtggcagccagatagcagacagccttacattctcggctgaaggctatggacttttgcaggcagggaaatgattgatgttttgagaacaaaggaatggcctgccaagagatgtgcatcagaaaacatcaatctggtctcaatatatgttatttgggtgatggataccctgaaagccctgcttgactattatgcaatctatgcatctaatgaaattatacgtgtgccccatacatttatataaacaaaaataaaaggaattgacaacctagaaaaaacaaagaggaatgaataaatggaaatgccaaagagaaaaaaaataacttggtagtagcaccctgaaaggatccagatgaagggtagacagagatttccatctctcttggagaactctcctgttcagtggtagcgcacctagaatgtcagagtaaggacacagtgcatcttagtccagtgatcacttccccactagctaggccccatccttagttattcccaagattttgtttccttattccagcagttgcgtatctaaaatgtcagagtaaggacgcagtacaccttagcccagtgatcacttcctcactagttaggtccatccttagttatttccaagattttgtttcctttatgaatcctgtcaaaatagtagacaaactgagacctagcttttgttgtattatttcagttaaagcaaataaacaaaacctcttctactcaaatattatttcctttgccttttctacctctacttccagctggcgattccaaaaataaaaagctttgtttcctcaaataataacaatgcacaatgttggaatattccagtgagtcatacattggtagtcacacacagggatgggggcgactttaacctgaaaactccagcccctaatgggcctttcccattggaaccaggttttactcttaagggcctgggtggagcttgggccctaagtgtgggctataagcaggggctggatgagtagacagcaaggcagtgctgtggagtctagcttggaaaggtaaacatccagagccagtagagctcaaaagctctcaaagggtaaccagagcagtatttggaggaagtatgcaccagtttcatccccatgtccttcttgaaggggatgctgtgggtggatcatgggtatatggattttaagtctttaagaatcagaatgtagagcccacctatttcttttctgtggcactgcaatttgcccccagctctaacttcaaaacacagggccttggtctttagttccaaaatcatcttaggatagttttcttactccatggcctactgggccctggcctgcttcaccattttttcaacttcatctcagatttatccaccaccctccaggctccctgactttcctttggtctcttaaatgtgccaaagtattttcagcttcagggccttcactgctgctattccctgtgagcacagtgcctttccttttgctcttcctcaagtgaccagacagttcccacgacccgttcatcatctgctaagggtgtttgtgacttcacattgtgaaaggtatcctcactttattattctctaattcaggaaacttcattgcaattagagattatatatttatttttttgtttagtttacaagactcagtcacccctacgactagattttatgctccatgaatttagggctggcctgttttatgtactaatatactaatctacatactcagttcagtgatgggatcacagaaggggcttcagtaacatttgtggaaggattgaacctgggtcatttccttaccgtagccttagcaactcatttccagtgtgctgggtgcatgtataggacagaacagggtggctctctgctctacagcgttgggtctaatggcctgtcccacaccccttagcctctcttcatgggttggttggagctgatggcgccaaatgagaagatcccactgaagatgctccaggggctggcaagaatcactttaaagaaaaataatctatctcttccatgaaatgaaaatagtaaccaggacgataatgttttcatgggtttgagaaaaaaaaaatttcttccaccattgtcgtgatcattttggaaattctaaaatctgtttctctgggcaaagaaaaaatttatctcactgatgaagtatatttaagggagttttcttttctttctttttttttttttttttgccagggggtgtggtctttaagaatagtttaggaagacttatgtttttttccccctattccagagtcactttgcaacttaagtagaaattcgtatatgttctctcatctcttaatcatgcacaggctcttctagaatatctcttacctgaatagcttctaaggggctagtcactcacagcagtggaatgggcagtgtttggagtctcaagacacaaggggggagttaaatcagctttcctttttgtggaaaatggggttcagtgacctgccttctgtttcctctctctcttcctacctgcagtgagtagtattactagccttttctatattctttccctccgatcttcctgctcttctttcccactccaaaggcacatgccatgcaaaatatttgaactagaccctcctccaaagcccagcttttacactgactcaccctcagcaaccctgaactaagactccatgtttcaactgtctttgtcattcctgatcagcatgcctctgtgccttcatagacgttgtcccctttccctggaattttgctccattcctatctcccgccaatgcatgtctctatgtgtcagacccctattcatcctctagaactcaacttggacatcaatttctcctcctggaagcctgccctgattgtcaaattctgttcactgacagtacctcacgctttcccagacactctcattatattgtcataatatgtttacacatctaactgactaaatgtgaaatactctggaggttgggcaggactgggtcaaatttatcatttgcatcattaggacatagtagataccacttattaattaatggatgtggagagcattttatttgcttcaagacctatgccaaaataaaacacagcaagctaattatttgtacttcagctcccatttttaagtcttctcacattattatatattacaaatataattggtagttaggatccttcctttctgtttatctttattgtcaagtcctaactgagccccagtgtgtgaatgagagcctcaaagatgctctctgtggatagaagtggaggaagagggaagacacaatccctgttctcaagaagcttgcagtctgaaggaggagaaaagacaaacagcactgatggaaggaggacacctgtgcgtgattactgctgttctgtcagtgaaaccccagagatttacagtcagttatcaccactgtaaagaacaatgtgaaagtcagggccaggtgcggtggctgatgcctctaatcccagtacttcaggagaccgaggccagtggatcccttgagcccagaagtttcagaccagcctgggcaacatggtgaaaccctgtctctactgaaaatacaaaagtggtggcacacgcctgtagttccagctactaggaaggctgaggaggtgggatcacttgagcccaggagacgaaggtggcagtgagccgagatcacaccactgcactccaggctaggtgacagagccagaccctgtctcaaaaaaaaaaaaaaaaaaaaaaagtcacccactgggtatcttggagcataacattatcgggcacatttaaatataaataaagatttgacattgagatacaaattcaccacactcctaattattcaaaaatattattctatcttgattgtcacccatatacttttgtgcacatgggaaatgcacccatgtgcatttccacaatgacatactaaatagacacacttttttttaaggtaggcttcaggcaaaatcaatacataaaacaaaaacagtttttcatgatgcatttaactttataagatataatctcattaataccaagtgccagtttatcagtggacacatatgtattatttctatatagctgtaataagaatgagcatactttttgctgtaattaataacttctgtatattcatacgttttttccccataagaccatgtagttccagttttcaatttgtagtaatgatatagaatctatcatagaatatgctattaattgcttgaatatgtccctgctattggttatttaggttgcttaattgctttttctccctgtgagggatagcactgttataaatatttccatacaaatagctttttttctttttcgcttttgaattatttccatggaatataagagtatattacctaaagtggacttagcaggttaatgggcataaatagctttgtcattctgccagaatgctccctggcaggtctgggccagcatacagtattcgcaggaggatatgggaatatctgtttctttataatatccttaaatttcataactttgaaatgaattttcactaattcaaatggcattttggcatttcagaaatgagttaatttgcttttctttaatctgctgaaagcaagatgccaggccttttttcagcattggttcactctctacttttcttcatgtataaactacctgtccttgtatttcagagatcatcctgctttggtgggtcttagactaaccatttgttaatggttatcctttctgatataaggaaaaatagaatgtgccttatcactttgctaattatttttctttgtcctgcagcatattttcacattacacaaattacacctatcagaggtacacccaagtgcaggaagtttgtggttttagtgaattagtagctattcccatggagccagtcaggggctggcgtctgttcagcgcaccttccagactcatcagacttttaaaaaccactttgtggtgaggaaagagggagggcttggaggtcccagctctgctgctgtgtgactggggaggttccttagcctctttgagcctgagcttcctcagctgaatcattggaaacaaaacctagcttgcagaatcatttggaacataagttggtgctgcttagagtggtctctccttactttcacttccttctacttgttccatccttctctcctctctctttaagaccaacagggaatacagctgctagagtttggagggaggccaagccttcagcccgggcacccaagaattcaccatgcccagagcctgtatccaccttcgtggacccagcttcctggcttctggggcaccacagtgtctgttcccctcaagcccaaaggaagtttgttgtttccaacacccagacagcctcagtactttcaccaacttggaagcggtggatctacagtcatcttgaaggggcccacactacttatgagcacatttcatgagagacctggccaaggaggaagatagggcccatggatttcctttccaggaaattaagggaaactaccccttatttagtacctaataagggctgctgacacattatctcaattttcaattggcaatcataggagtcactgtttttttccttttctcctcccttccctgcctccctcctcccccctcttccacccttctccccttcctccccctcctcctcctccttccccctcctcctcccccttccccctcctcctcctcttcctcctcccccttctccttcttcctcctctccttcttcctcctctccttctccctcctctcgcttctccctccccctccccctcctcttccgcttccccctcctcctcttctttccccctcccccctcctctcccttctcccctcccccctccccctcctcctatccccttcccttcttcctcctctccctccttttctcccctccacctcctccttctctcccctcccccctccccctcttcccctttcttttcccttttttccctcttattttccctcccctcctcctcttccccttttttgttggcaggcaagtgagtaagggggtgggcagatgaagaaatcagtcaggggggatcagtgtttttgctcgtggtcccacaataggaagtacagagctaagatttgaactgaaatctgtctgaactcaaagtccacgtgctttctgccaagcatgctggccctgagattatccctttccacctcttagaagctttccctgagctttctaccacacattaccttccttcgcgtccatctttctttgagatttaccaatcatgtcaccaattgaacacttctcatttaatgccttgaatgattaaacatgtttggcctgcaggttgccctatctacgtaggtctgtatacacacacacctgtgcacacttggttagtcaggacactgctgtgtgttctgctccaggaaactttcctactggctcacctcccctcacttctttctgtaattcatgtgctgagctggtggcagttgtttgtaaatgtgacccaacctcttgacaaaagtgcatgtctccaggagtgtgtgtctgacccaagttaagccaattggaatcccttcctaggaattggaggttaggaacaagagagagcacaatttttcttctctttctttcttctcctttcttccttccttccttccttccttccttccttccttccttccttctttctctcttttttttttggagctggtcctctagcatgtgaatcttaagaggtggggagggcccaaggggtgccaggtagactcggggagaggtggatggagcctcccttcaaaagaagagatatgaagagggtcccgtaggctcccagtcctgcattagtcctttcctgagtcacagctgcagccctgtccttggctactacaggatcccctgcttttctgtgcctccctgtactctgagcttatgtcagttccacagggccccttgcttgtcttcagaaagattccaacccctgttgccctgggttctgccagctgaatgtgggattttctgattattatcaacctacctgaagagtaatcatgggttccagttgggaaatttgcagaggtgtgaacttgaaccatgcctgcttctaagctggtgtgtagggatgagtgcacttctcagtgggcctagctaagtacggcatgcatgaccgtgtgggactttttgttttttctgctatttttttacatggtagctttttgccttatgataaaaacaaaatgaagtgaaacaaaactaaattcagacttaataatatccatccaagctggagataaaatgagggaaaatggaaaaggttaaataactaggtcatgtttcttgatggaaatgtgattggagaaaaggccaggggggtgacatactttttttgtatttgaggttttgtggatttgcaggaatctcaatgtcacttgagaactctgagggggtgcacgtcagtgtgtacaagattcacctggatagcctataaaatgcagatttccaggccctgttcccagagtgtacataatgcatgaaagatagggaccagggtctgtgtttttaagtaagtttctcagatgagtctggctcaaggggtctgtgagtcacactttgacagattcttacctgttgtatattacattgatctgtatctgtttgtctgtctataggttcccatgtatcttcatctctttctctctctctcactctcccacccacacacatatccactctttcagtaagctcctcacatctcctcctctcatatgcccacaatacccgataaatcctttgcacatttcatgtgccaggtaaatgcttgctggttctattattcctcagctgttattctgggatgaacttttccttggagcggggccacacccaatactatccacttggacccttccatgtgctgggcagtgggaggcaggtgcgccctttccctttccccagatctacctcctactcacatgcaacctactcatttgagtcaaaattctaattttagaagaaaactagggcctgacatctaagccttgccaggtgcatggcctggaggaagagaagttgagggctggagagtagctcaacagctgagatgtggaactcaggttttaggagggtggagaggcaggagggaaatgcagaaggcagtgacgtggccttcacttccagagccaagattgctcatgcagctatgaaatcaaacctgccgtttattgtgttttccttaaccactgggtttagaatggaaagttggcttgaggttgagtctctgatcttatcttgaggatgttgggtttactttaaacttagtcttaaggagattctagtggaggttctcatatgcaccaagctgtcatggtaacttcaggggtgccaaaattgctgccttaattgacaccctctaatcagtaaggaggtggaatttgaaacattaggagggaacagattttttagggtaagaatatattaggtgctgccatttacgtgtcgtgggattttgcttggttacctaatctaagtctatttcatccttgaataaaatgggaacaatagtaatcataggattgttgcaagggttaaatgagaaaatagatgtaaatattgacttctggtactacttgcattattgtcattaactggaatttatcaactggctaacatttatcctataaatatttacttattaacagatgtttataaacatctactatgtatcaagtagggttttatttatttatgggtttaccaattcataacaaagatcaagaggcaagaaaaaacagtaggtcattcattctgaagatactttttgaacacctactgtggattaggtgtttgaagcacctactgtgaacaaaatgctctgcttttctgcagccctgtgttctgtttggtcatgcctaattactcttttaattgtaaaggattgagtttgtcaatattttatttagaatatttgcatcaaaattaaatgtgaactatttttgactccccctaaaataaagagactcaacacttgctcttaaatatctcacagtgtagtgagagaagataaaatattagtattacaatacaataagaagttgctgtaatgttaggatgcatcaacagtcatatatataaaagaaggagcaacagaatctgtcttgagaagtcatgataggccttggagaagtgattttgatctgaggcttaaatggtgggagaagtattttaagcacaacaggaacacaaatgggttgaaacagaagaaagattgattgactgattgaacagaaaggactagatgtttatggcttcatggcaggcttgatccaacagctcaaatgatgatgtcgtcaaagacttagattttcttagtatttgtactccggcttgtgcattcttggctgcatcttcgggttccacactgtgtaccttcagcaacttcaggcattctctatactctgttggttgaagcagtcacaacattttgaagggaggaacatagaccccacttctcaacagagggtgcatcagggtcacattgtaaggtaagcatgtggaatgggagataccagaaaatataatgggccacagatggagagatgagtgtggactgtggtcatgagggataactccctgctggggacagggcttgagctgatgcttaaagagtggatagctggaagctggcaggcagagaagggcaggaagagaacatgtgcacattcctggggacaccggtgagggtttgtgttcctttttgggtcttctagatgcctccttactgcccagagcaactaaataggctaaaaatggagtctgttgctaccatctatctgtagaagaccaaagcattcagcaatttcaaagcacatggctcctttttggtgtcttacatattcaacctcaggtttaaagtcccctgtgcccagtaagttgatcaggcttgataaaatgcaaagccatttctcctgacttctccctttgttttctcttctattctggggtacgaggagcctctgtaccatgggattggaagactcaccaatgtctttgagttggcacaataagtacccttgttagcacagaaatcacattaaatcagttatgtgcttacttgcctgtctgtcccccattatgctgagagtcttgggagggaagaaactgtgtctaacacattccagattctgaagcagagccaggtacatagtaggtgctgtgtacaaggttattggaataaaataaccttgaatgaaacttcaaggttgaatgacagcagtgttcaacacacctgggcactttcataccatctcagcctactgcaaggtccacatttgtttccaccccttattttttattccttctcttagtcctggagtctgaccagctcctctgtgattcttatttctctagatcaggaatctgatctgtcctcagtttctgtatctgtatctgacagtcaggtctcagaactgaggccttaattcccaagcacacgttgtctgtttcttatcatggagggagattgtttagaccagagtcaacacacaagaaggactgccgtgtccctttacccttttccttggcaagttttcctggcatgaactcttgctgtaactaagatatgtgaggaacttacttttacagagatattttgccaaagataaatttctcaggactgtggccatggattcttagcaaaaggaaggacaaggagatacgatcaaatgtgtgctggtgaatcaatacaaataaattatgtgttctttgttattatgtcctaggctacatgagagagggctcttaatcatccaccatcagccgctggaggttctgctcctttctcaggagttatgtggagacaaacccaggcatatgttattttaggcaacccagatcactttctggtgggaatattggtgaggctgctaaaggaatgctagcctctgcaaaagactggaggagagcaattcctctcagagtctggcatggccctcaatacgctctaagtttttctacctctaatgtccctgggatttatcagcactttcctgcttgaatgaatggtcattctgctgtgatatatgggaccaatctctggcgattttaatcaagtatgtgactaagagcttggacagattaaaatctacacctaccccaacttcccaccatataaatgaggtggctctttatctcttatatcttgggatgtggctgccatggccctgttatctgccattctgggctaggacctagaccaaggccaactcaggaagtacatgcattctgggcaaggtgagatccaggtaagcagtttgtaaaaggagctaaagaggtgacgagacatgggggtgaggctaggagatagtaatctaggaaaggagcctctccaaaggcactggacaggcagtaacaaacatgcctgcagggccaataggcagatgagtaacgacaaaatagggcacagggagaacctaggccatgagcaggtttccaagacagggaggatgcacaagtttggggaaataagttggaaaccaccgcaaccaacctggagcatgaaatgaggtttaggccatgggaacacttagatggtcctcccctatgtgttggattggagctggatctcaaacctagacttgtgattaaaatgaattatactaacttcttggatatctctgagacaccttttttttcctattctgttccatttgcagtttttagcgacaactttttcataagggattccctcccacctcccttctctcctttcccactgccattgcctcagttcagatttcctacctcttatgtttggaccattgcagtatccttctcactaggctttctgcttttcatcttcactgatccacccttcatactcctggccatttcatttccaaagtgcaggtcctaaaaggtcactgacttattcaagctcattagacatcttcatggtatttaatgagtcaagtcaaaactctttaacttggtgtagttggcagaatagtggcctcccaaagatacccatgtcctgatctctagaacctgtggatgtgttaggtcacatgacaaagggaaattaagacagtaggtggaaataaggtagcagtcagctgagtttaagataaagcgattgtcttgaattatttggctgggtacaatgtaatcatgagggtccttaaatggggaagagggaggaagaaaagtcagttttcagagtgatgccatatgagaaagacctgaccagccattgttggctttgaagactgaaggggaccatgagtcaaggaatgggggaaaagaaaactgtagaagctgggaaaagaaaaacaacagattttcccctagagcccccacaaggaatgtagaacacaaccctaccaataccttgattatagccagtaaaacccattttggacttctggcccccataactgtgaaatgatacatttgtgttattttaaattcgtggtaatctgttacaacagcaatagaaaatttacacacctggtatttaaaaccactgttatttggccccagtagatatctccatcttcttctctatgtatgtgaagctctagcctcagaagacaatgggtagagtgtctccaacctagtgtaagtcagaccagtttcaaattttttttgcaggaagttgtataagcatgtatctcccttcttgcactgaaagtgccttaggtcaggaactttgtgtctctcatccctacatccccttagtaccaagcatgatgtgttgcctgtaagagagactctgttgtaatttgtaggattgaataggaggtgggttgtgatgaatgcccaatcatgagttggtgatagggtattcacttcactgttatttacagcagtggtgctgaacgctgtcccgggtgctggaggtgctgagcgctgtcccaggtgctggagatataactgcaaataaaacagatgtgttgatactgaagcatcttacagtctagccaagctcctgcctttgccctcatccgaagcagctgaggctagtggctgcttccagtctggagagatgctgatccccaggaaattcactggagtcagcagctgaaattgtttggctgggagctcttttagctcctgagacccaagagggagcactgcccctgacagaagctccagaagaaagggaagtgtgtgtgcctgcaggcaggatcagcagagacagcccctgaaatgaaaagagacaagagggttggatcacacaccaggcaaaatgaacttggatggacctgtgatcttcccatcgcggaggctgtcagtgcgtgtccacacaaagcaagcattggcatgcagggagttccaggcttttatctctgtgtcagtgagaggcctgatgaggttgctctttattttgtgagcttcaagttgtcaccactaaagtgacatgccccttcttgaggacatggcatttcctcactcaaatggcaaatgacctggtttgctcagagacagggaaaaaggaaggaacctaatgcatgctgacggcttactgtgtgcctggcagtacaataccctttagctgatcctcacaacaactgaatgaagggcgtgatcttggctaactttagtatgaggacactgaggctcaatagggtaagcccctttcctaaggtcacacaaaataagtggcagaccctggattctacactaaaactttctggtttaatgctttcactttttctcaaagaaacagatcacttatattaatattttcatttgtgttaatgatcatctctggaggtttcacattagtggcattgcagccagtttcctcttccatcagctcacatccgtttctgcccttggctgccttctcagggtggttttgatggtggttggatggatggagtaatggacaggcagaaaggtatgagctcagactcctacctaatggtacacctttggagagaattaagccgtggtctggtgagatgttattatgggatatagaaattggcaaggaattgtgtggtcatttagccccacccctgttgctgcgctgcatgctacctaaatcatttccaagaatggccatctcattttcaaagtcccttagggaatgagagtgaatggatttttaattcatttttaatggctcgttacacaaaaccagaacaaccccccactattcaacagccatttttcacagtctccttgtttcaacagcattgcgttttcatttccttgatttgtcacttgccttattcagttaccaaattctgcaaagtactttcttaacaatggcccatttttaagtcaggataactactgcttgttaatttctatatatcttatctctcccttggatccccttggaatagagaaccctgtgtttgggtgctgactcctgcctcttcctacttgcatgagcgggacagtttccttatctaggcaatggggataatgctatctcccttttgtcatagttatgctcattatctgtgtaatacacatcaagcatcaagtacagtggttggcacttagtaggtcctcagtaaatgttagcatgctcaccttggcccttcctgtatttgttcctctcttgtataaactaccgtagtttaattaagttgtgattttgtctggaaatttagtgttttctttcatctacaccccattaggtacaggagtatacacacatatacctcagagatattgtgtgttacagtccaccacaataaggtgaatatcacaataaagcaagtcacacaagttttttggttgccccatgcacataaatgttatgattacattatactgtcatctattaagtgttaagtagcatcatgtctaaaaaaatgcatacttcaagtaaaaatattttattgctaaaaatactaatgattacccgagcctttagtgagaaatcatcttttttgctggtagagggtcttgcctcaatgtcaatggctgctgactgatcaggtttgtggttggtgaagattgggatggctgtggcaatttcagaaaatgagaccacaatgaagtttgctgcattggttgactcttctttcatgaaagatttctctgtagaatgtgatgctgtctgatagcattttacccacagtaaacttctttcagaattgaagtcaatcttctcaagccctgccactgctttatccactcagtttatggaatagtctaaatcttctgttgtcatttcaataatgtttgcagcattttcaccaggaatagattccatctcaagaaactgctttcttttctcatctgtttaagtttaatcatgagattgcagaaattcagacacatcttcaggatccacttgtaattctagttctcttgctatttcgaccatatctgcagttactttgtccactgaagtcttaaacccctcaaacttatctatgagagttgaaatcaatctattccagactcctattcatgttgatattttgatctcctcccatgaatcataaatgttcttcatgacatatggaatagtgaatcctttccaggcggttttcaatttactttgctgagattcatcagaggaatcactgtttatggcaacatagttttatgaaatgtatttttttaaaaaaataagtcttggaagtgaaattactccttgactcacgggtacatgatggatgttgtgatagcaggcataaaaacaacattaatatctttgtacatctccatcgtagatcttgggagaccaggtgcattgtcagtaagcagtaatattttgaaagaaatatttttattggagcagtaggtctcaacagtgggcttaaaattttcagtaaactgtgctgtaaaaagatgtgctgtcatccaagctttgttattccatttatagaacacaagcagaggagattgagcataattcttaagggccctaggatttttggaatggtaagtgagcactggctttagcctagatgagttatcctgtcttttgaagctttgaagccaggcattgagttctcctctctaactatgaaagtcccagatggcatcttcttccaacagaaggctgttggtttacattgaaaatcgattatatagtgtagccaccttcattaatgatgcaaggtagatcttctgaaaacttgctgcagcttctccatcagaacttgctgcttcactttgtacttgtatgttatggacatcccttcttttcttaaacttcatgaaccaacctctgctagcttcaaacttttcttctgaagcttacctctcttagacttcatggaactgaagagcgttagggccttgctctggattaggctttggcttaaatgagtgttgtggctggtttgatcttctgtcactaaacctttttccctatcagcaataaggctgtttttcttttcacgtgtatgttcactggaatagtgtttaaaatttccttcaaggacttttcctttgcattcagagtttggcaaactctggcacaagagacctagctttcagtctattttggcttttaatgggccttctttgctaagcttaaccatttttacttttaatttaaagtgtgagatgtgtgactcttccttttactcaaacacttagaggccattgtagggttgatatttggcctaaattcagtattgttgtgtctcagagaatgggggcatgtgggctgaggagaaggagagagatggggaacagccgatcagtggagcagtcaaaacttgcacatttgtcaattaagttcactgttttatatgggcatggttcatggtgcccaaaaaacaattacaaagtaacatcaaagatcactcatcacaggtcatcataacagatataataataacaaaaaagcttgaaatgttgtgagaatttccaaaatgtgacgcagggacacaaggtgggcacatgctgttggaaacatggttccaacaggcttgctcgacatggggttgccacaagccttccatttggaaaaattaaaaagaaaaccacagtatctgtgaagtgcaatcaagtgaaacacagtaaaacaaggtacctttgtcttctctagtggcccttagagaatgataactctttaaaacttaatatggtctgatttcgggagattgctttcattatcttcccaccctgctcctgtgtccctttctccttaccctgttgtggacattctcaaagttatttcaaagccaccttgagctctcccttctggagaggcttggcagactaacttatctaaggaaaagaaatccttgaaagacattgctcccagaaaggagagggctgagagtttaaactttttccatctcttatgatctcatcaaagcctctcatccactgtgaggatgtcctgaccacctcagctcagattcatcgtctcctcctttgaacacctctggtaatactttaaactcaagaagtgtgttatatctctgttgattaatagatgccatatcaaagaaacatttaataatactttcatagtacaatgatgagaaaatcagggttcctgtcctgaggaagcatgtaacctagagtcagagatgcatgtgcagatagaaaattatagtctggtgagtagcaaaattggaggtatgtacaacaagttaggggaacatagattaagggaaaatcagttctgtctttgagaacagctgagacatcagagtgttgatatttgagctgaatctggaagcatgagaaggaaggagagcatcaggtagagaacaggagaagggctttcagaggagggagaagagcataatggaaaggtacgggaaagttgaataggagaaggggtattctagtatggctaaaattcagtggtcatttgggaaagtggctctagaagaggtttaaactgccatttggggccaggttgagaaagaccttttatgccatgaggaatctggattgattctaaaggcagtgagaagccactagagaatttttgtaagaaattaagtaaatgagttagttcaaaggcctttgaggccatctagtagccaaatccaatggttgatttttgatctttcttgtaaataaactgtcagcagtatttcactttacagggatctggtcaccctcttccttgaaatgctttcctcactcggtttccagaacccatgttctccttgatatccttgtatctcccagcctgttctgtgtcagccagggcctctaactcgagatattttttgattttaattttattttaagttctgggttacatgtgcagaacatgaagacttgttacataggtatacatgtgccatggtggtttgctgcacctgtcaacccatcatctaggttttaagccccacatgtattaggtattcgtcctaatgttctcctttgcctagccccccaacccccgacaggccctggtgtgtgttgttcctctacttgtgtccatgtgttctcattgttcatctcccacttatgagtgagaacatgcagtgtttggttttctcttcctgtgttattttgctgaggatgatggcttccagcttcatccatgtccctgcaaaggacatgatctcattcttttttacggctgcatagtatttctaaaagaagagattgaatacaggaattgaatacaagagtgctggaaaggctggaagagcaagaaagaggaaaggcaaggctgctcaaagatcggtcactgcaggaaccatcacgtgactgcctaggaggagaggaagcagtactagaggtcaagggtctctcccacctaggttcctgctgtgtgtgctgaggtgcatcagaagaacccaggagcctgtgctgctggttactgagacccatccccattgcttccaccacctctgttgctgctgatgtgttgtcacatcagaagccagatatgtggagagggctgcttctccctcctccgccagtccccactcatgctttccattggctgaactaatcttgaagagagctcacaggagagttttagaaatgtaatttgcagagccctggttacctgccatacataggcaggattgtggggtgagagtaaacagcacagcctacttctttggctattgtgagtgttcttttccaccctcctgtttgtatttaaccttgtgattctgcctaatataatgcaataacttcttttttttcttttgaggcaaggtctttctctgtcacccaggctggagtgcagtggtgcgaatgcagctcactacagccttgacctcctgggctcaagtgttcctcctgcctcagcctcccgagtagttgggaccacagatgtgtgccaccatgcccagctaattttttttaattattattattttttttggtagaggcaaggtcttgccatgttgcccaggctggtcgtgaactcctaggctcaaatgacactctcacctcggcctcctaaagtgttgggattatagattataggcatgagccactgcaccaagccacgacaaattataccatgaggatactgtcactctctatcaagaaagagattcatgaagttccattagttgctaaaccttctctgggtaatgttaattgctttgtagacctattacaatcctgtgtggatatcttataacccaaagtagttgtgaagctaaccaacactaacgttctttgtataaaagaaaagaaacagagagagagtaggagaaaagagagtaacttatgggcaccatctatttatctgttttgccctgctgaacctgtggctggaattaccccaaaagtgatggaagggaagttcccacaagggagtgccccaaacggtaccaagatagggccagttgcgattccaaagaaagaagcactaaatgccagggtgatcagtgcaaagcatttattaggggaacttagtatagtgctgcagcaatcctcatgacagacagcaagagaaaaggggtgatctacctagatctgtccaagcaacgtggtcagggaaaggagtttatgagacggtttaaggcatttagctcagggccaggacctctttctttcagtgttttgggcaacaacctagatacctttaacagttcctgggaatgttcaaaagaccagtgtaggttcaagcctgctggggaaaacctgcaccttgctgggtcacagaacagtcaagcactctgatttttcactcagaacacagaaagcaagtaggtgatgggggaggggggtgtggaatagggaatcctgcattctcactcatctctgtgcacacacattctgagccttctctcatctctgtgtatgtgcacataaagcaggcaaggagaaatatgcgtaattgctattatattcatttctgttactagtcctgaggcatagttgataggccatgtctttttcagctacccattttgtatttcttttgcccttagcaaatacctcagagggttaaggatttctacctcatagtgtgatagaataattcaaaccgtcatttctgaagaatcttagtccttaatagttctgcctttaccactgtagtcttccgttaacttgtacttcaggacttgaagacaataggggcacttgaaattaataagaggcataataataataataggtttcagacatcattctctttgtcctcattataaaacatcatctctgtttctccttgacaataggaacaaatcatcccagctggtaagtaaccccttcattacctgtttgttcagtggtagcatgagaagctcaacacagatggatattcctttcagcttccagttcaatagaacaggtgtgaccgggcacagtggcacacacctgtaatcccagcactttgggaggccaaggtgggcggactgcctgtggttaagagtttgagaccagccttgccaacatggtgataccctgtctctactaaaaatacaaaaattacccaggcatggtgacacgtgctcgtaattccagctactcaggaggctgaggcaggagaatcgtttgaacccaggaggcagaggttgcagtgagccaagacagggccattgccctccagcctcggcaacgagagtgaaactccatctcaaataaataaataaataaataaataaataaatgaacgaacgaacaggtgttttgcctcttggtgacagttccctccttgggaagcaatacttctctgctaacagagccccaagttgtggggacatgatttaaatattctgtggtgtcctcctggatatgataaggagagacatcactcacacttttcattgttgatgttcagaccttggtatttggaccatattttggtgggacccacatcctagaggataagcaccacagcctcacatgggtgtcagctcccagatggtggtcattgagttttcacaagtccactcaagcattgtatcagtccaggtgctctgggtgatcatgtttatgataagaccagtgaattccacagacatgcccatgactgtatttcatttgctgtgaaatgagttcctttgttagaagtcatgttgtatgggacaccatgacggtgactagcgcaatctgaaattgaaatgtttgattctagcatgatcactacaggaaaggaaagcaattccagtgagaagaaattgccttctctgagatgagaggggtgctgtgcaatcaacctgccaccatgcacgatgttgagactcagcattggtttcttatgttggtagattgggaactcagcagtgattatttccacatcagccttggtgggggagattccatggtgagcctaggggaagcctcaatctctgccacaatggccattctatacaggagcccacagagcagacacaggggtaactggggaagaggctcattgatctcaacagaagacaccatcctgtccatctgatgcttgaaagtctctatagtaaacaccacgtggtgagcattcatacaggacacaaatatcccctgtgccaatttcgagaggtccaaacaaactggtttttctgcctcgtttcactgatctctaaatgctgacatgccccagctgtcaatccttatagctttagtcaatccacacttggtctcttagtgactagacctagactcatgtcttacaagtccatccaatcactgacagctcccaaattgatatttgtagcctaaactctcttctctgaaccccagactcatttatccagctcagtgtttgacttctccatttgaatgtctcttaggcatttcgaaattaatgtctaaagctcaacttttaatctttcctccaaaccttcttctctcacagtcctcgtctcataagacagcaatttcatgcttccagtcacttaggctcaaatgctgagggttgtccttgactattctcttttgttcacacctcgtatctaatttgtcagcaaatctccttggctctatctttaaaatatatttagatcctgcccctcttcacctgtctccccagtccactgctgttactctggtccagtctacactgcatttcccctggatgattacagtaggctcctcatccactctcgtcccctcactgcctttctaaacacagcaaccagagtgatcttgttaaaacctaagtcctccatgtaaatcctctggtggtttcccatctcactcggagtaagtaccaagattcttacagtgcttctcaaggcccagtgagatctcagcctcccaatatctccctcacctcccctccagcttcattaacttgttgttccttggttacgctgggcacattcctgcctttggatctttgcatctgctgctgcttctgcctgacatgtttattaccaagagcaccatgtgacttcttccttcacctcattcaggattttaagtgtcagtttctcatagaggcctcttctgaactccttatttacttttgcaaccttcattccccacctgccacccccccagcccaccctggaaccacccctgtgtgtttgcactttttaatgtatttctcttatttcttatttcctgcttattttttccccacagtactcactgccatttgactactgcatttgttacctattttttttttttcctctgctaggatattatcttagagggggcaaagaggctggtttgttttctttactgctgattcagcacttggcaaaaaggaagcatgctatacatattagtttggtgaatgaatggaaaaattataaggacctgaaattggtcaatgtagtacaccccaacacatttcaggagactcggtgtttgcttgctatgggcaagatgagaaaggaatcatgctgagccacagagttggtaatgctcccttaaaaaaaaaacagagaaaggggttaacagttttgtaaaatttcttgcatcagtcactgacaagttggtgtctcttgtactattaataattccttgtcttcccaactagattgtaaactcatgctgtgcaatgggcactgtttgtcttattctggacacccagttggtgtccagacattctcgtactgtgggtcagttgggttctggactctagatgtttaatttctactccctgcaggggaggctcctctaggtgggaggaagatgccaagactcacaagactatgctgagacttaaaatacactcctgcaggcagtccccgaagtgtatgttttagcaactttcttatgttaccattgtctaccactcctggtaaagaaagtcagtgagtcctattccacttggctgaaagcaaagaattatcaggtctaggcaggagtgaggtcataagagtgaggggacctagaggtggatgtgcagagagccccatggatttaaaggcaccaagattttaggaaggtttaatgaactaaagtaattttccttcagagtaaaattttacaggcattaaaggtcctcacttcactgaatgtgctcacaggccagagcgtcctagtgatttatgaatttgcagattacacatttcctttctgagaacaggaatcccctggggctttctgcctggcttccaaagctgagtggaggtgccaggtgagagaacactggctctgatttgcggcctcctgcattgcagttagggtctagaatggatgagcatttttttagaaggagctcagcaactctagaatctgaaacctttccaccaaatatgagtaactagaagctcttgtcttctgaagaataattgtcacacttataactcatgtttgcacagtacagcttataaagcaagctggcatcccttatttgatttgaatcagcaaccctgtgagcgtggcagggaaagtgtaccattaccccattttagtaaaacacagccaactccgcaaacatacctgagttgttcgggcacatgcaggagtgtgcgtcaaggctgggtcttgagttcagccctctggtttcaggtgctgcattctttccatgtggccttgcaagctccatccaggaggcagagggctggatccaattgggcaagtgaatttagaccaggagatatttaggatttttgggtggaatagggactgaaactttagagtgtgggcacttcctctcacatagaaaatgggatgtgtagagtcacaccaaatatcactctccccaaccctgtcagggacttggacttgttagttccaatacggataatcttggaaggcagcaggttaaggagggctacacatttaaagaccacagcaaccattaaaaaaatcactttactatcaaaattcttatactgtgcttggcattgggcaggaatagatgaatgaaagaagtgaggaataaaggcattagttgctggtgttgcgtgtgtctgaagctggcttgagcatttggggacagcagaagatactagctgcttggggacaagaaaattggaggtggatactctacaaagacagctccaactgattttataagaagtcagctatgtcccttattgtcaccttatttatggtgacataaattattataatcttctattgtcaccgccctcttcactcttgtagagcttttaatcaaatcattactgactacaccaagtgcaatcccactctccttcttgcacccttcccttgtcctttgtgccttgtttcccaccttggcacagccttgccgtgtctctgagtggatcctgcgtatatcatggtgcactcaacacagcccatactgctccatctccatgctgcttttctcataactagaatgctgcccctacctcctgctcttttctatctacccctgtccaatttaaaaagaaaaaaaagaaataaagcagacaagctccatttcagtgtatagaaattcctaccatgctctaagacccagctcatataacccctccttcatgaagactttgttaatcacattttctggacttaattgcttcctcttctcaaatcttatagcacattttccatacctctctcctacatttatcatctcatcccttcttttactgccatatatttataattcatccaaaggaccttgtatagtacctgccatgtgtcagccgttgtgcttggtggtgggaatacagagctaaatgagacctgatttctgacctcaaggaggtcacagtctaacagggaagacagacatacagagaaatcatattatcccagtatgacagaagctataagagatgtatgaacagtgttatttcaaataagatgtcagatgccaatttaaaatagttatatgtacctatatgtacttccataaatgtaattttccagctatacacacacacatatagagacagacttctctgctattctctctgtgtgtatgtctgtatatagcttgtaagaagagagaagtgctattactcatgaattattccaatttattttcatttctcctgctgtctaaaatccccccaggattatagccagttaggtcaaaaaggtacttatttgacaaagcttatttggtaaacctggctctcccaacaatttgcctagttcttttctcattacacatctctgtttcctatttttctctccaagaacaaagaaaacaaaagttatctttacccctgggccttgagctctagatctctctccctgatttgcagagtttagcaggtgtatttctagttcacataagaggtactcggtaaatatttgtggaattcatgaatgaatgataaactccttgagggcaagggtacgtttttctcttctctgcattcctattcattgccttgcacggaagcccacataaacacttactgagtagaggagcatcacgttagagcagaacaagcatggttgagtcagacaggcatgagcagaaatgctggttctgtctcttgctggttgtgtgctgtgggggcaatttgcttaacccttgggactctgtttctttatctgtaaaatgggcgatattatataatacctgctctgtttcaaaggttttttgtgaagattgagaattgcccagtgtagtacttagcacatagtaggagtgcaattaatgttagctcctgcttatgcttccttgagtttgagtcccattctcattctggggccatcagctggaggggattcaagtcaggttttgctgtagatccggaactaccccctccaccatcctgcctgccatatccaccgactgggtttccggagccacactctcatctctttctggtccgagtacttgcctaacagccccgagcttgttaggtgggtttattgcatctactttcaatgttcttccctggaaattcactcctccccagtggcgtttggaaggctgtgagtggtgggagaggtcggggtgggcaggctttctcttgctcttggttttgtttgcttggcatagaatgtcttaagcctgaaggttacattatcatctcttcatggctctattaatatccttctgggctgggctccaggggaaaaggagtttccatcctataattctcagtgttttgacttttcctctggggaatgctggtgtgaccacgctgaggtatcctcctcatacgtgtcccactccctgctttatttgtaaggttaaattcaatgtaaaggaagcagtgttttgctagattagaatctcaccgtggtggggtgggtagtgtcactgtagcatagaggtgggaaaggaaccatgatgtgatggagcctttctggaaatgtggtcctctggttgccacagaagattttcgaatcctactcagggtccatcgagtcagacttactgggggtgggccatggaatcagcatttaacaggctccccagtggctcttaggctccggctttattcatggaatgggaggagcactaccttgggggtacttggtcaaggtcagacattgccaaggcttaaccttgagtcatgttcccctttctggggctccattttttcatctataaaatgagagcaatagactggcttaatagcatctcctgctgaagtctgtgatttaccaacacaatatcaatatctttcatttactcaaaagcgattattgtataagaaccttcaatatgctgagcctgtgaaggagacagaagtactaaacacaatccctaccttaagttgtttagactttagttgagaaggccactcatgtaacgttcagaaactatcaatatagtgtttgtgataaattgcatgactcaattttaagcaaaataggacttcacaggagagaacatttttgatgtctgggataatcctgggaggccacctgaaaggggtgggcttttgactgttgctccaacatcaggcaggcaagtacaggggataatgaaaggatggggcacaggcagtgatacaatgatagagcatgaaagaaagcagagatgtgaggatgtgtttgtcttacctgaggtaccttgaaaaacttagattgtttaaaacagaggacaggtttttgcaagctagaaaaaatggttggaagagtatgcatgggccagattgtggagtctaagtgtgccagtctaaggagtatgaatttcatccattggcggaggaagccagtaaaggtttctgatcaaggaagtgcatgaattaagaggtaaaattgaaaccatctaccatgaaggcagaagtaatattcacagaagtgtggaaggatatgtgagtctggattctccaagaagcagacgtaaagatgaaatgagatctctgagaaacttatcaggaaaaatgcccgtgagagaaagtgggaaaggagccagagcagattgggacaactgctgggctaagatggacatctgaccccccggtgaaggagatgggtaaggaaggaagacaggcaggtaggctggctgggagcatctcagactgtagtgaggttctgtggaaagttcagcaaggctgttaggagatcttagcatcaatgtcacccatcaaggagtcctgtcacccaggaatgtgtctgcctagtattcctgttgcttgtaaccattggccaggagcagcttttgtggggtgtgggcttggcaagaggtagcaatggatttcagagcacaacagctggagtgcttagtcaattatgcttcctgcaggtggagatctgagaggcatgttctcatggcagctactgagaggaaggagaaactaaggagagtctaataatattctcttgagtggtttatctgcagaacgcctgcgtctttgctcatgatgcttcctccatgtagaaacacttcagcattccctttagctagttagtttctactctttctaggtattagtttgggtttcacccttaggaatccttccctgacctctatctagtttctgtttttggtgcttcaacattccccggttttccctgcattccccaccacagcacctatcagtctatataggaattgcctgctcatttcttaggtttctcccctactagactagactgtgagctactagaaggaagaatctggatcttttatttctgtatcccccatgtatagcccagtggccagaatatcatagtcatttaatagaggaagaaaggaaatgatggaaggagggagggaaaaagcggagtggtccaagctttgagtaaggagaagggttttccagatctagtggttagaagctctgctaattaagtgaaactcttaccctcagcatctctttcttcattctatgtagattttgcactttttagaggcatgtgccctgaaggcttgatgttggggaaaaatgattttggaggcatgtcctctgaaggcttgatgttggggaaaaaatgaaatggtctgacttgctcctgcagagcctgaggtggtcattctgactcattcctagtagatcagttttgagcttttttactttttccagaatttggcatggcctgcacatagcctcccatgcttttacacggtgactttaagaaggacttggtacatgaaataaggtcaaatgaagaacagaagaactttgaggtgtgtgtgtgtgtatgtgtgtgtgtataccatatatactgattcaacaaacagaaattatctggcaacttgctagacacttggtgaggctatggataagtttatttctctgttagtctctggctttaataaatgaggaaactagttatgaatgggaggggcaaagacctctaagtgactgtagagaacaattctttgcatgggttcctcactccttgctgttgtgctgtggtaataagacaggtagcttggtagagtctactgttctacaaatagccatgccactggtgtgtgctattaatacatactctttgatttgtgctgtggtaggtagtaggacaggtagcttggtaaattctactattctacaaatggccatgccattgatgatgtttcttgccaacctgccattcctcatcgcagagaaattgaatattcccgtcacctttggcacataatggatcatatcccttgcctttaatttttttcttggtttatatagaagaaatggaaatggggctgattgaccccatagagtgctggatgagaataaatctcaaagtgagcattttgttgttagttaagtgccataaaaatgtgcaatataatggctgattatttttctttaatcttaaatggatacctagaatgggaaagtcccatctcggtagcagaaattcattatctcggaaagaatttaatggttgctgtgaaaatgaactggaggaagttaaattgtggaatgggaaggagctgaaaaaagtgaaatgagttgtgcattaaatttagataaacacaattatgtgtaactggattatcacgcgtgcaggcaggcaatgtgtattatgcacctgcgttttgattaaaatcgattcaggtgcacgcacttagcatccttttaaatgtggagctgtgcctaagccactgcccggatgcatgagaggcaggtagggcaacatctgacagccaagtccccagctagagaaagcgcatgggaacagactggtcagcccaagattggttaagaaaaccaccaactggattactggtagcctcagctctctgatacgtccagcttccttttgggttacttaacatcaactgatgtcaagaaagtggtcatggagtccagtggggttcaatgatctgcttactccatagtagtgggggcaggtgatacatggtcgaaggcagatggtatcaggggatgttggggaagtaggcctgtctgcattcaggtatttatgcctgccaaggccctgttgatggaaacacaaaatctctttgaaccccttttacagacagaatcaggaccacttcccttttacccttttagttccaattctgtaaatcagagtcatctctggatcaaaagcaagcctatcatctgatctctgggtggccttggtggtgaacaaagccagctggcctgcatctgacctcgaaggaggacagatgtggagaaacagctgtcaatagccaattaattcctgttggcatgttttatttcaaatgcaagcactgtcaggattaaaataaatgctaccagttacagggatgcattaaattaataactttttcccccttgcttaatcctataataccccgcaactcaatggataaatactaagccctcctctgggtgataggagatgcattatatattgttacacaaactaaagtaagcttccttttttccctccctttgttcctctcctttgcccttatccccaaccccttgcaggtcatacttatcctgacgaagctgtatgacttcaacctgggcagcgtgactgagagttcactatggaggtaagcagattagagattcttaaggagccaccctggcttggctcacatgagaaacgcaagctaagcagttgggaagtgtggactggaaggagcagaagatagtcctcttcctggaagctcatgttaatgctctgggtggaactgatggcccccacctgtgaattcctttcctgctctgcttatctcttttgggacctgttgcaaatacaccttggccctctcattgcttctgtgcttttggagtgtctcattctacttgaagaaggtggggcctggctagagagatcagataaacatgcacgagtagaggttcttgattaggaagcctgctgtaggagagattcttgtcctggatgtgtgtcttggccaaaggactgcctccagccctttgcatctgctagatgctgtggttcttgagaaggcagtatcatggggacagatacacatgggaagagatacagatacaagtctgcatgatgatgttctgatccccaggcaattttgccttcaggggccccttgccccataaaataatattaaaaggtctgttttaccactgcgttggtataaagacaactacattaatatcatatattaaaacacttgtttcagcccagtttattcttttgattttaaaataaaacacttttggggcctctaagactattgtgagcctagctgctgtacctcttgtgcctagtggataagtttgccctgttaacaatgattgtgcacacaggacgagggagaagagggatgtgggtgagtgaagttagagagaaccttaataaagccatgaaaccaggagtttctcaggacagggaatgcccgtgtgttacacacacttacgcctatacctcctcacgtacatatgcacatccatacgaccacattgacgtgcagtcacactggtcgacagcgggtcttatcagtcactgggacttggtgcttcaccctctctgctaggtccatgagacttgaggtgttgtgtgttttctcccatttaccttgtgatgtgtcaatactgggcaggaagctgtcacaaaaagccatgcatctggctgcatcatcatccctactaagtcctgacctgagggtttcctggggttttggagcagaggggactggggtgtgaaatgcttcttcatctgacctgtttgtttgcagagaactaggcagcttctctccaggaaagagggagcagtcgcagtatctattaaatatttaggggttaattgctcatgtcgactgaggcctgcctccattttcacaggatgtctaaaacctaattttgctgctcagtgaaaattggcagaggtataagtaactagcatgcctcgaacaaatgaaagcatgactatttccactcacacggtactttccaggaaattagaacctcagaaacctcccttcaagcccaagcacaatgatgctgtgtgatactttaagcctcattcctgtggtgtctgcttggtcaaatcatgaaacaagccagaaaattctatctttatattgaagaacagctattcctgctactccatgttgcagaaaaggtttggctatttctaggagcaggctaggcaagtataggaacctaggccagttgcttaatgctagaggccttcaagttatgaagggtgtttctcacaatttcaagagtcagtgtattcatcagtatgtaccaagagacactatatagtttggtgtctgtaagggtaccctggtgttcaattgccaggattgaagtcccagtttgtccaccaccaagctgtgttattttgggcattttacttaatctctgtctattagttccccagggctgccataacaattactacaaactgagtggcttaaagcaacagaaatgtcttctctcacagttctggagcccagaagtctgaaatcaaggtgtcgtcagggctgtgttccttctgaaggatctagggttctcctggataaaccaggatgacctcatcttgagatccttaacttaatgacatctgcaaagaatcttttatcaaataaggttccattatagattctgggagttaggatggggacatatcttttaagggagtttatcattcagtccacttcactaagtctgtttctctgcatataaattggggttagcacagaacatgtctttgctctagcctcattttacttgctattcctccaacgtaccaaccacacttttcctgagagcctttacactcagattttccctctgcctagtgctcccaggtgacagggcagacaccttacttccttcctctctctggtcataggtcacctaatcatgaggtccttccccaggattccaaattccatcacttggctacatttttttttcttggtccttatcaccagctggcatatgctaaatgtttacttgctggtttgtttattgtcttcccacacccactcacatctaagcttgtagagagagggaatttttttcactttaattcagtgctgtattctcagcatctagaagattatttggcacacaagaggtgcttaataaatgtttacttagtgaataaattaatgaatgggctgttttaaggattaagtgaaacaaatataaaaacatttagtccagtaactcacatgtaggaagtgcttacttaactgtaattgttaatgattgtcatagccctgtgtttggatagcattttcattccattgttgactttgtttttaaggattccttgctgcagaggtgcatgtgagggaatttataagacaccaagcgggtgtagtctgtattctctaggaattagcagagatctttgaggttgaaggttgggggttagggaggggagaagagtgatttagaatgttgtcccttgtgctagttgggaggaattgaaataccaatttctgtctagtcaaagatattctttatagaaaagattctccaagctgggtggtggcatgaagggagggatgcagtttggcaagtggagaaatgtccctaccacagggcaaagtccaggtgaggctggtctgcggaagagaatggagccagacgggaggcacagggagcagctgagtgctggaccaggtccggagggtgtggagattgaccaggttcacagaaggggcccaagcaaagggagttactcagagcgaatttacagatcacagattccatatggtgtgaccttatggggatttggaaagctggtgaatattatgggttttccgtgttgaccaatatcatatatgagtatatttttgtgttaggtttcaggaggttcatggacctgataaagccccagcttaggagccactggatagagtgtgactgaggaaagggactgctcctaaactttctgggggtttcccggtttgctgggacctcatcgggagtcttctaactttttactgtctttctcacgtatcttctaaagatctgtatctcccgttctcttttcctgtactgataatgatgtattttatagttagagcctagagccgtatgatttcccttcctaatacagtgtgcagaccaaagaaactaaattaaacatgcaccctttcagcttcatgattcggcctaacatgcttaaccaagttgaaattgaattcagtgatcttcttcagtgttctgtaccatcaagaagcctggaacagcagctgtcatgacaagatgacaccccctgtcaggttgcaatgtgatataattatctgccttactggattaataattcagaggccatctacttctaaatagacaaaagattgtttaaaagcattaatttgtgtagcagtatcttgtgcccttgtgacattctttccagaataccttggtgctcttctactggtggtggccaaggttatttcttcaccaccaccagagtagttatgtaaatttgtcgtttagcacaaccatctgttggtatcccttagtcaaaaaacactttacctataagatatcatgtgtagagagttcatgaggttggggactgacttgtttaaaggaaccagggctttccctgagttacctgggtcataaggctgagattaggagcactccctggctcttcatctgagcctccttccacagtgtcatatatccatcttcaaaaatggaaagtctgcagctagacagacataaccctcctatttatgtctcttccattcctaacaaatgtaggccattgtcatgtggtagggtggtgctatggactcaaagggaggaccacatctttctcatttccatgagaactgcatatggtgcatgctttggtgccatatttatgccctctgcactcgtggatgcgcgtgtgtctctgcctcagttggtggcattcatggtcctcaattagggaggaaggatgtcacttttctctggaagtggaaactctgatagtgccaattaatccactgctcgaggttattaaatctttacttttgaacatatgtcctggtgaggatttatgtttctgattggcagatcgtttcttggactcatttctgtatgtcttggacatgagcccttggactgataaacaaaaactttaaagaagtttaagttacccccttctggagggaaatgagttagcaagcaattctccagcttctgcctgtccatcctaagcatgactgttcatcaagggtccctgactgatcagcttcagaacaaaatatacatggtaaaggaacttcaggtgtgaggtcaccacaggtatgcagtccccacaggtgcaaggtgtccacaggtgtgaggtctctgcaggagctctcctctggctgctggtctagggtcttcacagagctaaatgaatttgcagttgtctaggcatgagaggaaacaggaatcatttgcaaagaatgatcccttcaattggtagaccttggttcttcacctctctcctctcttgctttattgcacccacccttagccttgctttattgcacccaccctagtagtatgggagccattctactattagaaaagcaaccagactgcacagccattcttcctgtatgcctggcttcaggatgcaccataattgattatgatatatatggagagtacggattcccaggcacttcctgctggagacctttcatgaccctcctttctgggtgggaggctcctcttctgcttatgggtagctttatatccttacaccatactggtgattcgttcctagcctgtgaacttctcaagggcagggaccgtgtgccttagttgtttctggatcattgacaatgcttagcatttcaactatactaaataaggatttggagacctgacgaaagttttcaatagccccaaaccaatcccagcaccagccccgccttgccgtgtccctttccatgtattgagttgtctcatactcctgccacttggggattctgtgacttttcatctggttcacaagctgttgtctggaccacttatttcctccttaattgttctgtcagtgacctttctcggggatgctgcttttttaaaatagaaaatggagaccttttgaatttatgaattttttgtttgccaagaaaaccctgataataattgctaagacttcccagaagttattagtttacaaattttaatgacactcatgatttatttatgcacttccctccctctacagctgctcaccccaattccttggtggaattcctgctgaatctgagtgaattagtggaaacaaaactgcagattggaatgacattttttgctaggctgttaattaaaagccttccaccccattcgctaggctctttatatgtgaggtcccgaaggctgggctgatataagctgtgaaatcctccgtctaaaactgggacggtctcctatttgtttgctgtggtaatcaatctggtggaaactcctgaatgggtcacagaactttcaactgaacctatattaatcgagcacccattatgtaagcagccctgcgctcattgctgggagatacaaagtatgttatgcttgctatcctcaaggaatgtttcatttggttggaagataagatgaatgtacatgggaaacaacagcaggcatatgcaagaatatatacatatccacagaatacagtgcattttgcaatgactggctgtgctctagaaatacttgtatgtttattattaccaccccacttcattccataaaaaatacaaaacaattctaggaatgaatcggagaagagagcaatatggcaaatatattttgttttgctatttaatatattatatcctatttttccattgggatgtgtgagcttcttaaaaagaaaaacagccaggcctggtggctcatgcctgaaatcccagcactttgggaggctcaggcgggtggattacctgaggtcaggggttcacgaccagcctggccaacatggtgaaaccgtgtctctactaaaaaatacaaaaattagctaggcgtggtggtgggtgcctgtaatcccagctactcgggaggctgaggcaggagaatcacttgaacgcgggaagcggaggttgtagtgagctgagttgatgccactgcactccagcctaggcaacagagcgagactccatctcaaaaaaaaaaaaaaaaaaaaaaaaaaggaaagactatttcaggtattggtagttcccatggttcctagaaacacctggtgacagtgggtggcatatatagtgtttaaagggggtaggtcttggattcaaacagcctggatgtgaacccgagctctattgcttactagctataacaccttgagcaatgttttcatctctttgagcctcagtttacttttccataaaaatagaatgataataaagtctatctcatataggttttgtggaaattcagtgaaataatgcatggaatgcaaaagttgtcaatgtaatcagtatttaatataataattctggtttgttcataccctgttagctcagcagcctcagccaggctccagatgacaactgtgctaatacctttaggaggatggggtacagaacaaatctagactcctaggcacatcatgcctggaaattgtgcatttctacttgagagagaatattcctgtcttcccctttatgttctcatctgtgtttggcaaaaggtgaaagttaacgtatttcttggttttcatacaccagatgctgctgctgctgctgatttggggcacaggatgcaaacaaagtacaatctgattttcaatttcttcaacacagtgttaactcggtctttattggtttccttttcatataacttttggagggcctaagcccattgaagagctttgctatctcccaaataattaacatggaaggcagggtggggccatgcatgtttctcaaacttgttgcatcctcagaattacttgtggaatgtgttaaacatctaaatttatgggccctacccaagagatttcaatttagtaaggctggtcattactcaggaatttattatttcaaaagcttcagccaggtgcggtgactcgcacctataatcctagcattttgggaggctgaggcaagcagatggcttgagctcatgagttcgagaccagccagggaaacatggtaaaatcccgtttctacaaaaaatgttaaaaaattagccaggcatggcggcatgtgcctgtaggcccagctactgggggactgaggcgggaggatctcttgaacctcaggaggtcgaggctacagtgagctgagatcagctactgcactccaacctgggtgacaaagtgagaccctgtctcaaaaagaaaataaaagctccttggttgattctgatcctaggtaggattgggaaccactgaactcacccgaggaagcttgggttctaggcccacctctgttactaattaatcagattactcatgccgtccttctgtttcttcacaaataaaggtattagacgaaatgatcttttgaaactctttcaactctgagtccacagtctctgccatactgggaagtcaaacaggaagcacacacaggatttatgatacccaaaagatacctttcctgagctaacagcactgcttctgagcacaaccaccttctttcataaaatctgctggtgaagttgcaatccaagtgtcaataaaataacttactctgctaacttgctgttcactgatggatattatccagttggcagacattagccagaacacctgtctaaactacttagtttgaattcattaaacatagggagcatcatgcaatctatgaaagtctttgttctgagaaaaaaaaatagaatgagaaatgagtttgctctaaatattgggccctcagacatcttactttgctagagaattgagaaatgagaacactggagaagtagatctggattacagatttaatattttcctatttattatgggaaagagggcttctttttatgcctcttttttcttccactaggcaggactgcagcgtgcataaatcttgatttttggccagtggctgagagaatgtaacacttttctatggattgtgtctgtggattgttattttatgttgtattccctttcctccaaatgcaacaccattttatcacaatcttaaataaccctgccatttggataaaaggtgtgaaattctgcccatccctgtccacagcctgagctctctctcattttctcagcagtcaattcattagccttctaatgcagttgataagtgaataggatcagacagtctcttctaaaataacatttataggtggatgcatttccttgctctctaaggtaggccttaatttatttccctgccagatgtccatgtgtgtaaaactgtgataggtgggcccttggaatgtggtttgaagccaaaagaaaaagaaaaaaattcaactcacacagagcctatctattttcaagtttataggagagtgatttgatataccccattcctgcttatatatataatgactataaagattaggtagtcaaactttcatagttactttctcatcgtttggtggccaattactttattggacatagtctataaatgtcattaggaggtttctggcaaattcccttgtaagaccactgccctagacattatttgggtgaaaatatgtaaactggtaaaagacgtctcctccctgttacacgtctgtgagatttctttataagaatcactgaacttaggaagttttttatatcttaatgttgcttccaaatgttttgtgcccaagttaaagctaaagctgagctgtcttccaatacataaggtttatcttgtaaaagattccccccttcactgctattattctcttaaacttgtatactatttttagtcattgtccacatgaatacgggacagttctaatatttctgggaggaatgtaaggcctgtgtaattgaacattccattttgcagacagatctgtggtccctagtgggtttgtggtcagtgatttcagatctgggaccccaatctggatcttccagttctcagcagcccctttttcttgctgtcatgttggtaagcatgctttcctggccttacagatttggcaaccattcatgtttcatgtgagatctatggccgagggactattttgggactagtagtttccttggatatttgcctaagtgattttcaattcacgtggattatgagaatcacctgggaaatttaagaaaagtcagtttcctgggccttattctaatcccactgaatcaacttctggggtcaggatctatgaacttatagttttaaagaactcccctcttgattctgatgtgccactgatccaaggcactttatggccatctttgcttctaaaatgtcatttgcttctaaagttgttttggataactctcccacagcataccacctttccctctacccatctttcttccttctggctcagagtgatgagcgtaatcattcatgcagaaatccatagttgctccctcctctttataatgacgaccataaaggttaataattggaatgtgctctggcacttactaatgagcttacattctgtcagcatcagggctgtttaattgggcaattaacactgatcttagagagtggttccacaagagagtggtcatgaggtgctgctcccctggagctgtgcttgagataagccttatgagggtcagttggccgtcaggaatctaggttctggtggggatcagaggacacaaaaactggggaataggccgggcgcggtggctcatgcctgtaatcccagcactttgggaggccaaggcgggcggatcacaaagtcaggagttccagaccagcctgaccaacatggtgaaacctcatctctactaaaaatacaaaaagttaggcagccatggtggcgggcacctgtagtcccagctactcaggaagctgacgcaggagagttgcttgaacctaggaggtggaggttgcagtgagccaagattgcaccactgcactccagcctggatgacagaatgagactgcgtctcaaaaagcaaaacaaaacagaacaaaagctggggaacagattccaggtgccttttgaaggctttctattcataaaggtttttggttgcaagtaacagaaaccattgctaacttaagcaagatataggatttgttggaaggatactggaattgcccaacatttggaagaagagatgagcaaaaaaaccccagtagtgacaaaattctaggaatctccagcaaccatagcagctggatgtcatggatttacactccagtgagctgctatgagatgacagctgcctcctttgaggtttaaattcctggaagagaaaatggaagagaccacttgggtcaaggagtcgaaactttaactgtatttagtaggtaagagtttcctggcccagctggccctgttgttcgtatctatgcatagagagactgggatgatcagcagcagggcggcacatggttctgggaataccagacatcacagataccacatgcttcctgatggattctagtgtacagataaatatgtacaattttaaagaacatccctccaattataatatttatttaagaggccatcagttattatgtgtcagagaatgttccaggagctttaaccataaaaataccacttataaaaaccttgcaagggttttaccccatattggtggatgatgaacccgagattcgtgctgtcagtgggcaaaagagatgaagtttgacctcagatctgtaaaatgccaaaatccattcttgtctcacttgccccttgctgtctccccgaatagcttttaactcccagtttagttcgtgaacattgtctcagccctggacactcatttccacatctgttctcctgaaccttagacaatgtacaaagttttaacagtagggtcttcataaatgaaggtgatatgattggtcacataatatctctgcaatttttatttcttgtaatgcctccctcccaacccatccccacactaagagatgcaagtagaatgctcttagtcattcacaaattctccattcttcataggagaggtggtgggtgattatagaaaattgtctgggatgagtgtgccatttgtgttcacacatttttaatgcaaattttattgatataactgaatattcacaggcagttctaagaaataatacagagagatattgtgtatactttactcagtccccctcgatattttgcaaagctacaatataatatctctaggatattgacattgatataatccaccaacattatacagatactctaaggtttagttgtacccatttttttgtgtgagtttgtgtgggggtgtggggaaggtaggtttgtctatctgccctcatagttatgatgctgaactgttccatcactacaggaatctctcatcttgccattttataatcacacctacctccctcacccaaaacccctaatcgctaaaccctggcaaccactaatctgttctccatttctaaaattctattatttcaaaaatgttatagggtcatacagtatataaccttttgatgcttttctcacttttcttcatttagcataatcccctggagattcatgcacttttttgtgtatcaatacttcccttttattgacaagtagtagtctagggtatgaatgtacgtcaatttgtttaaccatttacctgttgaagggcatttgggttgtttctagtttttggctatggaaaataatgctgttctgaacatttgaatacaggttttcgtgcaaacatgttttcatttttctgggataaatacatatgagtgcagtttatcctaccctccttgaattgcttttgcccctttgtcaaaaatcagttgtacatatttatatgggactgttttttgctgtccattctgttgcattgggatgtgtccattcctctgccagtaccatcctcttcatattatagtgatatggtaagccttaatgtcaggcagaatgattactctcactttattcttctttgttttagctgttctagggcctgtgcttttctgtatatattttggaagaagcttgtctctgtttgccaaaatcaaaaccctggtggggttttgataggagttttgttaaacctataagtgaatttgtggactactgacatctttagtatattgagcctttgaatccatgaacatggtggtacatcttttaggtctatgatttctttcatcagcattttatagttttcaccatataaaatctgtgtgtattttgttaagtgtacacttatttaagtatttcactttctttggagtgattgtaaaatatattgtttgtttaatttcagttttcacatatttattgcaactgaccagaaaatgaaatgggattgtcttttgtgtgttgacattatttccccaagaccttgctcaacttatttggtatttgcttttgagtgtgtgtgtgtgtatgtgtgtgtgtgtgtgtgttttgagacagggtcttactctatcacccaagctggagtgcagtggtgtgaacatggctcaccacagccttgaactcctaggctcaagtggtcctccttcctcagcctcctgagtagctaggaccacaggcatgtgccaccatacctggctgatttctaatttttttgtagagatggagccttgccatgttgtccaggctggtcttgtactcctaggctcaagtgatcctcctgccttggcctcttaagaagtgctgggattacaggcatgagccaccatgcccagccatgcttttgaatgtttattgtgaactcagcacggtgctaggcgttttctgaatgcatcaggaaacagagtgaagttctctaatgaggtatgtaagcctatttggctctactcagaccctgtattagtataattcatttaatgagacctactgtgtacaatatctttcctaggcactgtgggccatatgagaatgtagaaaagattttcccttccaggtgcccctaattggttggtctctctctctctctctacatatatatatatcatcaattagaggcatatatatataaattagaggtatatatttatatatatagagagaaagataaaggaagagagaaagctatagaaagggagagagagagaccactgttatatgatattatgatattatgttatgattatatgctattctgtaataactaatttatatatatgcctctaattgattatatttatatttatatataaatatatacatagaaatgtatgtatatataaatatatacatagaaatgtatgtatttgtgtattcacatgtatatataaatatatacatataaatgtatttatatgtatatttataaatataaacaattagaggcatatatataaattatttcttgcagaatgtcatataacagtggtctctccctttctattgctttctcttttcctttatctctatctctctctatagatctctaattagatatatataatatacatataatatataaaaatatattagtatatataaatatatattaattatataaatatataatatatatcaatatataaataatatatatttatatataaataaattagagatatatatagagagaaagatgagggaagagagtgatagggagagagagaccactgttatatgatattctgtaagaaataataacagaattttaaaacaaaggcgtgtgagagagagagagagattaattctagctttggaggatcagaggatgcttatgccaggagcagaatatgagctaggctttggagggagagaaaaactttgatgagtggtgtgaggggatgggcatgctagataaggagtatagtcagattaaattcaggaggagagaatgttcagggaaaatctgacaaatggttaggaggcagtggagtgaaattgtgaatgcagttcagggaaggtgacccaaggaggaagctggccagacagtgaaagccacatagtggaagactttggtgccagactgagcagtttgaaatcttttctgtggagtagagaggaaggagtaaaggttgtaaacagatattatagaataattgctgtgttttagcaagatgtgtttagcaagggtgatttagtatggggagaaattgtaagcaaggaggaatagtttgcacaatgttatgatgttcttattgctttttcccattcatttattccttaattaatttatgcatttatgtatttgtttacttgtgtgcttattcatctgccagcccctgtagaatgtccaatgatctgatgttcaatgcatccaaaatgaggaaggcaggaagtcaaagttcagagcttccttgtttgaagggaaacaaaaacttttccccccagaatctctggctttccattgtataaacatggattctacaacattggggttagatgtgctgactggtgtcattgagtcttacatggtgaggggctatgaggtaccaggctttactggcttactgtacccagagaaagttcagacattctgaaaatgtagagtctccctagggaaaccgggcctcttgtaatggtggagcagaggataaagaaagtgacgtgacttcttaaacttatcccatttcattcctcggtgaggatctgggcggtcggtaggggaggactgtaacaatgcaaacggaagaatttggaactggacctaattctgatttactttgaaactttgatgcttcatattggcatcctcttcaaacacatctgcctgaatgctctaagccatgaaaattgagatactttaaagggttcatctgtgaaatgagacaatgagtttccaaagctctaaatttttctcttttgtgaatatttaaattcttgtgtaataattttactaataaaaaatgtttttccaaagcttgaaaaacaaagagtactgttaaaatataccaatcatctaaattccattcaaaatcattgttatgttttggcatatgcatacttaatacatatacgtatttttacccatatatctttacataattgagatcctcttgtataaacagttttttcctatttttatataatgtttgactaaaagtttgtatgttatcaaaatatttggcaaaaataattttaatgtttgcatgatagtgtattgttccataatttactcaagtattcatctgttttggagatttagattgttttacagtttttcattccttaaaaaatgttctggtgcatatctcgatacttaaatctttgtttttccatgcattttagagttttttccttaagatagacttccaggggatgaattttaagactcttagcatacattgtcagatttgttaagagaagtgtactttttttttttttttgagacggagtctcgctctgtcgcccaggctggagtgcaatggtgtgatctcggctcactgaaagctctgcctcccgggttcaagccattctcctgcctcagccccctgagtagctgagagtacaggtacccgccaccacgcctggctaattttttgtgtttttagtagagacggggtttttccatgttagccaggatggtcttgatctcctgacctcgtgatccgcccccctcagcctcccaaagtgctgggattacaggtgtgagccaccgcacctggcctgagaagtgtacatttataaaaaaaaaaaaaaacaacaaaaaagaagtgcacatttcttagactcttatgctggaaaagccaaactctgaaattaaacgagaaatattcacttagttgcagcttgtatgtgtgtgtgtgtggtgtgtgtatgttgcatacatgcatttacatgctttagggtgttagtatgcctaaatttattgtaaaattatgagaataagacttggataatgaaatctctggaaatcatgcatctccagactcaaagaagaatgtgtctctcctgctgccggaaaatgtccaggcccatctgatctgatagagccttcagaaataatgccgcatatctacaactatctgatctttgacaaacctgagaaaaacaagcaatggggaaaggattccctatttaataaatggtgctgggaaaattggctagccatatgtagaaagctgaaactggatcccttgcttacaccttatacaaaaattaattcaagatggattaaagacttaaacgttagacctaaagccataaaaaccctagaagaaaacctaggcattaccattcaggacataggcatgggcaaggacttcatgtctaaaacaccaaaagcaatgtcaacaaaagccaaaattgacaaatgggatctaattaaactcaagagcttctgcacagcaaaagaaactaccatcatagtgaacaggcaacctacaaaatgggagaaaattttcgcaacctactcatctctcaaagggctaatatccagaatctacaatgaactcaaacaaatttacaagaaaaaagcaaacaaccccatcaaaaagtgggcaaaggatatgaacagacacttctcaaaagaagacgtttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtagagaagtaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcgtttgctcactcataggtgggaattgaacagtgagaacacatggacacaggaaggggaacatcacactctggggactgttgtgaggtggggggaggggggaggggtagcattaggagatatacctaatgctaaatgacgagttaatgggtgcagcacaccagcatggcacatgtatacacatgtaactaacctgcacattgtacacatataccctaaaacttaaagtataataataataaaaaacagaaaagaaaaaaaatgaaaacaacaacagcagcatcaataataatgcttgcttacacttaccaagtaccatgtgccggacaatgatcgaagtgctttacatatgtttaactcattgctataataaaccaggtaaaaataggtaaacactgttatccccattttacagctgaaaaacctgaggggcagagagcttcagtaactttcctggcatgcttactaggtgtttgagctgtgatttggatctaagccctctgattctagagcctgtgcgcttgaccctctgcaagatagtccctgaataagacctggcttcagttggaggttgtcactggggttcccaacagtctcaaatctacagtcccctcagtggaagacccaggtgcaaagccttaagtgaaggatgaagagtagggtgaccttcctcctgggtgagacccaagactcttccaaatgcactgcctgttctggtttcatcaaggagaggtgtgtggaagggtccagtctccttccttcctgtaaagatttggaacaggtctcaactccccctcagttcagttcccttaataactactgagggacttgtcaaacagaagcttacctgttctgtacctgtcgtacctgttacctgtacctgcttaatgtgcacacccttgggagtctctgtacagagaagtgaaaagcatgctctctggcccataccacctggatttgaatcccagttatgccactttctagctgtgcacttgaggcagtaactcctctgggcctcactttctcatgtctaaagtacaagtgaaaacagctgggcagctgagtggacatcctgagttaataatggtaaagtgttggaacagtgatgactcccttaagcacatgttctgcctatgagggcttgcttcaatttctgtcaggattgctctgccttttgccctaatccctcaggactccagtaaggtctcatgactttgggcactcattctcgtgtttccccacaccctcaacacacacctcccccgagcctacttctttggtgcttgccccggtgtggaggcagcttctgatcaagttctccctgaagtgtcaaagggaaagcatggagagtgaaatggcaggacgtcacccagtgggaggatcagggaggacgttcccaggggtgtcagcctgatagggccaccataacgcagtaacactgggtgcttcaacaacagaaatgtcccaccgtcctggaggctgagtctgagattgaggtgttggcatggttagttccctctgagcatgcatctcccccagctcctggtggtttgctggcaatctttggtgcaccttggcttgtagaatcatcaccttacctctgcctttatctccgcatgtgtgcctgtgtccaaatttccactttatgagactaccaatcctattggatcaggagcccatcctactgcagtatgccctcatcataactaatacatctgcaacaactttgtttccaaataaggtcacattctgaggtcccagggtgagttcttcaacaggtgaattttgagggggtggacacaattcaagtcataacattggggaagtgcccatagctgaggctgaaggatgaggaagagttaaccgggagctcaagatttggggaaaagagagtgcataatggtacatggaccacaggatctttgcacaggtctgactggaatctttcaatgatccacactaccattagtgtggcttttcaaggagccagagtaagtcaagagtggcccagagtgtgggaggtggcagaggacaagccctgtggagttttgtcagcaatttttagcagtttaggttttactttgggcacaatgggaaagcattttaagcagataagtgacatttaatgaatgtttcacaagtttattataaaatttttactttattcctgattttttttttgagaataaaacttttttcttccagtttgttctccacttgtatttcttcatatggacttttcatatattttgtagttaatctgttggggacttgttttatcatttgtatgtgtttttaaatataatgtataaactgaattgtatgtgtttttaaatataatgtgtaaactgaattgtatgtgtttttaaatataatgcattgttgaatcagatgccaatattcccctcattcagtttttttacctgttatcatagtattgtttttcataaagtaagggatcaggaagtattatttatattttgtaaatcaaatctgcaaaaatcttaatttgtaaaagttacattccttcttagatttattttttaagattgaagagttcccacctttttaatctattcttacactgcagcaaattcatccttgagatgggaaatgtatgctaaaaattgtcgaggaagctgtgacattcatttggggaaacatctgcttgttttgtgctcaattatctcatcaaatcctccccaagtaggtacgttatactcttcctttttgcagagcgggaagctgaggctttaataaaatgggtaaaatctgctgagagacatacaggtggatttggatgataaacacaaatgggcaggccctgttcataaccaaggagtttctcagctggaagctttgagtggtttcttgggtggcttccaccttctcacttcagagtttggaacccagttctcagaggcaaactagggatatccctagcagaacacatgcctctatggagctgttctagccaggctactgcctcgctttcaaacatccctgcctttactgatgccatgtcttgttctggaatttcttcttctctcctcttacgcatttttaggacctaggatgtgttctgttttctcccatagctgttcttgagcatcctagcccagcatcctctcacttcttcattttgagtcccttagaatctgcttttctacccactcatctgctacctggtcttactgtgcatggcttcttgaggttacccatagcacctggctgtgttgtatgtgctcagtaagtgtctgttgggtagacagaggagcaggatccgtttaagtctccttgatcttgaggttaggagtctgttgaaagcctgcctgggtctagcagctgtgggtcttccaagcatcaggtagcttcatatggacacttagttgttggtaccctgtctgctcctatccctagctttgcagtggtggtgttttctgctctgtagcatatcttacatcacagctagatggtataggatggagagatggatattttggagtgagggcatgtgctggagtccagccagcagatgactgagaatggcatacatagaatgccacagttgtcaaaactcactggctattttgaagcagttgccagattgcctatcagggttgtcaaaagggacatttccaggagatctgaggacaagtgagggcaatatgtgctcaggggcagttatcataactgctagcatatattgaatagctactgtgtgccaggaatgggtattttttaatattatcctaatttaaacctcctgatggcaagacatttagaaagtgtggggtatgaaatgagctgaatatgatactttgagtacatagggatgtagtatggttttctggctttgctatcttgcccagaggtgtcagaaattgttaaatgtttataaaagccttaaaaaaatttttaaaaagatttttctctgctgggaacccatgggagtaggggagagcttagtgttattgcaaccacagccctggatctccaatgtgcatgacctccctggggtgactggatgaatatggtctcaggggccccatccagccttaggcatcttaggaatcctcagtgacctttttatgtgcactggcaccaaaactacattcagtcccttcagggttcagctccctgccattgccagtgtatacctgaagtggtacctggttaacaaagcttgtccatagggtctcactgggtgatattctctctctttcatggcctcttggtgtgctgtgatgggcaatatcagccagtggagtgctggtccagttgggtgctccaaggtcttttcatcagagacatgcttggacctattaaacacaatttaacactattaaagcttgagtgttaaggtgaatataccaagtttatatagagagcaaggagagcaagtagtggggtgataatgtgagatactgcaagaggacccaaatcaccaaaggcaaactggtgttctttcaatctctagaacaaaccaagcttttcctgcctgggggcttcacacctgtctgaaatattctcattcttctccctaccttcccctggtgcccccagccaatcacatttttcacagatctggtcttttttatcttttgtctcttcaatttaagtatctcttccccagagaggtgttacctggccatcctatctaagagaggtttccaggctggtcagtctctcagtcccttgttgagcacttgttataatagtaccacttgcagccattttattttacatcttatgtaggggttatttatttatttcactactgtttccccttccccatgaaacagagatttattgagagaagggattgtgtttttctcacacagcatggttcctcactgcctagtgctgtgtttggcacataggaggatctgtgtgaaagaaggaaagaaggaaggaaggaagacaggaaagcaggaaggcaggccggaatccacagcagaagccagggcagataggaggactcgagatgttcacttctcttggatggcaaatcttgacctgatcccttgtcaatctcttcctttttgaactttctcagttagatcactgacatttcatgctataagtcatcaagtctcctctacaaattttagggatgaagaaagtgagattctgagaagggaaatgacttgtttaaccatcctttattagggaaagaggttggaccagaactaaaaccagcgcactttcagacaggaaagcagacaccctcaaaagatcccaagagtccagtatttagtggtttgtgagtaggtgcttcgcttttattgatgaagcatagagaagtaggaaagttaagacagaaagacagtcaaatgctgggctttcacccgggagaaacccgtgagtctgaaaagccattctccaaaagggaccttaaagaaacatgaaagaaacatggaattttttcttgacatgaagctagaagctgagcacaatgcatctgacaatgaaaaaccaggctgtgccttagaacaggcttgggggtgggaggctcatgctttctttgcgagatagtacttcactcacagaggctgtttgcagtactctgtccttggtgatgagtcttcatgggaaggaggcatgtaggggtcagagaatagttttctatctgttccccatattcgtcagctgtggttgatgtattatccttgaaattggaaaagaaaaggagagaagaaatgcacatagaacagagctgaaaagtgaaccaaagacgaaaaaggtctgagagagagaaggggcatgattgaggtggttcttttgaggaagcgaagtgacgtttgacttagttttcatgttcaggtacttgagggtttgaagtctgaacaagaagaaatggacaaagattaaggcacgggagatgaggtttatgtaacagaatttaatgactattatgttggaaagctagcagggtggatatgtaaaagacatgtaaagagatatgcatttctgaaaaacaaatcatctacgttgactatccttaaagaacagagttaccagatttatgggtctaggaatttttttttagaaaagccagagttggaaactattcatcaggaccatcagtaactattatgtttatactttgagtccttcaagttaaaaaaaacctaggtacttccttaggctgtgtgaaagagtaattttggtgcttggaaaaatctgattttgaaaactagatgcctcagttatcagctgtaattcatatgcaaattatgtaacctctttcatcctcacattaatgtcctccatctggaaagtggggacaaagtttaccacagggggttaatttggacattcattgaaatttaagtgtctcttatttgtaaatcattcattcattgttcatttccattttttctctcaacagtttggaaaaggtggccttaatactggtggagttcatattttatggttcactttttactaactcaggtacttttattttttgcccataatctcttttggggtatgtcaattttgaacagtcactcatcacgctggttctgtatactttttaataagaacaggaagaattagactttaggaagattttcttgggttgtctagagtcactgaataccattatcataagatgctctcacatccttgttttattctcattaaacagattcattcctagaagcctactgtggcctagacaccacgtgaggaactagggattcctggggtggggacaagatagaccatgtctctgctctcgtggagtggacagactaatggggacaacagacagtagataagtacacaataagccaggtaataactaaatgtggctagtgctgcagggtggtgtgaaaggaactgggtgggcttgggagaggagaggagaggagaggagggggtgctttttttaaagtggtcaggggagaactcactggaagcagggctgggattagggtgaggaaagtgaaattcccagtgtacaattttttttttttttttttgagacgaagtctcgctctgtcgcccaggctggagtgcagtggcgagatctcggctcattgcaagctccgcctcctgggttcacgccattctcctgcctcagcctcccgagtagttgggactacaggtgcccaccaccacgcccggctaattttttgtatttttagtagagacagggtttcatcatgttaaccaggatggtctcgatctcctgacctcatgatctgcccgcctaggcctcccaaagtactgagattacaggcgtgagccactgcacctggcccagtgtacaatatttaaggaagcattcactcttagggtcctgcaagtgccttcttaaaattttgcaccctacatgccctgcttgcttgcctcatcccagtcccaggcctgcctaggaggtgacatgagttgagacctcaaagataatgaggatacaggccttcaaaggcatgcatgatcatcagctaaacaagtgagtgaagatagtgtttgctgtggctcatttcaatgtggtacagagatatctgtgtaaatcctgtaattgccaaaattgacccatcaatgttaaagaccctttttaagtggatcattttcttccttttacacagccatcaaatgcagcactaatgaggggtggtattcatcttgttttacaaccctgagcttctctgtattcattagcatgcaggaatctgactccctgtggttcctagaaacaggagcccctatccttgcttcatattttcatatacgattgtttttaattgctgaggagcctcatggctcagcccaggtggttacatttccaccttcactctgacgtcagaatgcttcagagctctgctctctgactaagggataatgtcttggctgccatcttggggaaatgtctctttgtaaataacgtgtgcagctatagactataaattaaaaacacatcaacaatattaacacatcattgagaaacaccacatggcaaagttccaaaactatgagcaaagttctaacccctgagcaatgcatgatatattgctgtttctaatgtggtctataagacagcttccctgacagaatctcacactattgaaaagctgtgttctcatgggactactcgcctgccacgcttcatgtagtttttcagagatgctcacttacatcttgcatttcagatagagaccgctttaatcaagctagtccatactcatggcttccaggccagactttgtccaactagtccagtgatagttcccctggctctgttttcctgatggcatctcagccagtggcagggtgagattctatgtttgatattcagcaggctcagccctgtgactataggagataagggcttccttcagggcacacatagacaccttcaagtcatttatatggagctcgatgctgggaatttgagtccctgagctcagctttttcttttaccattttgtctagcaacattggagcaactagccaatctcattatatttgttagttttctaaaaatgcttgaaaatatcatatacccagtcagacatcttttgctttgtgtaagttgttgattaggtgtatccaatgcaaatatttttcatgtttctattaccagttcagttcatgccatggactatatcagtgctctcttcactactgggaagcatcatttgcacctttaaaactaatcagattagagagcccattccagaaacaccagaaccaattcagaaaactcattctctagtaccactgcatttctgctactaaaatctatgttaaggttctctagagaaatagaaccaatatgatggatatgtgtgtatgtgtgaaatataatatacaaatatatatttatatacatatattacatatatttatatgtattcaaaattggattatgtgattttagaggctgaaaagtttcacaatgtgtaaatttcagcctgggtccaaaagccagagtgtccaaaccaagagtgtcggtggtgtgagttctagtccaaggacaggagaagactaatgttgaagatcaaacagtcaggaagagagacagaattcaaccttcctctgcctttttgttgtattcaggccttcaatgggttggatgatgctcactcacattgaagagggccatgtgcctgacttagtttaccaattcaaatgctaatctcttctgggaattcccttacagacacactcagaaataatgtttaaccagatatctgagcatcatgtggcccagtcaaattaacacataaaactaagcatcacagcatctttcggatggaccctctaggcactatcaccaaccatttcttctgaaaccataagcagaacacaccatgaaccatgtttaaatgtgctaggttgaatgtttgaagtcaggactctgttggaatatcaggatgcgtaattactacacatattatgtagtcctgattacctgagttctccctacctgagacatccttctggctaggttgtcaaccattctttcaaacatcttttatagtagaggccaaaagactgcaagctgctagccctgaagagcttagagtctagagcatcatcattattagctactgcaagtaattttccatcattgtaccttggtttcctcattgtcagaatggacataatgatggcatctatcacgtagagtcgctctgaggagtaaatgaatgagtagatatatggaaagttgttggaataatgcatggcatagcataagagctctagaaatgctctctattgctgtcattatcattatttctgttctcacggaattgatgcatattataaatgtcaacaattctcttaggatggtgcacattttaccatattttttatcatgcagatgaaatacatgtaaataaaagcacacatttaaattaatatttctttctttcattagtggttttatatattggtcctgcacctctcagccaatcttaatctttaggaaagagaaacactgatccacctttagtaaatgacaatgagtagagagtcattcattcattcatgcatgcatttatgcaacaggtatttattgagccctttgtgccagagtctatgctagccccttaatgaaaatgacagatcattatttgtttaatgtttttttttttcttgttaacaactattgtattacttcaaaaaaaggtaacacctaaaactgccatccaccccttgcacctcagcatgagggaaggtttggagagagacttttgagggaggactagggaaaggatgatggatcaggttgctttaggtctgaggacagcaaagaacaaagggcatgtatctgcgagggtagacctcaggataaccaggggagtggagggaaggagaaatggctcacttggagagggagagcctggctgtgatacggtcattttcccatgttgagcatgacctcgcagggctgtgcccagcctgatttgaatgggatgaggcatcccacactctcttattctcttatcctactacctgacttcagtgtccctctcggaaggaatttcccaatggacccacctctgaggcattcttctgactaggttgtcaaccattctcttgaacatcttttatagtggaggtcaaaggacttaaggtgaccagcccttaggagcctagagactacagccacacaaagcacaggagtgagcagaaagcacagtgggcagagcagccctccatactcatgggggcagggatgaccctctgtgcttcaggatacgagtagttggagaagaaccaaacccctgcttcccagaggaaccacgggatgaagtcatatgagagatgacagtgtgtcatacactatctgaaaattacatgtgggttaactttttaaattctcacagtaatccaagaggtgagtatttgaactatatctgttttacagacaaagaaaccaatgcacagggaacagaggcttctgttgtgacttagaccttgaaggatgagtaggatttagttacacaaagggaaaagagggagctttccagaaaagtggaaagtccgctcctaaactaaactaggagtgcaaaccaattttaagagtcagaattcatcagtggtgcagtgtccttttaagaattctgctactttagaaaattttgagcccttggcttttggccccactgtgtgcaccagctctgggcgtttggcaatgcaggtggaccctcaaatgcaaattgccagaaagataaatgagaattggtggctgtatttaattatgcagccttctgcaatgtgtctacaacagacattttttcttatggagagtaattattcttagcgtgcccatctgagtgagattatgctttggtaattggttttgaatccttgatccatttttatttgagccaccttgctagaatcctttctatcaatatttgtgaattgagcctgaggtacacgtgcccctgagacacaacttaaaggtgatcttgtttttgcccttcccagaaacctgtcgaggtgagggcagggagttcctggggtgatgggcagatcctggattgtgagatgcgcttgcttagtactctcagttcctgctgagaggactcagttttacccctttgcgtcttatttctggtggtagtcttaactgattggaacacatctgtactgtaggcaaggaggtgacttctgctctctcacaccctgagactactctgctcacactgacccattgattcacaaatgtagcccaatactcatctacctgactgaataaagtacacaaagtatacataccctctgtcaaccaaatcctactccaagtctgtctacccataactgtaatataaatatgataatagctgccacatgaaacttacaatgtaccatgagggatgcatgtaatcataattgggaaagtacttctcaattgtacattaaatcataaatggcaggcattgtcttcagcctggactgaactccagcagtgactcccctgtgaccttggcaagtcagttttcattcctgggcttttcattgttaggaaaatgaggggtttgtgtctgatactcctgactaagtatttttgagaatctatttgcatgctgaagtctttggcccagggaagaaaatagaggactcagtctcaatgtgagtgtgcatcagcattaccggtctgcaacaatttacagtcctgctaacgtgtcagcttctgggtcccatcctccagggctttttattcagaaagttggagatgggacctagggatcctcattttgatttttttttttttttgcaaacatcccaagaattctgatgtagttagtccatgagccaacttaggaatctctgaaatagagggtgaataacaaaggcgagtgaaggagaaagttcttgcaatgatatctcctctggggatgtctgggtttccactgagattcctttctttagctctatctcctctgtgtctggtgtgcttgcccaaatgtgcatgctcatgtccactcccacgcaccattacaaacaatatgggttgaaaagtttgttttctgaaaagcacaatatgctgaagtcttggcagaaggaaaattgtgttatgtgctgaaagcatcatcatttgccatgcgtgaaagcttatggctggaaggactgatatgccatttgcagagtatggtttacagtcatgtacacacacatacacacaagcacacagacaaacatacacatttgagtaagctcccacacagtaaatgtgtcaagaaaagagcaaggaaagatccaggaagaatctttgccctttctgcagcagagagctggtcacacgaatgtgtccgtcattttcacaagaagggcttttgtttcttgttttcaaagctggcagaaaatagaaacatagcaagggtttctgatgcagaaatgcagtaaggaatgcagaatgctgaatttcttcatccaggacccatttttcctcagtgggataaaacccttggttttcattcttccttactggctgaccagatcatccttgctggaaatccattcattcctaaatgggcttgacagcttccacttagaccaaagtgctcctcttggaatgtgtacagttgttgagcagtgggagccagttctgagcactgaacacaggcaatcaacagccccatttagctttgagctgactaccttcagaagaaggactgttatacctgttgagaaggaaagtgtgcatgaaaagtaatttccttctccttttttatagtggaaacaattgccttttgggggcagagcaccagcattctcttttggatgcagtagtcatacagtcaccatttggagatatgcaatctctcatttttattataattgtggcatatctttaatttgcttggcataatgcacttaatccataattataaaatatgcaactagcccttggcctcattctgctctcccaccacagaggcagtttggtgtttttattaatttaactttgtacaagctaacagattgtcataaaggaaaacagaatttctcaaccagttcggctaatagctgagcttcagcaaagggccctgtggtatgtgttgaacaataactacctctctccagcactacttgcagtttttaattgaattgctatcccatggatatcatgttggaactattcatctgctccactaagtcttctgatattaaacaagttctttcaggttattattgtaatacaaatacggttggacagttgatttccattaaaaattcactgccatggtaaggctaacacagtgaagggagcttatcctgaacatggccaagcaaagaaatcacattaataagggtgaaaatgcagtgtgcttatcttgtttgcttccttctcacaccctcctctttgtttaagaggatttggtcatgctgacatattttgacaaatgacaaaatactgggcattttcagagtttctagtttggttttagatatctgccatttggatctgccaataagaagacatgtccattcctctgggtttctcttctacctccatttttcctttgctatcttgtctctagcacacattgtcattccagttgacattacgaatatctgctgccaagagctattcttactgttataataaacatcttataggccttattgccctctgcattgtgtatactgatgcctttccaacgtgtactacttacactttctgatgtttgtatactgactagttcaccaaaatttcagaatatcaaaactataggggccctctggaaacccttaaatggtagggttttattaaaaaaaacaaatggaagtaaaccttatatgtaattgggatgggtagaattaggaatggctactatatattccagctttgtgaaggtgtcataatggaggaagcttattgtcctccctactgttactcctttaacttgcacacctaaccttgagtacatctcatcatattctttaccatatccctggcttgcagctctcttctgcatcacatcctgggaaatccttcttgatgacttctctatcaatattagaaaacacctttgggtctctgacctcatacccttcagctctcttctgcagccgcctaccagcaccaccaaatcttggttttcatcatcatttggaactaccttaccataataacttgaatccttgaattacactatgtgatcacagtctcctatttatccagttttcttacactcctacattcactgaatttgtgttttcatttgaatacatgatgtcttccattttctcaactcttccttactctcctcgagtcacatgtcttatcttccttaaaagattatatactcttcaaagaaaggaatcaagccttctacctactcattactttgcatggaatcatgtttgtcagttggtagatatttccaagccaagagtgttgtttgaccaatcaagaaaacaattataccctgacttctgaagtgggatatgcattgcatcaaggatgccatcttgggacatatgcatttatttgcagtttggttttacagtagtgggttatatgagcagtctctcttgaattcaaatcctgactgtgccattaaatagctatgtgaccatggacaagttacttgtcttagcttcaattttctcatctgcacaatgaggcacaatgatagggtctactgtgtgaagtaactgtgataattaaattagttaatgtttgtaaagtgatgagtgtatgtagtctctgaacttagtagactattaaaagatagttggtatttcattactgggagcttcagatcaatgtttacttaagataaacctttgaaatgtcagcattgaaatgttgaagacttttgagtctataagttgtgagtgagacccagctgctctaatgaaattcctagttagttattgccgctggcctgcccatgtctacaaaaaaatagatggtctcatgggctcaatggtgcatattagaagtgtttctaaattgtaaaacctgcatgcctgtctgattgagtaagtgctaggctgatggctagtgcaaagcttcacaatgggtataattatttgtggttttgaatctctagaccctataacatgaaggtgaagccttagaatagctaaatagactcacatggcaaaaggaaaatggctgtttttaaaataatacagccaaacataaacccacaggctcttaaagtttatctgagagtttctgaaccatgtttttttcccctagttactattactccatacttcaaggtcaaatgccaataaagtagcaaattgtatttctcaccttgacatggttattagatctgacattccttgagaaaaacagtgaagcctgctgacaaaaaggactgtgacttcaactgttgtaagtcactaagggcaataaacattcctgaaagagatttattctaaggattttaatcatttcctgttatagccggtttgtgttggataaacgtgtcatcaggtgctaattacttgccttgatttttctggctgatggaggatggtacttattttaatactgtcaccctgatctttgggtttctgccttttcatttggctattaacaaagcaagttagattccaaaatattttctagatatgcactcttcacattaatctgtagaagcacagaggttgtctggcacttatagatctgtttccacaggcacaatatcaaagacccagaaaagctttctgatccttccagaaaatagtaatatctcaggatgctgtgaaagagagagcctgggttgaaagttagaagcctggatagggtttttcatggctctgacccttgttgactgtagaattaggagtattcctctttcatatgcccccaaaactccacaccattgtcagatgctgtcacattgcacatgcaatgaactggtccaggttttccttccttccttccttccttccttccttccttccttccttcctttctttctttctcttccttccttcctttccttcttttcttttttctttctctctttctctttctctccttctttctttctttcttctttctctgcttttcttttttctcttttcttttgtttctttcaaaaggatgttgctttgtcactcagggtggagtatagcaaagcaatcgcagctcactgcagcctcagccttccaggcccaagcctcctaagtagctgggaccacaagtacatgtcaccatgcctggctaagatttatatttattttttccttttttttggagacaaggtctccctatattgcccaggttggtcttgaacttctgggctcaagtaatcctcctgctttggcctctcaaagtgttgagattacaactgtgagtcacagcacccagccaggtcttcctcttttaatcacaacacctactgtttcctagtaattcttaacccgtatttcacctagtccagtcaccattatccagcatgccttctggttatccacattattatttcgtcttaaatgtctttctttccaccctttctttgccttttcactttctccatctttcattgcccagccccagttccttccaatccacagtgatcaatgtttcttgtttaaaaaatttatttacccctcagaacctgtatcctcttatgtaaagtggatacacttacagtgcctctcatgaagattaagtgcacagatatttgactcataaaatattttcaataaatataatccctaccccagtaatgtatcttgctgtctgctattccttcaagccctgtgtgtctgggcctgaactggtcataggagtaaaaaaatatagatgctggtcacattctcaataggctcagaattaaataaggaaagatgtatacaaatcatttcaatgcaaggccatttaagggaataccatataaggacagaaaacaggctaagagaagacaggaagggaaattgtgccaggtgataagaaaaagatttcctgagaaggagtcagataccacatagagtatttcttccctatggttttctgcattttcctaagttttaaaacataggaaactgtatatttaacattatgatagttttcaaagtcttctctattctctaaattataaaactagttttcttatgaggtctccttaggaataatacttagattttgaaaatctgtttacttatttatacatatatacctcaccattttccagaagggatttcagatgtgcctgtactgaatatcttgaccatcatctcagtgcatatgtggaatgcaacttttgggaaatatacacagattcttcaattgcatttgtttatgaaattcttttttttttccattagctcaggaacaagaatgtaaccatagagattttcacaatttattcaatcacttggccaatatctgttgaacccatacttcattccagagcagtgccattttcttgggatacagatgtggacaagacattcatggaccctactcttgacaagttgacatgcttatagggaagcagacaacaagcaatgggataaattaataaaacaacataattagagctagtaatacattctgtgagggaaataaaaggtgctatgatgagcaaaggaggatgataggggtggggctatggagaatttcattatataagcattttgggcaaagggctcactttattatagaaggtacttgatgttcaagaagatttactcaaaatctgcaaaaaaaattgagctattgccttctgtgtttattatctttaattgtgtgtgcacacaagctgtatgtattatttatgaaaagatatctgtaagataaaaagcagaatctcccaattagaataagggttaggtattttatatgatgaaatacaatgtgaccatttaaaatattttatagggcctttaaaaataacataatccaatattagcatgaaaaaataatatgtggtttggaatgtaagtacataaaattatgccattatcagtcatgtttcagtctgaatgcactgtatgtattccaaatatggagggcttaaatacagagaattagagggatttgcacgatgtgttggatgttctaggaaacataggcatagatgcgaccattgatcccagccagcagtgccacagtggatgtttttgaagggctcaccctgaaggtatcacaaatctccaggaacctctggtaagccccagcctactccatcagcaaattcggtggttctcagggtcagatttgtgttataaaagactgcagcatgtctttcctgagacttgctacaagttaggattcaactttggagcactttaggatggacagattatgatggatcagcatatgttagttttctattaaaactattgtaacaaattaccaacatgtagtggcataaaataacagaagtttattattttgcagttttgtaagttagaagtccagtacaagtctcactgggataaaatcaaggtgaagtaggctgtgttcctttctggagaatctaggggagaatctacttccttgcttttttcagctgttataggctgcttatatcccttggctcatggtccctgtctccatcttcaaaggcaaccataacaggccaagtccttctcacctcaccactctctgacccactgcagctgaaaaaattctcctcttgtatagactcatatgattagattaggcccacctggataacccaggataatctcctgatctcaatatctttactctcaactatatatgctaagtcccttttgcaagagcatattggcaggccccagagattagggcttggacatcttcaggggctattattttgagcaccagcatgctaatgaaaaagatggtggggctagtcattatgagcccattgactgcctttgtgcaagccagacaaagatgcctcccctagttggagagggccacttgatgagcaaaaggggtttccgctgaatttagaaaaggcatcctttcttctagacaggtgctgccctgagccagggctcacggcttgcataacagagcacaggctgggtttcagacccacgcttccccttgatgggatggcttaacctgcacaaaactatacagaggccctgggtagaatcaatgggtggcaatagctagaagagaggtgatgaaatccggtgaatttaatcccccacctctttctcaggatgggattggggtggtggaggtgttaagccttggagctgctggggattccacagctctaatcctttctctcaggacccaatccactttgattcacttcctcatcatttcatttatattttaaataaccatgtaccacctgtccaaccaggctataacttcctggagggcggcaagcctacgttatcttcctcttatattccttattatacttccttattagatatttaacacatgtggcataaatgaaccaatgactgaaataaaacgtaatgagaattgtaaaagacctttaggatttaacaataaaagccattgttaccatctttttaaaaatagaaatacagagaaaaactattggacagcaaagtttcccttccctcctcagtctttccattccttgaacaatcctttcccccagtgggacctttcttttgtccattggctgttctatgctccctgcctttccttttctctttcaaaatctgctagttggtattgatgctcaggcatgattgagtttatcactgtggtctgcccttaaggaatacatgtgtttgatgcctaattataggattaaaagtctgctttgtgttaaaagaattgtcagagcaggtgggagaagcattttgggggcaggggcttccttggtacctctaacatcttatcccgtaggttgctacttctgccaatgcctccagcaggccctcccccgtctgctggagaaaggaaacattcttgcagaacatttcaagtacattatccagccctctattagaaaccctgctttccctcatcctgaccccctgccttactctgtaatattacaatgcagataagcacagaggtagcacgtgttgatgcggtcattactgagctgatcctgcttcacaagctatccattttgcagtgggaatgtcacaacatgagtcacaatgggacttcaaaactgtgtgtttgtcactctgtatccaggggagaaagacactaatatttcaaatttcctgagatttttctgcatatctgacttgttaaaacatataatctctgaaatctgagagataatgccttggaatcaaaactatgattatttatttgctccaacttcagcatcatttatgcagcaaagtatgaaaaaggaattacattccccgataacatcaggaaacccatatttaatgcagatttaaaaggacagatgctagcatactggttccactgatcattacaaacacacagaggtttagcagctgtctgatagctacatgcacagtacaatgagagatacaaatatgggtgagtgcatatagattgtagtttaatctcctgaaatatttctactgatcaatgactgtagcttcgtggtgtgcaattgtcctctttaaatcaaaatggcctgtctatttgtgaactctagctcagtgctttgctggagggaaaaagttgggaaagaagcccgttagtaatgcatagaatgatactttttaatcagaatattaacattttgattgaaccgatggaacatttaaatggaaatattcaattgcaaagaccaaacttgtgagggagcctacaacatgcacagggtctgtgcctttttccttgattaaagagaattcttttaatagagaaaaaagtaacagattaaagaatcttatattaagaatggaagggtgggtattgttcccttttcaattgcttctatttaaatatagacaagcacacacatgggcagctataaaggcagagactttgatctacggatgattgaagaagtgtgtagtaacttgcgtcaaaaaccaagcaaagcaaaaagactatgaaatgaggtgtaacatcagactgcgatgctagcaccagctccatccctaactggccatgtgaccttggagaagccactttactctctgggctcagtttttcacactggtcaaatggagacaatacttaaggaattcacacagttttcatgtggattgaaagggatttaaaaactctttgcatcttcagcagttggtaagcatccctgtttcccactgggaaaatgcaaatccccaaatagggtatgaagctagaggtgatgagctgctcagtggatgcacagtgaaatttaggaggcagagtctcctttaaagggttttgaccctttgactgatctgccactgattaataccccagttttctagagtaaagtaaatatctggattttcttttcacaacaaattgtgggtagagatccacctgattcacctgatacctctgctttgttcttaatccatcttggaatgaaacatctgactgcttctgaaatgcccagatttattgcaaaggaggttcccaagtcacttattatttttttgtttggctttgaagcatgatcaaaagtgtgactatttctttggtcaaaagaaatctcctggcttcagatactcttagagcagagcttagtgtttggaatgagaaaggaaaaaatgactatcagagcatcagcttatgaagcaagtatccttagaatgcttaaggttttgaagggcaattctgataaatatagtctcattgtttgtgctggggaaggagcatggcctcttagaactgtagaattctacagaatcattttacaagtgaagaacctgaggcccacagagagagaaagcattgggaaatatgtttatggatttgacccaacactcctgtttagggaagatacatccagatggccactcctatacccataacatacactatgattttttatttccttggtcaaccttccaatttgatacagcccagtcctcttgcttattcccatctccccacccagtgccactcctggccacagactgggatgatagcatctttgaagatatcagaaaagctagtgaacatttgtactagaaaaaggaatgctaattcattatttcattagcacataatatttcctctcttgactcctctcttccacttcaaagagaatgctgctgatttttggtgaagtgtggaagaaatcattctgctttccaggagactaacattatggaatcacagggaggaaggacacacattttaaggttacaggtggctgtgccacctgccagtcaattctcaacagacggagtaggagcttcattttttttattccagagcagagcagtggatgtcgggaagattcctgaacttcactgaagctgttttccacagggtctggtaagccaaggagtttccacactggggtgagtggatttgacagcagaggtggaaggaatctacaggaaagagctgcctaattaatcacaagctatcagagcctttcagcagtgagagtctctgaggtcttaacaacacccctcagtaaagttaaaaaccatcttggtatgacttcattttcttagagacacatgattgatctggctattggtgaatggagacactgcggcttctttctgtagatggtgtcattagatgagaagattaagtgcctttgagcaaaggctatgtgaagactgtgagtgattcactgggaatggaagaaagataaagaaaactctgaaatatgtacttttaaaggcaaaaccttagactttacctcatttattagcatcataaaaagcttggtggagagtctcagctaagaaaaatgccttctttgggtcaagtctttagggataccgctcaaagcagctaactggggctggtatctatgaggaatatcttattttttattgttggtcctactctattccccttttaagcttttgaatgctctgaaaggagacaggggtcttttcatttggagcctcttaagtattaggaagccaggctgggccaattcaacttcttttcctctaaggaggctgggaggtaggtttgtcagagcttatgattaattaggaagctctttcccatagactcctgcctttgctgtcaaatctgctcactccaatgtggtgactcctgggttttctttttcctgtggcaaacagcttcagtgaggttcaggaaacttacctacatccactgttctgctgtggaatgaggggggggaaagggtcctaccctatctgttgagaactgaccaaacagatggtacagccacctgtagcaaaccagggcaggcaatagagaagggttatcaatgcctatggtcaacagaagatttgtttacccttctgaaatcattcaagtttaaatttctaaatacttcttggcaggccaagtcaaacatttttagaaggacttagcccatgagtttccagtttgcaaccctgcaggtgataatatatctttaaaggagagaggagacatttaatgtaagtatgcttttgtcactcagttcactcattcatttattcattcctcaaccacgtcgagactgctcattgctggcttaccctggaggagacagaaaagtaagatctaaccactgacataaagcaatccaacatctaggatctatgatataaaaattcatatgttatgtcagagacttttagcgttatatacagtactgtaaagttcagagaaaatacaggatagtgagctttaggtgccagggaaaggatgcagtcagcagaccatggggagctattgaaggttttcaactggatgagtatttgagatggaatttaggaagaataatcatgttgtactgtatgggaagtgtgtgaaagtttgttcttagagaagggaggatcaggttccattgggtataggaaggaggtgacctttttgagaggtaatttgggtacaaaattcaacacacttaacagaacatttgggttcaagggaaaaaaaaagacatttctaaaatagttttgaattctcatagatagctatttgggtagaaaagcaggtacccatcagcaaagctctccataatctgatctcatgtatttttctagctttttttttttcctcctatgtccctccaggggtgcttgctaccaatcctagtggacctggactagttattctgcccagagcatctctttcattttttgcttctagattgtttttctcacactatttattctgcttctttgaagatggtaggaggtcaggagagtgtgagtgaactaaactttaaattcagtattttaacagagttcctgagaatctatcaagtagcaggcaccatgccaggagtaaagtggacaggcagatctttgtccagaagctgggctgatgacaaggagactgggctgctgctcacccacacagggagcactgtctcaggtcttcttgtagattctcatgggcacagcctggtggaacactgatgcctctgtcaaaagtttctgtctactggacattttggaatcataagccatgcccttttcaggatcttaacaacaaagatctcaaggacagcagattttagtttgtgctgccaggaagacttagtagatttaagagagcatacacacttgtgtttcaagtgagcaagacacacttttaaaatgttcaaaatattcctttccttctcagagatcctttgtgtaggtggcccttgtggcaatacggtattaagtactcagcaggacttttaaagtacatctttatgtactttaattttgttaggaccggaacagtgttaatggtcatcatctttttaaatgcttgcagagtattaatgcttaggagaaaaactttttccctcaaatatagaatgcataaccatgaaacaatatttttcgttttgcgtctttcccattctcatgccatcctacttatgtgaatatgtgatgtcaagcagatggctgtatcaaactagctggaacatacatatgatgactatcccattattcttggaaaggtctgagtgcacctcagcactacgaaggattttgacatttttccttaatagttctgagaatttctcttagctttcataatctgaagctgaatagttgaaacagtgatatgagaatattttgaggggagagcaagaaagaaaagaagaatatagttatatctgttttctgtgactgatgacttaacaatcctcaaagtcaagcaggaacactagagatggaaaatacattttatataggtaaaagataacccatttaacagctgaaaaaactgaggaaccataaatatcaggtgatagtctgagacaccctgctgctaatagatagcagctgcaggaggattagaatttctctgttggctccatgctccatagtccttaaatgcatctttaatactttttttctagtaagactgacttgatttgtggttttatgcaatgaggtggaggtggaggcttttattttggggtacatgatacataatgattggttagccctgtatgtgagcagccaaatctatttgcattcctttactcttagtagcctttctaaaattctcttatttatgtggtgtttctctctttacagtattcctgaaaattgcatttgaatatctttataacagggataatggtgaattattccatttactttatgaacttagtttcatatatgtttatgtgtgttcagaataggcagatacacagaatatgtccagataccacatatgttatttatatgtatatatataatacattacgtaaaatatatacagttgtgtatataatatataactctatcatctatctatctatctatctatctatctatctatctatctatctatctatctacattctcccctaaacctagatgtagaattaaaatatttctttaggtgggagcccaaaacagcagccattgatgggaaatgacttgcaaggcagaatctacttgccatctttttatgtttaatttaacatttgaaagaaggtggggaaaatatttgttcctagacttcctaaataaaatgttttttcctttattgatggggacaattttgaggtttgcttgaggttttctttccacaatttacccactaccttcttggtccaactttctgattagaacatatgcaggttattcactttcctgcctgtgagcttaattgcagtgctggctgcaggaaagtgttctaaaagtaatatttatgtgggagtatttggtaatcctagtgattcaaattttttcattcagcaagtaatttagtgaatatcttgctaaagtatagtagggaaaataattcattgtagagtgtctcttttacatggatttatgatttagttggggagacaaaagattcacatgcagtgattatatgaaaatttaaaaccttctgtgaacacatggcatagacactttgcagttcataaatgctaaaggacttcaggataaaaaatggtaattgtggactgcagtggttgggaagactttttgggtgcgagtagcttaagctaaggctgaaaggatggataagaaagagctgggcagagaggaggtacagaggacatactagaaagaggaatggcatgagcaaaatcttgggattggaaacaaatatggatcttggggagacctggagtcattcagtattgctggcatggagtgggagtgcataagaataactaaagatatagttactgatatggaggaaagaagaagggatgttagaaggctgtaaaggctccagtgaggagtttagacttcctcctggtggcttgttacttagaatgcagcttctagacaagagtccggttataggaaagggtggaattgtcactctgggtcaggttgttgggtgctcaccctgcgatcttgtctgcctcaagatccccaagtggtgatgttggtggttgtagttctcatccagaattttgtttagatcgcatgtgaactggattgttttcagctactaccacttctgatagttgtgctcacttattctcacctctatgactttgttgttctacttatgcttctgtggatgttttaagttctgtatctgtcatacatgatctactgcatctgtcagatctggcagtggctggatctgcatgaggtgtctaagtacagatgcttgcacatttagtataagaccagttatctctcttatcttccataccttcccagcaacatggtgggggcgggggggcgggggcggagcaagcccatgaagacagcatgagaccaatgagagtgcttctaagagtttgggtttatggtgtgttttttttgaaggcagttgggaagctgtgctctccccttggacctcttttccttttgcttgcagcattgagacatcatagatttcttttagtgagcattgtaaaaataattccccttacctttactttttagagtctcatacaattgtaacagttaacctcttttaaacgattttactcttttattcccctgcttctgagaataaaactgaaaattaaatgttaaaatcaaatccataaatccctagctaccaccagagcaaagtgtgactggctaagtagttggaccaggagactcaaatgctggccgatccaagaaattgggcttcattctattttcctgttaaggatcagaccttatggtactcagtggaaaatgtgaagtggcccagtaggagagtccattgttttccatgtttctaaaaacatgtgatctacatgtgctaccaatgcaaagtgaagatgttgtccattcttatttcactacttttaactacctctccagtactcaccttttttttctatgttgactcaaataaaggcaagaataaaaccttggaaatggcaggaaatttgtagattacctccatctaagtccagaggttacattttaaatacttaacaattggtatgacaggacaccaatcaatcacatagagaaaaacaaaatcagtcagagtagagaaagacaaatagggtcaggaggatccatgttatacaggtgttagctgggaggatctatgttacacaggtgttatagcctttcagtttgtgagttgtgggaagatccttggggagtgactgagttggctggaagacatttgggggcctcgagggcaacagccatttacaaaatccaattgttttaaaattattaccgttgaatattagccctacctattccctactttaggtcatatattttggagttgttagtggatgcataaacattaggattgttatgtcttctggaaagattgattactttatcattataaaatatttctctttatctgtggtagttgtttttttggctctgaaatctacttttcttggtattcatatagctacttaagcttttcttttttttattggtatatatttttttaccccatctttttgcttttaacttatttgtgtctttatatttaaagtgcatttcttttagacaccatctagttgagactctaaaggctccagtgaggagtgtagacattttatatttgtggtagatttcctgtgcttttttttttttttttaaatccgatctgacaatctttgctttttaattaaagttctagatcatttacatttaatgtaattattgatgttttaggtttaaatctgttgccttactctttattttcgatctgtcctattgttatttgttccattttccctccttttggatggtattttttttttttttttgctatcccattttatcttctttttgacttgctgtgtataactatttattgtgtcaggttaggggttgcttttgggtttatagtacacatctttaatttatcacaggctagattcaagtgacattttaccatctcacaaaaggcacaagaaccctaaaacagtatactctccttccagcccttggacaattagaggcatacattttatttctatgcatgttataaacctcacaatacattattattttttatttaaatagtttattcttgaaagatatttgaatattaagaaagagttatatttatccatgtagtcaccatttctggtgctctttgttttgcgtagatacatatttccatctggtatcattctaataattctgcctaaaggacttcctttacattttcttgtggtaccagtatacagatgatagttctttcatctgttttagaaaacctttattttgcttttgtttatcaaagaaatgtaatttaattggcttatttttcctttcagaactttaaaaatgtactttcttatcatttacattgtttctataaaataatcttctgtcatccatagctttgttccattccatatatctttttttctatattcttatgtttctatcactgatgttaagcaattgagtacgacgtgctttgatgttgttttattcatgattcttgtggttggaagtttttgtgcttctcggatatcgacttatagttttcaccaggttttgaaaatattcagccattatttcttaaaatatttttctctgccccacccccacacctccttctccttttagagactctgattacaactgatgttgtcctgcagcacactgattttctgttcattttttcctcagtttttttttgtgtttcattttggtatgcaaataaatagaaaaaacttattttttctatgtttcgttcactttctattgctgtgttttcaatttcatttaccttttccttgtaatgtctaatctgtcattaatcccttttagtgtacttttcatctcattcattataattttcatatctgaaagtttgatttgtgtcttcttatatctttcatgtctctacttgcatgtacacttttttctcttgcttcttgaacttgtggaataaagttaaaataactggtttaatgtccttatttactaattctgtcacctgtgtcatttctgacctggttttcagtaagttttgtcaacattggtaatattgacatttttcagtggctaataatttttgtaggggatttcctgtgcatcataggatatttagcagaattcctgtcctccacctactaaatgccagtcccatcttcagtcacgacaattaaacatttctccagatattgactaatgctcccaggatgcagacagtgagaaatcacccccagttgagaactactgatttagattaattgatttttcttctttttgtgtgttgtagatatctgcttctatgcatgccaaataattttttatctgataccagatactgtgatttttatcttattgggtgctggatattttaaaattcctgtaaattttattgagctttgttctgggacatgattatgttgtttggaaacagttgaattcttacacgtgttttgtttagggtttacaagtgttttgccccactactgaggcgggaagttttctgaggtattctacctgattccccatgacttatgagggttgccactctggcttatggtaacagtaactgttattggccttgtgtgaacttctggaattgttccttctaattctttcaggcggttctttttctgatgttgggtatttttcacatagatgcactgatcaatactcagctgaagacttagtaggatagggagtccgctctgtatatccagagttctctctacttgtgcagctgtccgtttttcagtactgcttcttgcaaactctagctgctttgccttaggctttcctgttctgtctgctgaactcagggagatcactgggcttcacctaagttacttttccctaatgtagcctgaaaactctgtccatgcagggttaaggggcaattacaaggcttactgaatttgtttactgtctcttagggatgcttctccttcattgtcttggtgtccagtgacatgaaaattgttgttttatatgttttattagttcttaaattgtttcatgtgagcgggtaaattcactctctgttactccctcttgtccagaatcagaagtacctatgctttattttatatctgataaaactgaggtccaaaaaagtgagttgttgcctaaggtttgctgaaccagattagtggcagagctagcattggatccagatttctttcttccaggttggtgctttttcaatcataacacacactatgactggcacctccgaaggtaatgaattggctcctggatcttcaaagacaagatttaaatcacaaagagaatgaacttcatggagttgctgctcttctttgatccttatttgttaaacatatttttctctaaataggtttgtgacccctcagtgaagatgtagactgtcagcgtgaatattttgtgaagattctcattttaagttttacaactttatactgctggaagttgtaaaaacatgtggcccttaaaaattccagcttgatggttaaaatgtccattcagggtctgttcatctttcttgttaggaaacctagattgtaagtatactaataacttaatagtaatggactagctcagtgctgtgtttagggagatgcactaagctagttgggattaggtattattttggccgagggtggaagtgagatttttaccttactcacagttcttaccacatcaagaccaataaaaacatctgctgcatgactgactattctgtttcacatatgttacttgtctgtaagcttctacaggtaaaggcaaaggccatggttaaatagtatctggccgggagcagtgtatcacacctgtaatcccagcactttgggaggctgaggcgggcagatcacctgaggtcaggagttgaaaaccagcctggccaacatggtgaaaccccatctctactaaaaatacaaaaaattagcagggcgtggtggcgtgtgcctgtagtcccagctgcttgggaggctgagacatgagaatcacttgtacccgggaggcggaggttgcagtagccgagatcgtgccactgcactccagcctgagcaacagagtgagattctgcctcaaaaaaaaaaaatttttttttctcctattgcttgagacacaaggtacttaatacatgtgagttctttcctcccactttatgtcttcccagtgtgaaactaggaggctgtaacacatagtgtgttctcattgcgtgcctctctctcttgctcactgtatttcagccttactgcctttctgtaattccttaaaaaagtcaatctctttcttccctaggatcctcatacatgccattctcactgcaaagctctttatttaactctttgcatgactcaatttttcaggtttagcctaaatggaatctccttttagaaggagctaccctctctcagtctctgtcatggtccctgtttgtttccattgtgcgtcatagtttcaggttttgaacttacttattagcacactagttcattgtctacctcccactctagattgtgagcttcatgagagccaggacttcgtttgctttattacttataattgacttgggtcccaaggaaaatgggcaggtatttggtttatacttgttgggatttgtgtttgtaaaagagtaacgtaatgcaaggctgatgtagatactcagcagggacttgtggaattaaatctccaagggtagtcggtctcccaggcatcgccatatgcaaagcataacctcattctgagtatagaatgaccaagaacaatggcctcttctgtccactccccacactgtctgccttgtcagctttggtaatcagagcaaggtaaggtgcagttcactccagtttgatttcacttgtagagagattttctatcagtggcatgtactggctgttttcaatgtttctgacagatgacaagccttttgtcccacttgtccccctttatgccttgactgactttggccacccagtcccctggtgcgagacctttaactggtcctttgtagagtctgtttctatgaattagggctcgtttccttccaaatgcccaagatgccttgccgtatctgctctgcatgtcgcaaagaatctagcaatctcaatggcgaagtgaacagctccttgcttttccagttatttccttctcaggcaagcactgccatgcttagtagtctggtcagctttctgctcttccgagactctccttcacccattctgataaggacctcgggttttctcctgtgacaaatttatggctctctccagcacctgttccatcctccctttctgcaacactcccaaccggcaaattcatttcattgtttagctatgtctactccctgtcaataaattacttcttcctggcttgcccaggcctttctatttttttcacagaccttttgggggcttgttcttaattattccagctactcactgaccaggcttcctctctgttatttgtcgtgaactcttgtgtaatctcctttcttctctccaccctttgctttcttatcattgttttacacacatgtaactgtcaaatcatgtcagttttataagcccataggtcctctcaactgcagcgtttctctcaaatagtgttagaggagggaaaaaggcattgctcttttcagtattcttcatctaccaacatttaatcaccaagcaattgctgagattcaactgtgtgcaacaccctggattggaatgagcagtggtggtgatggtgagtggagacagggtgttgaataccagagttatatttcacagcaaatattgaatcatgaaggctcttgagctggaaaatgactttgtgctccttagctgtgctttagcaaggcaaatttgacaccactctgaaacctggactgaggaggaggaggttcagaagtggaggaatataagctaggggagtcttagagaatcccaggcagcctggcaggcagctgatcatgttgaatttggattgtacagaaggagagaccaagaaggacccatgcacgaggtatttctgagctagcaaaacttggcagcaattagaggtgagggatggaagaacagtcatgatgattcgaatgttttggaccaggaagagttgtaggatttggtcctattaccaaattggggaatggaaaaggagaaggagggaggaagtgggggaggagaggtaggtgcaggagaatgatgatgggagaagtgacgagctcagttttagttagcatcctggaattgaaatggcaacggttcattgcacagcatttggaaatgtgggacaggcactcatgggagaggctagagctggataaagtttgggagtcatccaaatagaagtgggaagtgaaccagaggagcagccatatgcatattaaaaagcagctaatactgcaggcagcaggtgtggggctccagtgtggtatgaacaggccctgtgggctgtggacactcaggggatggtggagtaccatgacaggagctgtcagggaggacttcctcaaggaggtgaggctggagctgaggctttcctctgccttcacccagcatgccatttttgtttttacctatttcaatccctttccacatctgggcatgattttcatttgcacttataatcttcaaccccaaatattttccttcctctccatttgtgattaatctgaaagtagagggtagacagcagaggaaagatgccctcaggtgcaaactcgtgccccatcccttaaaggtagtgagtgatagcctctttttggaaagcatgttgggcagcagagactgaatcagaaacttcttatgtcccactaacaacagggagaaaaaaagtgttgtagagacttgcgtgcactttgccttcctaagaactctcatgtactgtatatcttctttctttgtccagaaactgactgctccagcatccctcagctcacactctcctttcctttccttttcacagcatctgtgtctcagggatgtgcaagaatataatgattcctgcttcctcagctggtctcatcagctgttctcatccactacactgagttctggctttgatggcaaggaaagggctccctctgctccctgaatgtctgtctccatgcctgtacacgcttacatgtatgatgggggaagagttttggatgctctccctgcctgctagctttgccaaagctattgaattaagcaggcaatttcctctcactttgtttctctgtaaatttcccaaccatatggtatgaggagagttcttggattataaataaacagcactgctcatgaatctcaggatttttgtttttccctccaatgggaataaatagaaagcatagatttgtaacttcagaaaaatgtgttggaggagaagataatgtctccctttatatacatatataaatatttttcttccatttctctttatgcagagtccctttttcctgggagttttctggccagagtccatttgttttttattactgccattttccaacctggaggtaaattgttgctctaaggcaatgtgataatagccacatgggcctggccagattgcactgaccagatgggtttggtgcatcttttctgctgctggagttgtcagttcccctctttgcaggacacagacttcctcactggtcttatggcaaaggaattcagggaatgggaaggatccacaagaccttggccttaataaagaatcacaatatttggcagccattttacctgatttcctgccactaaagctacagcgaatcagctgggcatgctagccaccaaggacaaatgccaggataggggcctgggactggaatggttgaggccaggggcaactcaaagaaggcataatttaaagtgtgagtgcagatttcgatctgagggaaaagcggagtgttggtgctgcaaggtcagtgagagcagttgtgtgattcaagaagtaatgagagaccacagtagggatggggcaagtgggcaggggtcagccagtggtggcccacaggccaaatgtagcccacttcttgtttatgtactgcttatgagctaagaacagttttcacatttttaaatggttgaaaaaaatcaaaaggatactacattgtaataccttagaaataaggtgaactcaaagtttagtgtccagaaataacatttgactggcacgcaactgtactcatttacttacatattgtctatagctgcttttgtgctataatggcagagttgagtagctgttacagagaccatatgcctcagagagtctaaaatatttgctttctggccctgtacagaaaaagcttactgtcccctggtctagagtaccaggaattatgatgggaattatggagagcaagcttagggcaggtgatgggtttaaaactaggtgctggactatagcatgctgggctcactcttttgggtgctgctcatacagtgaaactcattaggggcaggtcagttcatttaatgtgcaaaactgaggcaaaaactcatccctgagaatgtcaaagcaataatactttcagctttgttaagctttgggagacagggatttactctctcagtctgtacaaaaggtaacagtctgtgggcctatcatgttttcaccccgtcctagggccctgtcctcatacaaaacaattatctgataatataattcacacgaagtcattgactatttaatacctttcccagaattttgtcttttccaacaatgatctcaaacccaaaggaacgaatatttaaagacagacttttgggcactggacagattgttgcggaacatttacgagatgggaggcttcttgcatcacagtatatacagcctctaagagcagttccactaaaatgcataagatgcttcaaaagacaattttatagatagttgaagttatcaatgtacttctctttaaaagcaggataattttcacattgaaaagctgtatgttcatctaagattttaattttgttggtacgattcccctgcatccaaccctgactttctcatacatttatagtttggtaaactatggaatggtagaggaattttagagatcaatgacagaaactggagagaaagtttgatttcatttttcctttgtgagtgcagaatatagtctttcttgcaagtgaagcagttgttgggtggtcctgggaatggaatgctttgagcaagtcctgttctggtcgctaatgagttgaatgggttgcctgggggtagtcccacgtatgcttgccagccagcctttgagaacacacattcagatatctgccgcccatactgacttctcacattcacttagtccagctcattcattctagtggaggtgggaaatagagcgttaaatctccatgattgcacatctgttcctttgcacccttgacagaatggcttagggtaggtttgtggtggcttctctgtaaggcttccagtttctttatggagtgttgtctgagagccagtgtggtatctgaagaacgtgagttctaaagtcaggacaacctgttttcagacacccactttgccacttaccacatcagggaattttagaaaatctcttggtctctccaagcctcgcttctttatttgaaatattgggataaaagtaaaaatatctatcttattatacagtgcctaacacaatagtttgtttgtttcctttcattgtggtattctgagcatctagaatagtgtcaggcaagttataggcactgcatgaatatttggaaaatgaatgaagaatagggactcagcaaattgtatttctttttcttttggtaggtacggtatgtttctgggtatctcaagttagcttaaagtttccttgggggccataagtaattaactgcttttttatgtgtgagataaaatgctaatttcaaaaccctggaacctcactgttatattcctgtggcagggactgattagatattcactaaacctgtttcctcttcatcctgggcaagaaactagactacatttgtcagcctttattcattgactgaaatctggcccctggaaagaggctagtagtgatagatgccactttcatacctggcaaaaacacttcccacatttttcttcatgcttattcattttcggactcaccaattcaattgagatttccaagatctacaggagagcagaaccctaatgtggaaggaggctggatctcgaaagcactgcatagaacagagcccctatttttccccccatcaccctgctggctcatattgggctatgatatgagtgagaaatacactaacatagtgttaagtcactgaaatgttggtattgtttgctgttgcagttagttgcttcaatgcatacagtctccaagatgcatgtccagccctcccattcctacactcactttattctctagcctggatacctatttactattctcaagatatgctgtgtttttctagcatctagcatagctctgtttataccatagggactcagtaaacatctgttgattgatttctgggccaaagaatgaaacagcagcttcctataaaatgtaagcatgttttacatcagacagacctgatatttcagaggaaatattcatttaagtgttcttctctactatgggacttagtatatagtttttaaacagagaattcagcttatctggcacattaaaacttacagactcacacacatcctttcagggagattcctgccatataaaaggaaaattcagctgtatggagttctagatgtgttagaataacatcgcaggtaggctccatccaggagagagggtttcaggccagggatgtatgagctagcagtcaatgtcaggagccttggagaaatggagcatccatgccaagttttcccacctacatccagtgcttcatatgcaaacagcctaactttccccatttgtagaaagctgcacctaacttttctgttatgctctcacaccttggatgaattgcatggccaatgttgataacccagaaaatgacaactacttagctttctgttgcttccacaaagtaggtcaggaaatggaggggaagtgaattactctcccagacaggggttataccaggcagataactgtacttgctcaaaattgttttcttttatccatcagatatcttgaacatcttgccatcatcctaatgctaagataataataatagaaggcatttattgagctgaatgtgccaagcattaggtcaacattttctttactcatccattagctgccattgagtgctgtgaccatctccagaggttaccattttcctacatctaggatggccaatgcctagctgatatggggcacaaaagcccagccctcttgccttacagtgggacatgtatgtggtgaggtgtctgccccagagcctccctggggattaagcttcacaggaaaccacatccttgtttgtcttctgcttctttccagtcttgcttccctttctcccattaggttttgcctcaaagcactcccaccatagttcttgagcttccaaatcccagacttgggctctgattttagggaacccagcttaggatgttttccttttttctcaaagttggtttataatgtgctacagagatgctggctctgctggtttctgtcagtgataacagaattctctcaggcactcaggtttggtatctttaagatatctttacctgttccttcttcttcacctctgaccatgccagtaaacagattatgcttcttctacctgtcttttatttcttgcaacctacagtcatccaggatagtgagatggattcctgacaagtctttctacctctggagcatatgcttcaccaaaccatcatataaatcactaacagcttagtcctttcaaacaggctttatattcctatctcatttcttgtaagacaagttcaagcttcttagcagatatgtaggagcctccacataatcttattctactgatctgaacttatcccctcttatgcccgtgtaagaacattttatggcctggtgcggacgctcacgcctgtaatcccaggactttggggggccgaggtgggcggatcatgaggtcaggagttcaagaccagcctggccaacatggtgaaaccccgtctctactaaaaatgcaaaaaattaattacccagctgtggtggcacgcacctgtaatcccagctactcgggaggctgaggcaggagaattgcttaaacctgggaggtggaggttgcagtgagctgagatggtgccactgtactccagtgtgggcgacagagcaagactctatcttggggtggggggaggggggcggggaaagaacattttattatctacccagtctccttaattaccttctgaaaatacttgcatttttcaggttccaagcctttgagcatactctttgtcttctgttgaccttccaatactcaaccctctttcaaagcctacttttttcatgaagtcttccttcctttactttgagctcctctatcactaataaatgtcattgtcttcttcattgacattgtcaccatcatcatcatattaataatggccaccatttattaagagcctataatatgcatgacattgtgataaatgcttcatgtgcattgcctgctttagttaccaaacaacccaggaaaaactttttagatagttttgcccattttatagatgagaaaactgaagttcaaagagggtaagtgacctggtcaagatcacacaagtatctagtggtggaaccaggcattgaaaccatgtctgtgacttcgaagtttgtgcacttaaccactctggtaatatattccatttggcttaattgcttcctactcatttatcccttatttattcattaaaggtacttattgagttcctgcaatgtatcagggagtgtgcactggagacttagtagggtccttgtcctcagagttttatctaatagcactcttgagcccctttcctaactaccatctccccctcaaaccttcccctcacctacagtctctccaggagaggactgtctctgaatttcaccaatgtgctatgtcgtcttgcccagcctttcctggtggtcttgttattagatttaaaatgatgtttttcagcccttggctttcaggccttgctcatgccttgctttctagttatctagtgagagatggtcttgtctccctaagaccatattattctttctgacagtattcccactggtgcctagattaggtgatgcagaggctggcaaacctttgaacagctgaatgcttactccagagacattgccctcacttaggcagtttttgcaggacctcagtggcctctcagtggtgacagatctgcatctttggagcatagatctgcattttggaaggagccagaagccatttggagcttgatcagatgcatagaatgttggggatggcagggacttttgagatcattgattccaaccatctcattttacagagaaagagagtaatcaaactgtgaagcattgtttttggttggaaacaaagagtgtctgtaacaacaagactagaaacccaatcaaccataactcatggggcttgctgaatgcttaagtgtgagccactgaagatggctgataggaccatgttgctgccagtcctgatgattgttaactggctgagatacattctgtttctgactgggactctggctcctgtcagcaccttcacttgcccagttgagcactccctttacccaggggagcacccatctctggaaaagtgctgaattccagtgactctgagaggtcatggacttgaggaatgtttgtgtatgttgaggggagtgggctgtgagggacagggtccttgagccaaggcccttgcaggcttttgcatggattgaccatgaaaattgctgtcttctctttccagttatacttttttccttggcttctgcaaccttcttgttccaaagactccagaaccagttatctgagataaaatatgtttttctgttcaatagtcagatcactcagatgataggaagtggctgtcttcatcttgtgaagtcattgttattttccagaggagaaacagggaatggtggtaagacagttgtaggaaggaatgaaagcctgtcaagaaactaagctgattcttgccctgtgctttatgtaggttttctcactgaatcctcctaataacactgcttgatggcaactattatgcccatgttagatatggggaaactgaggcctggaaaggttaggcagtgtttttggtgttgtgttgctagtaggtaggagagcaggaattctaacctaattttgactccaagcattctcctttttatacttgtatagctttccaataggaaatgaccatggagaccccctgagcaggtgaatcagtgaaacccttgccatgtgatactttgtgaagcagatgctcaattaccattgtttaaataaatggccgggcattgaagtagagtgcatagaacttggaatcatatgacctgggttcaagttccaggattgtcatttggtcagtcacttaacgtctccgagtctgtttcctcatttttatgacagagataaaatatctatgtcagagggtcatagtgaggattcagtgaactgctttaagagaaagtgttttgtataaagcactatgcaaatgttagttacttaatgccacagtgatttagggtgacagtcttccgagaaattaattacagagtctaagtgtctgccagagtcttgatccttgacctcaagaagcttatagttgtggtgaggacaagagactatggaaatcagaggggacagggcaaattgtgctgtagatatataaaaacaatagaaaaccagagaaaggaaagataacagaagagcacggtagatgagagggctttacacaggagcctggagttgaactgtaaaggtttgaagtgagaggagattcgcgactgggcatagatttaacaataataaaaaaaggcatgttgtaagttacagtcctcttgggacccaggagttgttttgcatagagcagcagttctcaaagtatgactcagtgacccctggtagcctccatgactctcttcagaggatggatagagtcaaaactattctctaataataataaaatgttatctgctttttaaactcttattttcttatgagtgtacagtggagtttactagaggctacctggcatatttgatattatcacagattgaatgtagaaacagatacaagaatccatatatcttctattaaaccagatattaaagagctttgaaagaaaaatttgaaaagtaaaagaatgctaattttgtcatgaaattgttttgttttggaaactatagttttttaaataaaattatgttatttatattaacatgtaacagggttattgttattttaaaatgagtcaatattgtaaatttttctcagatgtaatttctgttgtaatatgtattgctagatataacacacttgaattaaatatcttggggtccttagtaacttttaaaagtataaaggagtcctgagtcataaaagtttgagaaccaaccactgttaaagacattctggtatggagatacagtaaaggtctcagatttttatcacactttggcgtcaatgtgtatgtcctttggtatcttagaacatctatgtacaggaatttcaagatgataatgcccaatgttgcaagcatgcagtgaaactggtacttttatacattgttaatagaagtgcagactggccagagtatgtctgtaaggcactttatagcaagagctttaatgataatttttatcctttgaactagtaattacacttacatgaatctattctagggaaacaaataatgatacatacaaatatttatgtctgacaacacacattcaagttatttaatacaagattttggctagaaactgaccaactggccagagaagatagttaaagtaaattatgatgcattcatacactggaatgttgtaaggctttaaaataaaatgatatttttgaaaaatatgtaacaatatgtggaaatgcttacaatattatgttaaatggaaaatcaggacccaaattctataaataatgaccccaaattttgtaaacacacaagagttaaagaaaaacacaccaaaatgttaactgagtttttctatatgatgtggctatcttgtgcgttattattttttttttaatttaagggtatttctaccataaattttcagtattttttttttaaaagactctagggtgtgacattccttttatccaaggctgtggtaaccagtctactgagccagcccatgtcatgtgggttcaggcgcacactgcctcagatcttgaaagggacacttctctaagagtcactgtgatagtttaaggcatattctatgacttgacaatacatccgacttctagctaattgctttttcctgcttagccattcaaaagaaagcttagaaaatactgagattgtttttcatgccctactactcgggtctgttgtcaagaacagtcagtgtagaatgtaggatccaataggcaattgttttaaatgatgtgcatgtaacacagcacagagagcagagcaatcactccataatttttacaaaggaagagataaatgaagttttaggtttctggacccaaaacgagatgaagttactatagtgttagaggctcaaaaaggagagctgtaattcactccttggaaactgggaatttcctcttcttcttgcctgtgttggaaaacaccatgtgttggaagactttagccctctttctattctggatggccagtaggacaactggtaaaactggtccagcacaaaggagcatctgctttgctattagtttctcacagcagaacagtttcagtcagaagggaatctgtctgaatgtgactatttcagtccctgggacatattttctcagtttgaggatttaccctgcatggcattattcagcatgatttaggggttaaaagagacgtccaaggtagtcccttgacttcaaagaccttattctgtctggagaaagaagtgtcatgcacacaaagttaaataatggcataaaacaacagcagaaaagagaaaaagatgtggtcccagaaagccgatacgatgctctctgagagtgacaaagatgctgagcactgggaaagcagaggcaggtgagatgagaggctccgtcggggaggatggcggcagaaggagacactctcttctctcccgggctgaagactctgggaggggaggtatttgcattaattgaaaagtgattaatgaaagcattgagtgccttccatgtgcaaggcattgtgcttattacagaaaaggaaaatatttaaagatgagtgggacacagaatttagtttcttgagggtaggaaggtggtctgaaggctctctatttattcatgttccttcattgggcggctgcacattttatcctggaggtttctggatgtgcccaaacagacataattgtgcacatgtcacagggccccgactggctctatgtaattttaaagagaaatgataaacatatttattttttagacagtgatgccttgctaaaactgtccagcacctgctagtgtaggcctcattatttttttccccaggaaaacttagtggaaaagttgggttcgttttccctggactttaatttgttaagtgttggccacctgctggaggctatctttgattacatgtagcaggccccccatcctcccatgtgtcttttggtagcttactgctgatatggtgggaatgagatggcgttagcctgtccactgggggttatgtagctataacacagctgctgtttgcccagaaatgtgtgaggcagtttctccttctgtgataatattattggtctaccttggtgttgcccaacaacagacagtgaagtgaaccctctgatagtagggctatataagcttcacaaaagccctaagaacacaacatttagattcccattgagcagacatgaaacatgagtttatataattagtctgaggctccacagactggatttgaatccaaatctccttgactctgaaatgaatcctcttgtgattcttttggtctgcctttttgaacgcagaagcttatctgtaactgggttctcctacagatgtgttaatttgttgattaacattgtgactgtttggtaacaatcactttattgctataatttttaactacatgagtcatacttggatacacttttgtttgaaaacatctcaacattacaagtaaattcaagtgcttctagctacctaaccccagcccaccccggttccctacccagtggtaacttctattagtagttttatatattttccactagattttatatgtatttgtttacacgcttataaacttaatggaaatgtattgccttgttgtgtctggatatactgtgtgtgtgtaatatatttagtattatgtcttagagacttttcaggtcaataactctggtatctgtcttactcttgaatgctgctgtatagtactgtgtgtgtgtgtgtgtgtgtgtgtgtaatacactctatttagcctttccctgataattgttattcagttatgttcatatcaacagagatgcagtgaattatgggctgtcataccttctcatgggcctgtttgtgcactttcttttccctggagggcttctttccttcccttacgtgcatgatacaaataggtcttttgcctgataggttagagtttttggcattttaaaacctaaatataacaactcaccatcctattttctgaactgaaggtcttcagtgagaactaatgtgttcacaccaaataaagaaaggaaaagaaagaaactgaagatctgaatattggcccaaccccatatacttcagcctctgtcctacctgagacgtgtgctgggaagctgctgctggtgggtctacaacttatctgatccgaaccatgaattctgcatgactggtctccaaagacagcaaacctccaattttccgcatttagaaccggtgatggctctcattcaaatagtgggggcaggaggaaatagagacgaattaattatcctgtatcattgtgcctctctttgtgagactaaacaatgcagccatgagttgggtaaaaagaggtcagggagagctgtgtaagcttctgcactggcatcaaccttcctgtggagtttctgaagcagagggtggggcaatacccacttggagaatgaagctgtttaaatgacttacttttggcttgaggtctgaaattagttatctggatggttatttgtggtcaggctgggcttctgccattgcaaagatacagattaatgtgactttgggcactggccctaaaatgaggagtggaataggccagagggaaacattaatgcttttccatcacaactctctgagaagtctttggtctggagctgtgctgtgggaactcctgacgctgaccttggaatgggctgtggttcaccacacaccagagcacctaatagcctatggtctttgattgttgacaatcctcagtgtatctcagtggagtacacctgaaggagctgctagtgggtgctccccaaggcctggcacttggaagcatagttgtatcttttgattctccaggcaactgggtcttatcatacacttatggtgacaattggaaacagtgtccacagatcctttaatgatttattgggtatccgtgtgcctcacccctattaagtgtaagtagtgcaaatcaagaaaaagaaaacaaggtgatttcccttgaggacaatacaatcaggggtattcataaaaatgacagccataagcatttatggaacaagggcttttagcagatgctaagctaggtatcttattactcttcattgaatctgaataacaacaactctattgtctgagctgaggttcagagacatgaaaagcttgcacagctagatctggctctgagtctagttgtctttgtactactccagtctgcttgttttctttatgtagaactgtgctctgcactttcagaaattaaaaaaaaaattcatttgtgactgttcttttgagaagcttttagcaattgctgaaaatatcaaaagcacacatgtatattcagagaataaatagggagctcttaggtgcaattggtgtaaatgcagaggagggcgtgggtgggaattataggaaagatctttgtagtacaatgagtactggagctgggagtaaaaaaggagacaatctgaacattggaggcaatggtaaagcaaagcaggtaaactacgaaggccttgaatgccagacagaggcagatgtttgacctgatgtggcagccaggcagggaaggatgctctagggtatcagagatccaggcagaaatcttgagaagttgtcttagagacaaaagcagggtgagaacatgactcgggggtgggacagaggtggaggctgatattctctacctctagctgataccagctagagcagcaccaccaaatcatacccctcctgcttttgcaaaagcaccctttcattttgctattgtgcttggcttgtttggagctgcaaaaggtcagagttgagtagttgtggcggaggtccacaaaacccaaaatatttactatctggttgttttacaggaaaaaaaagtttgccaacctgagctagagctactttaaatggccggaaaggggaagcaaagcacagtgtgcctagcccatgtcagatgccgtggttgataaatatatgcaaaggaatgagccaaacatggcaacgcagaagttgctgagaggaaaggaacaaccacaactgtggttgtttgccaattttagattgtttgccagttttagattgtatccctcagaaggcaggccactgaggagatgacttctgactggtgaaagatgccagggttaatgatccttaattttgcagagctcaggggcaagaagaggagaagaaatgaggagaggactgaggaccagggtggtaaacaccagaagaaggtgctgactggataaggaaagccatgtgctcacccagattgagaacatcagatggccccgtgagagctggcagagtgtctatctctggccagaatggggcattaggacagggaggttgagctgcagttcagctctactgagaggctgacttggctgcatcgactggatgtcttttctgtttttttttttttcttttaaaatagcccatattcttattgccaccagcctctccccgagaagatcactagaggagtagtgaacttgctgggtaggtaaaaagcatacgataactcacacctccactcctgactgaaattgtcagtgggaaagtggccctgtgggaatgaccaagtgtatggcaggtcagactgggggttcctcccacaatgtaccagtccgcactaagtccttcggaatgcctctggatgagacaagaactcagtgaacagtttcaggactcagactaggagttgatgccatagaatagtcccaagcacctctacgaagttgaagagggaggatgtccagtctgccagtcagcatcaggtacctggagagtagcgtgagtgacaggtagctggcaggacctgccagatgatgagcaggtgcctgagcaggcggtgaaaccaaggagcagtgtctctttggaggtacagtctccttggagaagatgttgtaaatagccagtgaagtagaagttatgccctgaggtgacccacacagagacgtcaccccagaaaaacttttcttcacaaatacacaagaagccacgcataagaatgtttgttgtaacattgtttataatagcaaattaaaaaaaatacttctcagtggtttgaaaggataagcagtggtttattcataagctgaaacactagatagcagttaaagtgaatgaatgaccactaggtatgtaacacggatacatctcacaagccgaatgttgggtgaaataagcaagctgctgaacatatatcctatgtgagaacacttatgtacatgtagaaacactcaaaaaggttatgtgttgtttatgcacacaaacacttgttaaatctaatagtggccaaatgatgggcattgcattgtgtttttctgtgtgctggaaataataagaaaaaaagaacaagggatagagacacacatgtgtgtgcacacacacgtgacagtggagtggggttggggtaactggagccagggtacaggagccagagccccgtggctacactgacctcatgcgccaccttccaggttagttgtgtgcactgaacaattcagaatggtaactggcagagtgccaggcccatgcctggctcagggcactggtgtcatggctccagtgttctgaacatttcagtcttatgaacctagtgtcaggatttgggaggctagctttaaaattgatgagatgagcctgttttctctaagtgaccccactggctgatgtctggaatcacaaagtagagaggatggtttgctttcttgtaagagcaagttctgccagcataaatgtctctggcaatggggctgagacctctctaccatttgcccctcaccccaggccaagtgggcccacagaatgctgtggtcagggcagtgtgcagtggccatcctggaaaggacagagtcgagggcactgttggttccataggctcccaggctccctgaggtatcttcatcaaataggacttgttcctctgagaccaaatgagcagaacctgccagaggcatggaggagactgagacatagagggtgtcctttgttgggcagtccctcttttcagcagccacttttggaaaatagcaaagtcagtgttaatctgtcatgcagcttgtgaaagtgagaccatgtgtgatgatcagcgtactatcttttgtgagagttatttggattcgggaaggaagtttgttgtgacttccatcagtcctgcagggatccctgagaatttagctcttctaagacttttgctatagatagtatgagaaaaagatgatagttggaaaacaacttagcattgtgttggtggtttaataaaatttaagatcccataagggaccttaggattatgtaagtaaacctcttgtgttaatgatggaatggagcttgacaaagatgctttccttaaccaaacttgagttaggatcctctgagctctttttttaactaggctcccctgcttgggcatgttctcaagagtccaattttttaacaagaatccttctaagtcatgttagccagaatctcccagcctctgttgctaatgaaagtcctcatcctccactataatctagataatatctgatcaccctggcctgcattcagcaagaaacttgttagattagtaacaaagaattaccctcccctgttagcaatttttcatccactgacctctcctctgcctctgataaaaaattcccacttttcctttttctatttggagttgagccctgtctttcccctactgcaaaatcccattgcagtagtctctctacatattgcagtagtcctgaataaagtttacttaatcattttaaccagtgtcagaataattttttaacagccttctaaaagtggcttgtgcagggtaacacgttgagtgcatttgaaaatcagctctacagtctcgacttctaggctccagcttcaatgttctttctccacaccatgctgccttaatgccttcaagagtgtagaattaagaagtaattaactctgtaaaatattttacttggattaataaaaatgcaaatgacagcctctagagatcatggtctatctccagtcttgcactgcctaggatagttgctcagggtgatttgtcatttaaccgtaattctactacaagtgaattacagacccttccctaggacagaccttgctagactgtaccgtctgcactgttgtgctagcatccaaagcctcaagcgtgttttctaggcattgtttgctgtgtgttgaattaccactagacatcagtagttggttaaaaacttgtgagtaggtttggacaatctcattcatccattcattcttacaaataaagacaaattaaaacaatacaaaaactattactttcagcagttgctttgtaccaggcatggtgcaagacactggagctgttaaaaacatggttctagtcttcaaggagttacagccaaggaagagatcccagaataaggacagtgtagccaaaccaataggataaatgcttaaatagaaatgcgtacaagatagtacgggaccacagaggagattgtgattaatcccccccgggaaagctggaaaagggtgatgttggaattagatgttgagggttggaggaaaatttgccaagtagaggaaacagggatggatagttcggacaaggagatgatgcgtacagcagcggagggcagtgagaatgtaggacatgctcaggaaagtttagcgaggctggagagaaagggccagaggagcaagtggctgggaatgggtccagaaagggacgttgaagccagattttacaagacttaagcttggaagattcagcttgactgtgtgcattgggcaattactaccaaggagtgaggtggacagatctggggtagaaaaatagcctggtaacagcatggaggatgaatgggggagggagaagactggaagaagagcatcaaattgggggatcgttgaaacatgatgatgtatgagccacagcattggtgtgatgatggaaaggataccaggggtctaagttttttaggaaatagcattattaagacttgaagagtgatctgcgttgtagaaaggcaaggagaaagattgggagtgattcccagagcttctgtgcctgcagtagacaagagtcagagaataagtcagcttttgggggattgatgattaaagttagcataactcatgaccatgtggagccagtagcctagggaggggtttgaaatattgatatttgtttattcagtaaacgtgaaacgtgctgagtgtgcataatgtgtaaaactttgtgctgtacattttggagaaaggagaaatgaatgaatgcctcttcacttttgtttattttttaacattttagtatacctgcattctgttaggaggtttcccatgtcttatatttttgtaacctcacaaatgcctcatgagactaaattatccccattcttttttttttttttttttttttccgagacggagtctcactgtcactcaggctggagtacagtggtgcgatctcagctcactgcaacctctgcctcctgggttcaagcaattcttctgccttagcctcccagagctgggactacaggtgtgtgccaccatgcccagctaatttttatatttttagtagagacggggtttcaccatcttggccaggctggtctcaaactcctgacctcaggtgatccacccacctcggcctcccaaagtgctgggattacaggcgtgcgtcaccacacccggaatcttcatccctcagataaggaacctgaggctccagtggtgcaaataacttgcacatggtcatgcaaccagagagctatggatgtagaatgaaacagagattttgctacacccaaaattcatgttctttcctcttatgaagggagttttgtgatgttctttaattctttgaggagcctacattgtgcttggggaaacagagcatagagaaatcaatcatgacactattgaagagttagagaagaggcatgtacagtgtgccttgggtgcctaaggatggggaaatctgttctggtgcagaaaagagaggagcggtgattgggaggagggctagagaagcttttacagaggaggtgcaggtgggtgtttacactgggcccagggaccaggaatctgccagcttggatgagggtgggggtgactgttaagggtcatcacattgggaaggaggctgaggtgggaggatggcttaagcccaggaatttgaggcacaagccatcgggctgatgtgatgctatgattgtgccactacactccatccaggctaggcaacagagtgagcacctgtctcttaaaaaaaagacaaaggttatatagttttaagtactaagcttctgaagctgagctgttggccagggaagcactgattagcattagaaggtggataaaggctcaaagcaaaggctgggggtggtggttactagggcatcaaatgccagttcaaagcaaggctcagagccagagttgggaactgagattgtggcggatttcaggcccctataaggtcagttgagtacagagaaaatgcattgacctctgtgctcttctaaagcttgagttggagaagttttgtaagtctagccaaggacagtgatgacgggaagaggaggtgagaactgatgatacaggtggtggaaaaagggagggaggtctctgtgggccagggtttggggacaggtgaacagtatggcagggaggtcaactacttgaatcccactgtttggcaccctctctccctcctccaccatggaaggcaggatggaaagaaaggagcctctacttctggttttggcataggtcagtgtgctggaaaggaggagcaggtagccagcaggatcattggagtgatgaacccctcctctgtaagcagcccagtgccataggcttttcaccctggacacacccacatcgttgtccctgtgtaaagcatccaaccctctgcctggtgtggtctcatttagccattggaccccataagttttctgggcacttcctacccctccaagggtcccttgcttcaggctcaatggagtgggttgaagttggttgtaccctggtgatgacctcaggagacagctggccatgctcccatggcctccacacacaactcccgtatagagggtccgctggtgggaacttgtgtgcttccacaactccacacagagctggggtgggggggtggggcggggctgagcagcatgagagtcaggccgtctccagcagctcctttcaccaaacaacttcacaaagggcgaaaaagtaggtcctgagaaaggctggaagcaaaggggagcacgcttaggtagtaagcaggtgcattagtctaattgctcttctaaaattaatggggctttttatctctgaagcactcatatgattcgggaagaaaggtgctggtcggtcgagggagaacctggcttccctttagacatagctgcccattggtaaaatgatctctccctctctgttttctcttttacctgcaggtcgacagattatggcaccacctatgaaaagctgaatgacaaagtgggtttgaagactgtcctcagttacctctatgtcaatccaaccaacaaaaggaaggtaagagactgggtcagtaggtcctgagcactcctgctgggtagctgtgctgattagggccagaggttaaggaaaaaactcagttgtcattgaatcatttacagaggtctggtttatatgctgggaacttcataaacgctgtttgtaattctaacaacaagcttgatagtaataataataatagtgacagcagcagtgatagtaatgccaccagtaaaactatgtacctatgtcttatctcagttatcgttacaatgaatctatgggatagaaactattatggtccccattttgcaagagaagctcagagagatgaagtaactttctaccctgaatcagatggtggtaagtaacagatctagaatgtaagcatgggtttgctcagcttcagagttgagtctttccacagccttcctcttgctggtacattttttgagaaccccttactccaagggagattgtttctcccacgtgaaggaaagaaaggcagctcctggcttcttcaacttgatcctgagctgcttctgaggcagagggcagaccagactcctctggcacctctgcttctctgctttcctcttgatttagcagccaggatgaaatcatataaggtcagaccttggccatggaaatctactgagaggaggaggcctggattctgtggaacaatgggcagttttagaaaacaaatactgcaccatgtattatctttggggagatgtgctctttctccagctaagaaagcactgctatttagaaacgtaggcagacatgattcaaatacatgcaccaaaatgaccatattaaaggtcattttaatatttctaaaaggctaaaaaaaaatggcaccaccaagctctcctcttgcaatctgatttgcattcccccgtggttttgccagtgctttcttcctcaaggtaagctcaggagcaagcttcaaaccattgtgcggatgtctctgatttctaacatggtagagtccaaactgtggctgataattatgactgtttatgctgctcagagcagagcagcttttacctgagccactagcagaataatgtgcatccatagactttctcctcacctccacctctagtgcccctaagtacacccagcaaagggagggagcagaattgttgacttatggttcagcattggtgatagatagccaaaggatccagttagctctagggactctcaggccctagactgtgcccactagccaagtgccaaagctttgatcatcaggctggctgtttaggcacctgttattgattttatttgagtagtttcttttttctttgtcccaaagcattgccattttcacatctttcagtatcattatttaaattattggattttagagctagaagaaagcacagatttcacctagacaagtggttattaatagtttcttttaatttgtttattttaaaattaacatataacattgtatgtgtttatattgtacaacatactgttttgaagtacatatgcattgtggaatggttaaatctagctaattaacaaatgcagtaactcacagttactttgtggtgataatacttaatatctactcttatcatttttcaagaaaataatatattgccattaactatagtcatcatgctctacaatagatatcttgaacttattcctcctatataactgtaattatgtattttttgaccaatgtctcccaaacatgcctcccctttaaccattcgacccctgttaaccaccattctattatctaattctgagattaactcttttagattccacatatgcgtgagatcaaatggtatttgtctgtctgtgtctggcttatttaacttagcataatgtcttcaggttcatccatgttgtcacaaaagacaagatttccttttttatggatgaatggtattttattgtgtctacgtaccacattttcttcattcatccattgatagacacttaggttgatcttatatcatggctgttgtgagtagtgctgcaataaacatgagagtgcagaaatctcttggacatactggtttcattttctttggatatatacccagtagtcgaattgcttgttcatatggtagctctatttttaatttttgaggaactccatactgttttctataatagccatactaatttacattcccaccaacagtgtgcctaacagtttttggactgcaagtcttttacacatgtgattaaagttctaggtggcctctctagaaatatgcctatgccacaaaaattttcatacattttgaggacttcgtggacacctcagatcccactcatgaacccaagatatccatggagtctcggttagaaatcatttttccatgccaacaacattttacagatgagaaaattgaagcaaaaaaaactcacatagccagatagaaaaaggagccaggattagaacccaggactcttgattgtcaggccagatgtatttgcatcagctcatcttttgcagcttttcttcttgtacagtgatagcgtaggggttcaaaattgctttatgatcttgaattaaagcttggtgccatgtccttgatgggcacatgattaaagttgactgaatcaagccagcagtgatggttttcagttcttctcctgcccttctcccttcttgagaaggaagcagaggcccacagaggacaactgccccacccagccaactcaacaggttaggagcagccttgtcagttggtctgatgactcctaatttagtgctcctcccatcccacacaagtgccttgagcatactggatctcagtgggcatatgcactttgggcgaagcaagaactggatatttggtgcatgaaaagtgccctacagcgctgatctctgtcttgtatctgggccacaacagaattaatcgtattttcatgtagatgattgataggccacttttgtgaggattttcctaagtggctcgtgaaggtttgtacctgtttgtatctgttttggaattcatctgtcatgtatgtttcctcttcgaaaatatcataatgatgtttctttttgtcttttgctgtttttttctactcctgacagtctgaactctccttagtgcaactaagaagttcttagaagtgatagagacaagggatggattaaggcagattctgtgggttggaaggaacgtagagttgagatttggctctcactggcacggggataccacctccatttatccttcctcatggtgacattcaggcagtgggctctcaggagccatttctcacagaaactagtgctcaataaacagaagttaggcctattttgttgtctggtctgagaaacatcaccaaagtgtagttaactcccatctgggaggcactgccacccagaaagttaaacatacagacattttcttcactcagattggggaaaaataagcaacaggccaatggcatggattttttttttttagaaaatagcaatagaaattaacgtttgtagccaggcacagtggctcatgcctgtaatcccagcactttgggagactgaggtgggcagatcacctgaggtcgggagttcgagaccagcctgaccaacatggagaaaccctgtctctgctaaaaatacaaaattagccaggcgtggtggtacatgccgtaatcccagctactcaggaggctgaggcaggagaatcgcttgaacccaggaggtggaggttgcggtgagcagaggtcacaccattgcactccagcctgggcaacaagagtgaaactccgtctgaagaaaaaaaaaagaaattaatgttcataagggtcctacatgatctaaagtgctttcctcatcatccaagaaaaaatgaaattggattcattttcattttactaagtggtatgtattgtaatctgagcctcttgatgttgacagtgcacacgtagtctacattctaactttctcgtaaccagtatattcagcttagcagaaatcccccttctccagccacttaggcaaaaagaaaatttgatataaataaaaatactcttatttgttcctttattagtctagagctctggaaccatgtaacacaacttcgtttttaagtttccttctttacgtcttcaagtttaaacttatggtaatatggatactcatctcagcttgtgttaggcaagatggtttagatttggttagtacccaaattatctgtagcaacccatttcatcagtcagccaatggcagtagtctctcgtggatttttgagttcatcttgtagaagcacttgcttttcacctaatgagttatttatttaacagatggctgctgctttccttggaggctatgaatacatcaaatgagatctgttgcccctggcaaaacagtaaattgagtttgtattcatgtagttgctcccaaagctaattgttgattttttaaacaattttgaacaacataaaattatccaaatactgatagttaattaaccattaagttggaaggaagcagaggtgttaacctgtgtatagtttccttctaccagtaatcatcccaggtagcactaactgagcagctactatcctaaactcccttttaagagttttatccacatgatctctaatcctcccagccactttgaaagtaggcagggtaagaaaatagactttgataaattaccccaagactatattgctataaatggtagatctacagcagctttcccaatgggtttattttgaggacaaattagtcattcagcaattctgggcttcctggaggtagctgagatttagactgggagtactgtctttatcacaggctgtgagcagggtataatcatttcatctagcgggttttataattccctgtctaaatgagagtattgatatgaaatgcacgaagctgcttcagtcaaagttgtcctagactgctgttctgtggcatggtggcatcagcattattttaatgaccttgacccactctgactatttgatgtgaattttgtatacccggttgtttgcctttctccagccattggccaattaactcattgcccaggtttgagcccaacttccttatgggagcccagaattgctgaatgtgtctggttggtacttgaagatgaggaatagtatattagctctggaagcaagagagtgtatggtttgcctcccagaggagtggctccattatggtggggctagtaagctctagctcacagcttctccttccccttgcatgagataaacatccctgggttcccagaactcattactgtcagttgtttcttgtcctcaggcccatgcagaatggcaagtgccaaggtcaagtctgctgtgctttgtaaaaacaggctgaaggctttgtgccttaactagagaggagcctgactcccatgggcgagcttatttgagaatgaatctttgagtggacagagaaatgcaggcatgttattgtctaattactctggctccaaagtgactgccacctgcaactttggagacagtgcattggaaatggcagagagcacacactggtctaacagccagagaatgtgaccaaattactatagttagaggtacatgtctctctctctctctctctgtgtgtgtgtgtgtgtgtgtgtgtgtgtgtgtgatgaaaactataaggtctgacatcagtataggctaatgagttctttctattgagcttctaataagttctaggcactgggctaagttccttactacactttattctaagttttactattaatctcctgagcgtggtagttttatcctcatttgacagacgaagaaactgaggctcaagcagatagacacttaattttggaaaatagctaataagagggggtccaggattcctgttcacctctatctgcccacagggttggtgccactaccacaggtataaagaccaggtgagttgtaatcatcactctattagtggtaaccctgttgcctggggttttctgttcattagtgttagaggattagcagtttcttggaggaggaggggaatattacatcctgcattcctaattgatttaccagtgagaaggataattactttcaggctaccctgcagaaatatagtgggaattaccagtgagattcttacagtgagcaagctgcttttgtcaagctgttcgagaggcaccgcgtgtgtggtcggaggctggttatgccaatgtcgctctctggatacaacacataaccctgaactatctttaaaatgctggaaaacctttaaccaaaacatagcacagaattttaaaataccagactcctaagatagttgcagggtcagggaaagtaagtggcagggtaacacattttcagtccacaaatattaaagtctcttacactaaagtaaggccaaaaaggtggaaaggtaattttaggctgttgaacaatcttttaaaaatgtctacctctgagcaaagtatgttttgagggagggagtttcctgctttcagaaatgtgcaattcacctgggcagacaagatgcaccgaagaaaatgactgctacatagacctaggtctcaaattcggatgcatgcaggggccagaagataatggcaaggaagatgtgggccaggtagagacttggaagcccctctgtaaagggccttttgccattaggctccaaatgactgttgtcatgtgaaaatgagggcccagcatagccagttattgttaacatccttgctattatgttctgagttttaaagatatttttctatatagattttaatatgaaacatccgtgttttgaaatatttaggaggtggagttcagggtttgggggctaacaggctgtaccaaatctactgttatccctgtttccagttggcagcatgtggcatattcaagtggtaactaagtctacaggtgaaaagttggtatttgcaaagtggtctttagagtcacaggagaacacttcgtagactctcttgctggggacctgcactgatacccttatatgtgtgagagataaactaagtcaagtgtggcttacaaagatttccctttgactcagaggaagcacatggttgatccttcagtgcaaagggactttttgtgtcattgtagggtaagaccactagagtaggggtagggggcagatgtctgctttctgcttctggttttgcccctgagcaactcagtgtctttatataggccacttccctcccagggctttcatttctctatttgtataatggcaagtttatgttctatgcttttcgaagccccttccagctcaggtcgtctggatggccaccatttagacagtgtttttcagagggctttgcagtaccatgtgatgatccacatttaatttctgtggctcattggatagccagttgggaagtccttaggaagtgtaatcctcatagctcttagttatatgactacatgttggctggccaagcccttaggaagtgtaatcctcatagctcttagttatatgactacatgttggctggccaagccctgttacctgggctatcttttctgaagttacagttccttggtcaaaaggtgggtccctgaaacacactggctctgctggtagaagtcagagcagcagcactacttgctggcacaattaaggggttctatcagcatgagccaatgcaacttcataggagcatcacacgcattacccagggacgcttagccctcctcctgcaggcaagggagttagagatgctgcctgttctggtaacccagaatagaggacaccaagtgttgcaatagggagtgggagcttagctctgctgtaccacactccctccttcatggccattgacttaatgacacatcaaccagacatctctcctctgtgagcctttctttttctcttcgtaacatgtgcataataacctgtctgttaaggagcaaagaagtctctgttagtgctagtatctgtttctattcataaaggcaacaagtgtctatgataataatgacaatgatagtaaaaataataatacaagaaggagctagagttttttgagagtttgctatgtgctgaaaattatcctaaatgcttccaatgaattaactcatttaatacttcaacagaaactctatgatgttggcacgatcatcatgcaatttgcagatgatggatatttggtactgagatgttagccatttgctcagatttgttgctgatggtcatgtgccttggtctaatatgctcatttaactcgtttccattcatatttaattcttagactcactgcatattggagcttaaagggctctcggagactgtgcagaccctcattgaacagaagaggccactcagggacttgtctgaggtcatagagtcacttgcctcagagctggggcgggagcagtttacagactcctagtctagtattctctgccaagcccataaggctggtgacagctggagaattctgatctgatagagaaccttgactgagaataaggtgagcacaaatatgaagtggtaggaaaatagcattccacgtcggtcctgctgaatgtcagttgtgtctctacggcttacagagatatccacagcctctcagtactccactctcaaagcccaaagggtattgcagctggaatctcatttcaaatgaacctgggtgggaaaccaaggacttgcattcaaaactgcccagaatggttgagcagcatgacaaaggccaaatggcttgataaaggagcaagaggctgggtccctgggaggtgggctatctgggaaaagaatcaggatttctgttttaagcctttctgttaactacctgtatggcactgagaagtcatttaaattctctgatcctcaccttctcaatttgtaaaatggggataaaagatcacttacctgtccccttctttcagaagcataactagcatgttagatatattgtatgggagggttgttagcatttttttatgaattgttcttaatactgtccactagctcccatgcctggccagcaaaatgctttaatttttttaaaaaaatttactttaagttctgggatacatgtgcagaacgtgcaggtttgttacataggtatacatgtgccatggtgatttgctgtacctatcaacccgtcatctaggttttaagccctggctgcattagatattcttcctaatgctctccctcccctttcccctgacaggccccagtgtgtgatgttcccctccctgtgttcatgtgttctcattatttaactcccactatgagtgagaacatgcgatgtttgattttctgttcctgtgttagtttgctgagaatgatggtttccagcttcatccatgtccttgcaaagaaaatgaactcaaaatgctttaatttttaactgtagaacacatgactcggttgtctttttctcttttttaagaaaagtaaatgccgaattaggggaattaacataggcatgttgccttatgttagaatgaccaggttaaaccacttaatttttttgtccaaggcaaacatgatataaggaatatgcactaccagaataactccccctggtggcagaaaccatgctccaagcccatctgaggcgctgactgctttttgccccttttcaatgggcattgccctgatagtgtgaatcccatcaattcagcagatgagtggggaaatgaatattttcccccaaacctttaggaaaaagcaggtttttgtttgtttgaggcttttgggtttctttttcctcttttgtttttcatttttaaatcttgaatgttattattgaaggctgcaggtatggcagacaatgagcaggtgaagaaccaatggtaaagtgtcccaaaactgacatgttagctaacaggcttctgaatgaattgctgtggtccacagaggaggctggagaaggtagcaaggagatgctgtatcagttactacagccttaaaacaaagttggtgtctctttggactttcaaattgctcctatgcagcttattttatttttgtttaatcaaataagagagcctttccatggcaaaaaataaagaacatatctaggaaaaatgagagttgtaattttgtttgaaagaaatgagctacagaaacagaaagattgttactactgggatggagctggcatcaagattgcagactggaagccagggtccggctgcctggctgtgcctttagtgctgaccgcagtggctgctgggcctcccctcctgagctgtgagctgcctgctttcaggcttccttggagaggatgcagctcccagaggcttggatttttaaagagcctcatgtcctgccttatccaggaggcatgctgccactttctctttccccatcttcttccttgtctcttaaaaccagacttgctgactgcctgagaaagactgattgttctgctcatggagagaaatggtcccacttttgttaattcacagccatctcattttttcctgcttcataaattaacatagttaccaagcggctagagcagtgttttggagatgggtttaggggaaaatgtatgaaaggaagaagtaaaaaaaaaggaaaagaacaaaacatgaaccaaacctccctcatttactgattccacgtccaaatgtttttcttcttggtgtatccagaaaaagaaccagaaaagactccttgcaccccaaaagggaaagtatcagatcccattagggctaagaaagcagaaaggagaatcaatgagggggcagacaccggtctaggagtttccatctgccttcgcaagtgtgacccagcaatggaatggctgcgaatgtgcttccattcaaactcatcacttaaaggaaaaagaatctagagtaattcttggaaattcagtcttaagtcacaaatgtctctttctcagcaaatataggtatatggttctttgtataaattactgcagtgtgctctggccaagaatttatttaaaggctcattaaaatgattactagttttttcttttgcattttatttgaaaatgggaagaatataaacctatcctggctcttctccaaagtgccctttagggtttgcatcgagtatatcgtaatttttttaaaaataaagataataatgatttgcattaagattatccagacattttagaggaataataaaaattagtcacttagtgtactttttaggtgcttatgtttgctcaatatcttttaaaatttttatttctattgttgaagtttttatgtgtctgtatgtgtgtatatgtgcatctaggtgtgtataaaacatttttcacaaagtattatgaaaacttgagagttaagaaatatgaaaaaatgtctgtttctcttccgtgtgaactctgatttgggctgaaccaaggatttagggaagcttgtattcctggatggccacatacaatgctggttccatttcactgcctggctcatttagccatcatagttgctcaataaagcctctgagaagggattccatttgaggttaaatggcagccaaggacacacagtaattgtttaggcagagccagtgataggagcaggaaaatcaagggtgcaacccagatgagaggtcattgatctgtatcttgagagagtcaggctggataagagaaaataacaacacagtgaacattgatgggggcttctaagccaggcctgaaggaccagtggagatcatgggagttttacactttgaaagcctttaaaaagaagacagcaagctgagcacggtggctcacacctgtaatcccagcactttgggaggccgaggcaggtggatcacctgaggtcaggagttcaagactagcctggccaacatggtgaaaccaagtctctactaaaagtacaaaattagccaggcgtggtggcgggtgtctgtaatcctagctactcgggaggctgaggcaggagaatcgcttgaacccgggaggtggaggttgtggtgagccgagatcgtaccattgcactccagcctgggcaacagagcaagactccgtctgaaaaaaaaaaaagaagacagtgtgtatccaagtctagaagagtgaatgcagcaccaagcttgaagaaggatgtcatgctgtggcataatcaaagctggtaaaaggtagaggcaaaaatcaggcagaatttggaagaaattttgggatttggaaaaggagggaaaggaaagggcaatctgataaggtaatgagagtatagaggttttaagtatgtgggttttagcagtttcaagttgggagagagaatagggtacgactagatattatagactcccaaaagcccagggatggagttaggactcagggcagaaggacctggggagccatagcaggcttctgagcaggggcttgaaagcatgagacctgtgtctcaggaaggctggcgaccagcctctcagactgatgagatgcctgtgttaagcatcccactctgtcctctcttctcacatgcactgccctcactagaccttctgggtgtgttttctgaacatcacaagcaagagcaattttagcaaagtgcttgggaaggcaggatgatgtgttcttcctcatgttccaatgcacagccatatagcaaatggatctcactgcccctgaggtagagatatctgtaacaaatacaatcaccaccactggtgaaagaaatgactcgatttttttttcttcaaccaagcagagagattgctactggcatgcatgcctcctcgcccccagttcgtgcccccattaccagcccaaggtcagaatgacagacctcagcacttggtacacactctgctggtgagcgtgtctgggcaatgagggccaagtgtcctgggatcctcgggtctgccagatggctcaggggtgggtttgaagccagcaagtctctgtccccacatgttggggtctgagctggcagggaagtctgagacattggcctcagtgacaaatgaaggccttggtcagtgctgcagccctatgtcgagggcctcctgagagcagatgcagacagtcagccctgtcatcccacagcatgaatctaactctgagaaatggcttgggctgtcttatgatgaccaaacagaggaaacaaatgaatcagagaggacagaagtgtgagaaatgcatgtgattatctccttggcagggcagccagaggtaggaaaagtagtggtcagtttagagctccttaattattcctggtttcccccagggcccaatgaggtagtgtgatgtgcaggaaagagcgtgcagctcatgcttcagttgctgtgtgaccttgaacatattacttgacttctctaagccttagttgtttaatctgtcaatggggctcacaatagtattttataaaacaaaacagctttaataattaaatagcataatgtatatagaatacctggcagagagtaggtatgactggcttttcaccagttaaatgagcctctcttcggctttcccccctgctcagtgacacctcccaattcctaggcactccatatcaatgtagctggcttttctattctgggagaaggaatctatacttctttatatcagcaaatatatagaaaaagttctttcaacttccaaaatgaaaacaataacaaactcctcctgcatccctcctgtttcatcatttatttacccatctgcctgtgtgctctgtagcaggcagggcccagtggccctgagcttcaggtgcatcccaacactgagttggtcccaaaggttccaagccctagacagccctcagcaacaggccagccccattgtctctgggcttcaagctggcccctggggacacaggctctaagcctatcccagcagactcaatcaacaggtccatcaatgtggatccaggctgcaggcctgccagcctaaggactccaacagcaagcccacccatggaccatgctaaccagtctgtccagaatctctggatggcatgactgctaagggaatttcccagacaaagccagcgtgcaaaaactggaataagtacctatttttttcagttacacagacaccagaatatagccacaagcatcaagaacaaacagggaaacatgaaatcacctcattaaagggacaaaataaaggacagtgactgatcctaaagaaatggacatgtatgaattgcctgacaaagaattaaaaatagctgctttaaggaagttccataaatgtccagaaaatggcagagaaataattcaatgaaatgaagaaaacgataaacgatcagaatgggacatttaacagagtgattgaaataataaaaaaatcaaccagaaagaacagtaattgctaacattgtgcattgttctaataaaaaaaaaggtataaggtaaatactgttattcttaatttgagagaggacacattgcagcaaaaagactaaagctttccagttgggcagtggccaagtcaggttttgaaaccagattgtcaacttttaaacatatgcttcatagtaataataaaaataaaagaaaaattaatactgtgtgttattggtctctcctggcttagatgggtaccatgaccctctagaacatctctttataaatccatgaaaaggaatatagatgtggaaagggatgtgtttccttctagtccagcaatgccatggctccatgctgagaagttctgaaaaatattccctgccgagagaagaagtcacgggagttgctgagttttctgaaacataggacaaacaatacaccggggttgatgggggcagtaaatagcctttggaaaatgccttagtgttcaataattcataagagtaagcatcagtgccaagcactggcattcccacttggaagcccccatagggcaggggctggctgggttgctgagggcctcttttcacttggccaagaagctactttgttgatatcctcactctacctcttagcagctgggggcttaggcacatcattaaatacttataagcttctctttcctcgtctgtgtaatcgggatgatactagtacccatctccttagctgatagaaggattaaatgagaaatctttgcaaatacttagtgagtgaccaacccgtggtaccctgtaagtaaatactatttattattactcttgtcatcattgtaatctcaggacaatgggcccttgaaaacaggggataattccatgtttgatctacccatttatgatggacactcagcctgggcaattattgctcttattcaggcatctggtgagcctttggagaaatgtggagctggcaagtgactgaaagtttgtctgctttaaagctctcattaaattgatgaagaaactgagtctcagggggggagtcccttattcaaagttacacagccacttgatggcagaactatgattttggagatcaggtgtctggcttcaagcccagtatcttcctgttagattacacagaaagacactgcacaatacaggcagagctgggcagctaggtagctacagaagaccctgacattagggcgctttgagattctcttatctttgttcagtaaacctaggatttccagggcactggcagcagaaacggccaggtcaggctttcaaatcgtgtgactctggtggagaaactgcccaagggtataaataaggtcttaaataagacctttaaggctaagttgtactcagagcaaccaaaggcagcaacatcaaaggagagtctgagtcagggttgaataaagagagaaaaagtccaaattggagaatgtctgttgatatgcaaaggctgagaaaagactccaaacagaaatctcaacctctagaaaggctccagaaagactggaaccaacttaggtgatagactgtaagacaggcctgagaatagtgttcaggactgagactaggaggctattgacagcctgtttttatagggcaacttttgcttatgcagggacagtagcaggagaggcacttgactgattaaagcagttaggccaggccagacaagaaggacagtcacaaaagaagaatagcatgaagataggatgcaattatccaaagtggtctttggcctgaacctcaagtcttaaatcatcccaggggaggcagtggcagcatagatatgcatgagagatttcctgactccactctggacctttggagaggagtgagctgatgtcagagcagaaacttagtgtgcacgttagctctggaaactcagcttgaaataatgaactgctggcttcctggtctcagccgccctgccttgatcccaaatcacagaacatcagcattctatagctcaaaggagatcagctttgcagacccaagcttgtaaaaagttatttttcttggaagattttcttggcattaatagtttctacagaacccgtcttgcctcagctggaccctaagcaaattgtaaatgatttggagcattccctaccactctcttctctgaagtagctataaagattgtttctctttagtctcacggctgcttgcatttgaatgtatgcatgctgagtgtaccctgaagtcagggctggcacatgggcctgaactatcaacccctggaagtgagggagaaagaagtggtgaggaagtaggctgtaccacagttatcccctcaaaaagtgacacagttagaactttctatatatcttcaggaatcaccactttgatcttgccaatccttactcagaaactttcagcagcttccaggtgtccacaggagaacatctacctcattagtctggtgttcatgtggttctgtctacgttgtgtgattctcagcttatgtgttcagccttttctttgtcctgctctatagtgttagttctatgctttgaacaagtttcattttaacttttaatttttattttttagaaatgaggtctgtctttgttgtcaagcctagagtgcagtagagcgatcatagctcactgcagccttgaattcctgggttcaagcaatcctcctacctcagagtcaagagtagctgggactacaggtgcacttaccactcccagctattctttttaattttctttttcttttgttcttttctttctttatttatttttaaaatagagacagggtcttgctttgttccccaggctggtcttgaactcctggcttcaaataatcctcctgtgttggcctcaaaaagtgataggattacagacatgagccactgtgctggcccccttggacaagttttaattgttccatacctcaggctactttccataaaataggaatcataatacttccctagatcagcagtgatgctttggctctgcaagatacagaaaactctgcctgaaatggaagcataggaaacatatgagttcatgtgatagagtctcagggtaggtagctccaggttgttaattctttggttcagtgacatcttggaagacaaagtcctttctatcttgctgctctgccttctagagcattggtctttgtcctctggctattttttttttttttataatggatgacaagatggttacagaggttctggcatcacacccagacagacagtaaaatgtacagaagaccaatagtagacaacacattttcagatggagggaactgcttccagaagctcagagctcccagcagagtaccatgtgtgcatcatgtcaggacagggtaaaccaggggagacagagtggggcccagcctcctctaagcacaggcccacacagagagggatactgtaacaaaatacaagttctgttaggaaggtagaaagaggtgcattgatggaagttatataggcaaccaccaacgcctgctgcactgccttataaggttcatttgagaatcaagtgacacgagccgtgtaaatcatgtaaatgttaacatctctgctatttattatcattcccatctttatgctgggtctcccactgatgtgtgtccactccacctatcaaaatcttattcctctttcagtgttcagcttaaatcttccttccttttttgtcttactctgtagcccaggctggagtgcaatggtgcaatcttggctcactgcaacctccacaacccgggttcaagagattctcttgcctcatcctctcgagtagctgggactacaggcatgcaccaccatgcctggctaatttttgtacttttagtagagatggggtttcaccacgttggccaggctggtctcgaactgacctcaggtgatctgcctgcctcggcctcccaaagtgctgggattacaagcatgagccactgtgcccggccttccctcctttttgaaattttcccagacaccccactatttcactcctatttttaaccccagatgaaacttctgtccctaattcccaaagcgctatggcagccaatggattgattgcatcaaataacataaaggaacttgaataatattgaatcccagacctcatctaccatggagaatctgattctacaggtctgggaaaggttaaggctatgtatgagacaataggtctaggcattaatgatgtataatcaggtttggaataatttttgaacttagtatctgggctttatggactgcaaaggtagcagataacttttcaagtttggtgtttaaagagcagggacagtatcttgtatgtttttgtgtccctgagtgttgcttaacacacagcctgggcacatttgtacagtgtcaataattttaaaagttgtgtatttactgaaccttttgagtgagaggatttaaatttttttttcagactctttctggatgtgcgcataagtgcactcattttatccatacctcttgtattctaagacttacaaccaagaaatgtttactggtttactcctttaccacttcttgccaaagaggtagaccagcctgcctccttatgctcagattcggtctttctgtcaagagtttccatcctccttttggaattataaccaagttaaaaggtctgactgtgatttcctttaagattgtagaggtggacgaagtcaaaattgacttaatactatctgtgaaaacagtcaaggctgggaaggggcattttttgcactgctttcctttagcagtggtgattttagcagtgagttatagtacatgcagttggagttgaaggacactgagagagattctgagcagcagaacattcagttggtccatgagtgttttctaaatgtcagtggggaatgttggcttgtttgggtactgaggaggactattaagcaatagtaaataatagcccatgacattcttactgtgtgccagagacagggccaatcatcgtatgattaattctcggagcagtcctttgacccttgtgagttaggtattataattatccccattttgcacctgttcaactgaggctaagaggttaaaaacttacctcactaggaagctgatgacctaggttatgaactcagatttgattgactcaggatttcaggctctgacccactgaactctattgagttctagaaagcatgtatcactgctttcagcagatttggagtctgtttcattagatctcaactctggctgctctttaggattacctggaggagctttaaaacatacccatgctcaggcctcagccaaggagatgtttaaatacatctagggtggggtccagggttggcaatttataaagcttttgaggtaattctattgtacttccagcatcaagaaccatgggtctagttggagtgaaaaaaattcattcatccatcaaattttatttagtgtcttttgtgtccctggtctttgcttttctggagtcattcccaggagagtgataagcattgcaagtcacaagaggaaagaggcactgattctgcccggcaggtctaggaagctcagaaggaagctatattgaagcagaggcaacacatcagtagaggtttgctgaggactaatggtggggtgggttggggagggttttctgggcagaggaaatagcacatgctgtagcatagagttgtgagaaggtaaggtgtgttcaggaagctgcaaaaggcttggtttgggtggagtgaaagcacctgtgatgtggtggcagaggaggagggaaagtggttagggaccatgtgagcaaaggtgttgggctcagtacagggctcaggagttgagattttgtttcttgagaggagtcattgcatcaggtctgtgtcctagaaagtcccttgggaaacagggcgaaggctggatttaagggaaaggtaagactgatagagtccagtatgacattgctttgcaaaagcaaaaaatattttttgccacctgaaggcctaatcatgacagttttaccagtaaattaatctattatacattcatatgatggaacatgatagaatgattaaagattatgtgtattgatatggaaagctattcattatatgtatgtttaaaaagacaggttatagaactgtatatctgaaatggagcaagaaaaaaaaatggctaacattgtgttgtagggaagagatgacaaggacctggactcctatagtgtagaaggaaggtatggaggggccagctgtgaaaatgctagaaaagtgggatcaacccaaattagtgtttggatgttgggataagaaaagaaaattttaaggtggggttccgaggatttcaacttgagtggctgggtaaatgaatgagagctggggaactgggcatattaacaaaacatagatggactgcagagagacaggttggtgaatgataatcagttcgatttgggcatgctgagtttgatactatgggacatccaggggaaaaggctgttaagctgttggatttatgtgtcgggatgttaggaaacagtcttgagcttaagagcacagataagtctccttggcaaacaaagacgaatttaacaataaaagctgtttgggattcttgttgttgaacataggatcaaatgcaagtaaacccagactgctatcaattcagcaaacagtttttgaaaactttctcagtgatcaacatggtgccaggtacagggatcaccaaatgaacagacttggtctctgtccaaggaaacataatctatcaagtgctttggtaacacaaaggagggactgattaatctaccatgaatgtttagaggaagatgtggcagaggtcacatttgactaggcttcaaaacagtggtccccaacctttttggtaccagggaccagttttgtgaaagacaatttttccacagatgggggcacagggggtgatttcagatgaaactgttctatctcagatcatcaggcattagttagattctcataagtgtgcaacctagatcccttgtatgtgcagttcacaggagggttcatgctcctatgagaacctaatgcctgatgatctgacaggaggcggagctcaggcagtaatgttggcctgccgtccactcacctcctgctgtgcagcccagttcctaacaggccactgaccagtataggggttgaggacccttgcttcaaaaggtaagttagagtttgccacgtggatcaatggtttttatgcattcccattgcaattggacttcactttagaaattaagcagattctagaaaatgtaggtgttaatttgaatgccaggatgccaaatatataaattcattaggagagttcactataaaatctaagttttattttaaaagataactaacatagaataagtgttttcaagtcagtttaagttctctttcatcatggccgaaagctcacattactttcgcttaccacgaggcaaaacaacattaaatatctgagtcaagaaggatggtgcatatgatacgttttccttcagtctagagcaaagtaagttcgggtcttggaagggcaacccttccccactccagccagatgcctcattccccatggctgagtcaatacaaaaagaatgagtgagtcaattcttgctcacctcaagggagcttgttgaaggtcactcagcaaagtggtggcagaatgccattgctttatggaccttgccacactaatgggcacttccaaatgatgcttccccacatgtttggcctctctcctctggcagtgcatgtgtgtgcttttacctttaattacaaggcacagcagtgcacagtggtttggatgcaggtgccagtggagatggaagccagccaagtagtagacgcttgacctggtgaaggatgacagattgacagagtttggactctggtattaccctttgattttgctgaagtttaatgtgttttcggcacttccaggactccctatgcatcacgagcccattcagcctcagcttgcttctttctttactgtcgttagtgccttaaatttttgactgggaaagaaatacatcagagagacccaaactttctcaagctgatgtggttctcagtagttagctggtaaatttataacctggaatgaggctgggctttgacatcttccaagtgaatggccttcattggtcagggaggaatgtttttcagggggaagtgttatgtgacagaatttgtttttattcagttcctactctgatcaaaatctgccagtgacttctcattgcctgtaggattcaggccaaactccacagcatggggttaaagctccttcgtaatgtacacccaatatttttgcttgccttatctcactcatactctttgaccttttttgaatttagattccccatgtttcctttacactcccccagtagcaccagtgcttatgcccatagtatcctcttaaaatgatcctccctaacttttttccacttacttgaattctaaccatcttcagggccctgtgcagaagtcagttccaagggggcctttcctgatcaccttggcccagtgtttcctcccacatttccaccaacatattatcttttaatgtttccatctatataaatatggctagttctgttatggcaggcactgagttttccccattcttgtatgcatcatagtgcctggcataatgtcttgcaggctgtcacagtgcaacatttttcttgctgccttgcgggggaagccgtgatgcaggtgttgaaggcagttccagggtagctggattgcagccacttgtcaatggttctcaatctttccctggacgaggcctgtggagggctaactaatgaagaggtcttttgcttcaggttttatcccagcttcccagatctgctttcctggtccagatggcacctgaacttggctactgcattctggacccaccttctgtgttcagcattctgctggcctctcctgtcactgctataggattaatggcttccagctgtgatagttatactcttcctctagcaccctctgccaaaatccagagtctagtacctctggctggaggagacgaggaaggaggagtaaaggagacatttatggtggaattgattactccctttttgatgctttcatcgcactcttgtttacctccctagcatgtatcttcctgtagctcagccatttatgtctttgtgtctcctgctaagtcgtaaatgccccaaggccagaaccatgcattatctgtccctgcttactggtacctaacacagtgcctggcactgggttgacattcatttcaactaagctgaaatcagtaagcaattacaaagtcagaataacccacaaaatgtccgatcaaagcaggtgtactctctgcactccagagtgaattcccgtggctcctcttatgacagtccttttaagagaacgtccaaatgggtctgaaactcctgaacactggagcttggagagacatttttaatcctttgggtggaattaccactggggaagagggaggtcaaggccagccaaactgtccctgagaccgtgaagtaactgccctcaccaaaaacctactcagaaaatgaatttcttgatgggtctccaaactgactctggtccaaatagcccaagggcaagactagaagggatttgggcatggatttgtcttgctccacaacactcgggtgggtaaaagataagccatattaaacaatctttccattgaaaaatgaaatcaggagctcgagcccgtaatcactagacttattgatttatttcatctcagtgattctttttggctctctcccccatgcctttgttaccggaaaggggtctggatccagacaccaagggagggttcttggatgtcatgcaagaaataattttggggtgagttcacagagtaaagtgaaagcaagtttaaggaagtaaaaaaacaaaagaatggctactccataggcagagcagcagcaagggctgctggttggctatttttatggttatctcttgatcatatgctaaacaaggggtggattatttatgacttttccaggaaaggggcaggaaatttccagaaccgagagttcctcttccttttcttttatatatatatatatatatatatatatatatatatttttttttttttttttattatactttaagttctagggtacatgtgcacaatgtgcaggtttcttacatatgtatacatgtgccatgttggtgtgccgcacccattaactcgtcatttacattaggtatatctcctaatgctatctctcccccctccccccaccccacaacaggccccggtgtgtgatgttccccttcctgtgtccaagtgctctcattgttcaattcccacctatgagtgacaacatgcggcgttcgctttttttgtccttgtgatagtttgctgagaatgatggtttccagcttcatccatgtccctacaaaggacatgaattcatcactttttatggctgcatagtattccatggtatatatgtgccacattttcttaatccactctatcattgatggacatttggattggttccaagtctttgctgttgtgaatagtgccgcagtaaacatacgtgtgcatgtgtcttttcaatgaaataaaagaggacacaaacaaatggaagaacattccatgctcatggataagaagaatcaatatcatgaaaacggccatactgcccaaggtaatttatagattcaatgccatctccatcaagctaccaatgactttcttcacagaattggaaaaaactactttaaagttcatatggaaccaaaaaagagccctcattgcccagtcagtcctaagccaaaagaaaaaagctggaggcatcatgctacctgacttcaaactatcctcttccttttcgatcatatagggtaacttccaggtgttgccatggcatttgtaaactgccatggcactggtgagaatgtctcttagcatgctaatgcattataattagcaaatattgagcagtgagtacactagaggtcacttttggcacatcttggttttggcaggttttgaccagcttctttattgcatcctgctttatcagtgggactttgtgacctgtatctttgtgacctcctgtctcattttgtgactaagaatgcctaacctcctgggatgcagctcaacaggtcttggcctcattttactcagcccctattcaagatatagctgctgtgatttgcacacctctgatacccttgggccatgtaaaaattcttgattttataatataaggaagaatagaaaatgtctttcacttcatttgggaatggtcttcactacacctggcccttgtttgtgtggtctcttcagaggaggctaactctgaaggtgtttttactgtctctgtgttgagttaggctgtgcacatcttctttagggttctcaaggccaccagctttgttcccagtttatacaggcactcccattagagtttctgccactcagctattgcttatcaggctgagaactaccactctcgttactactatccaattaaaactttcaggatttggactcttctcttttcaacaagaacaccaaaacttggacaacctggcttaattccctgggtaggtctagattatagagaagcaaaaatgactgtggcattggcttccaggaataagcctctttctcttcttgctctggctccaaagcaaagtaaaaaaaaaagctgtcaactccccactaggggaaagagtccaggccttggaaacaaaggcctggctggatgtctggaagggcttatatggggaattgagacttagcttttgttttagcctgatgagtctggagtattgagaaaaaaagacacaatttaatgtcttaatagattatcctgtgtattaaattctcaataaatctccctgctataaggacagggattatctttattctctctttttaaatgataaaaatatcttgtattcactggagaggttgtgcctagacagtatgaggatcaaagagatcttactttaaaaggccagtgctctggaaggagaatcatagatggaatctgaccagtgaaacatttcacacattttcccaggacttctaggagtcaaacgttaccatttcctagagcaactgctgaaatattttggaatattgaaaatttgaagagttcagtattaatcagatgaaaggaatcgtaattaaatgtcttcccaccaagaagtcaccaggcccagatggcctcaccagtgaattatttcaaatgttaaggaaaactagatcttacagaaattctgttagacaataggagaagaaagaagactttccagctcattgtgagggcagcatcactttgacacaaaacttgagaatgacattataagaaataagaattacagattaatcctttttatgaacatagatgcaaaagtccctaagacattagctaattaaatccaacaaaatataaagataacatattacaaccaaattgggtttattttaggaatgcaaggtcactttaacattcaaaaatcaaatgtaatttgccacaattacataataaaggagaaaatcatgtgataatcttaagcaatgcagagcaagtatttgataacactcaatacccattcatgataataactcttatccaactagaggagaacttccttaatgagataaagtgtagtttttaagaagccaaaaacctacagcaaacctcaaactaaatgatgaaatcttgaaagtttccctcctaagattagcaatctaagattagataaggatgcccactaacacctcttttattcagcattataatggaggttctagtcagtgcaaaatgcaagaaataaataaaatgtataaggattggagggaaaagaaataacaactgtggaaaattcaaaagaatctgtaaataaacccttagaattaataagtgaatatggcaaggtcactggatataatgtcaatgtataaaagtattatttttagacaatgcaacagaaaataaatataaaatatttttttttaagagacggagttttgctctgttgcccaggctggagtgcagtggtgcattcttggctcactgcaacatccgcctcttaagttcaagcaattctcctgcctcagcctcctgagtagctgggagtacaggtgcatgctgccatgcccagctaatgttttgtattttagtagagacggggttccaccatgttgcccaggtctcgaactcctgagctaaggcaatccacctgcctcggtctcccaaagtgctatgattacaggcataagccactgtgcccggccaaatgtaaaaagagttctatgtataatagcatcaagtaatatgtgataaatatgttaataatatagtaatacaatgaatcaagtcatgaatgctgagtggagactcaatatagaagactaaaaaaattcttgaaaacatttcaaggtggcctaagtaaagagaaaaccaagtttatggtttatagaattaattttataaacatccttatttccccccactctcatctattgattcaaaacaatctcaatggaaattctaatggactttttctgtggaatttaacaagctgattctaaaatttataaacaaatttaaagggtgaagaataggtaagagaatcttggaaaaaaaagttggagatattactagacataagacttatttaaagctgcagtaattaagaaagtctggtattagcgcaaagatagaaaaatagaccaataggacagaataaaagtccaggagtagatccatatatatacagttgcttgagttttttgcttttcttttgagatggggtcttgctctgttgcctagggtggagtgaagtggcatggtcatagctcactgcaatctcaacctcacaggatcaagcagtcctcccacctcagcctcccaagtgcatgccaccacacccagctatgtttggttgcttgatttataacaaagggtaacactgaaatgcagtgatgaaaatgtggtcttttaaaaaatataactaggtctattaaatatcctaatattaaaaaataataatcttgactcctcttacttcgacaaaaaacatttcttctggattgcagatatgactattaaacttaaaaccataaaacttttcaagaaaagcataagatattatcttcatgacttctgtatgggcaaagatttcttatataggcttctaaaaaattttgactatagaagaaaagattgatatgttggacttaaatgaaataaagaattatttaagaaaagcattatataagagtgaaagtcatagcatttaataagagaagatggttgcagtgtctgtatctggcagagtactcatatctagactacataaataatgcctataaatcattaagagaaagactgacgacttaaaaaaatgggcagaagacttaacagacatttcaccacagaaggtatcttaatgagcaataaacatttgaaaactagctcaatttcctttgtcatcaggaaatacaaaattatactacttgagatatctttttataaccaacatattagctaaaatgaaaagataatatcaagtgttggcaagaaggtgaggcaactggaactttcatgcagtactgagaagatgtaacttgttataaccactttagaaaaccggcagtgtctcctaaagctgaatatatacacaccctgtgacccagcaattgtactcttaggtataatatcatacagaactacatatgtatgtgagccaaaagacatgtacaagaaaggtcatagcaataaaagccacaatctggaaccaactcacatatttgtcaacagcaaaatggactaataattgtggaataattcatccaatgtaataccatacagtaatgagattgaatgaattactgctataagcaagcaacaacatggattaatctcatagagtattgagccataaaacgtcatagagtgttgagataaaaaagaatacatatcgtatgaccccgtttatataacatttaaaaatagaactaatcaatgttaaatagaagagcattgtggttacttttgggagagaggacatacaaggagggtttctgaggtgttgctaattttctgttttgttttgttttgttttgttttgtttttgttttgagatggagtctcgctctgtcaggctggagtgcagttgcatgatctcggctcaggctcactgcaacctccacctcctgggtttaagtgattctcctgcctcagcctcctgagtagctgggattataggagtgcaccaccacccctagctaattttttgtatttttagtagagatgagttttcaccatgttggccaggctggtctcgaactcctgacttcgagtgatccacctgcctcagcctcccaaagtgctggaattacagatgtgaaccactgtgcccagcctaatgttctttttttttttttttttaatcatggaagtgaatacataggcacactcactcatctttgaaagtttatcaagctgtaccattatgatttttgaacctatgcatgttgactttaatgcaaggtttactttaaactattttgttatgttaaggaggaggcacctcaattcaccgggatacactttttcacaaaattaagcatgcacacacatacacaataccaactttttttttttttaaactgtgtttgctccatcacatattttgccttgagtcacactggagaagctgagatggcttagttaacacttccaggtgctgtgggcatgggcttggactcaggcggctgttatttttaagacatttgatatgattttaagagctggcaccctggcttcaggaagacctgagttctagtcctggctccacctcttattaatggtgttattttggttgagttctggaaatgtcagtttccatatctgtaaaatggggataatattaattctgactctggtagggtactgttgagtatcaaatgagataatcaatgaaagtgcttagtgcagtgtctggcacatcgagtatgcacaataaatgacaggtggtggtgatgacagctatgactactagataaggaggggatgtaaggctgtttaagacacctgtgggggttgagaataaagagttgcaaatacaggacggctgttcttgtttctgctttggtgcttagtctcctgtcatttcctttgggacccctctgcaccctcctcctctgctgttgtcccagttgggtcagtgagtcccagcagattgccttctgcctggctcatgtcctttctctctttctctctgcatgctgtgtgtgggtgtgctggagctagcctatttccctgctatcagcagaagacaaaattgttcgataagcactttgtcgtagtcagaccatcacaggagctttcatgaggaggcagggcacacaaaactctttgtaaacaataaaacccatctcctgctttgacatgaagttgcccgtaggttggtagtcttgctgattccatggtttcaaacaaaaccagaagctgcttccactggcagagcgtatttccatgtctcagagtctcatttctgtgcctctccccacctccctgtgggtatgaagttaactgaacattatctttctcctcttcttctgcctaagaacccatcacatgtggcccaagggagcagaggcatcagagcatgcttctttttatatggaattaataggtttatgtttctttagtggaatttctaagtcctagaggaatagaaggccttgctccctctgaactctgaggtcatttggtgtggtgatatgggagggcagatgtagcaggaatggggacagcaggatggatgaaactgtgctgaggttcaacttacctctgggaggtggtagcctgagattgtctgcggtccctggcatggaagattgagagagtagatggcagctcacgttctaggaaaagcaggggatgacttgtacaaatccgcaccgatatgtggcctaatgtgctacccttatcctcactgctccatcaatttttctttgagtcacttataaagagctcttccatttctccttccaggagggaatgtgattggccaaggaagggctctgttggtagacgttcacattttttaaaaaaagcttctatggcagtgaaagcagggtccatgcattctgtagtttttgcggattgaggggaaatttctcctctctctgggtatcagaaagaagggctgataacactagaaacctatcctccaactctggcagagggaggcttaggaaatgttgggatttagaagagcttcattctctttcctcttgggggaggcacaataaattcaaaagcacaaaggctctctgaacacggaggcggggtcctttcacgggctgcgaggctgaccggtgctgcagtgatacatcatccgcgcaggctcagagaatggcagtacttacaagggcctgcttcatgacctagcactggatgttgtattttttgtttgtttgttttgttgttgttgttttgagatgcagtctttctgtgtcaccgaggctggagtgcagtggcgcaatcttggctcagtgcaatctctgcctcccaggttcaagctgttctcctgcctcagcctcccgagtagctgggactgcaggcacgtggcaccatgcctggctaatttttgtatttttagtagagtcagggtttcaccatgttggctggactggtcttgacctcaagtgatcctcctgcctcggcctcccaaagtgctgggattataggtgtgagccactgtgcccagcctagatgttacagtttttaaagaacttgggcataggtactcaaaaaacaaaactccttttgtctggatgccagcactatttttgtcattgtaaaaattaatgagaatgtactccttataagttgactggcaacaggctaagagtcgttttgggattgaggaacaaataacacatagacaactatcatgctttttccaactgcatattgtccacctcttctgcctgattcaggttccctggacaccaatccctgcctggtcctgtcttaagtgcccctgagccctgcttatttcctagggagcattacctatgcttgacctcacctgtataagtctgtccacggggttatgctgtgccagacagaagttgcaaagggtagtgtgcaaagcatggaaataagggctttgccaaattagtgggtcattaccagtaaaatcagatgttgatgcatcatggaaaaaagtcaacataaaggggcttagaagccagattttagaaaaatgggcaaggactctcagtgtggaggtaagtggaatagaatgaggaatttatcaagacagagatggttcagctgggaactgagtttgcaaatgaattaatttgattcacagcattttatggataccaggccctggaaagatagtagctaaaccttgatatagctctgccctcatggcattaactttccggttcgatgtctgcccatgtcttcttttactttgaccctaacatgcctcatgggttgaacagaagtgctttaaagggaaggaacctctgcaagaggaagattactgcggatctgaaggagtgaagatttgatgtgccttttctcaggggttatcaaacaggtcagattactccacatccaggatgcccttttttattccagcattgattattcacagtgaggtctccatgggaagtattttattataggtcactgttctcccagttccttttgccattaccctcattccgcccagctacccactaaatgttacttattttgtcaaggaatacaaattaatgctacagtagcccaagccaattcaagccaatttgttgcagaaaagtccaccatccagaatatgtagaaaacatgctttgattagtcatcatttgggatcacacatccatccaggtcttctccattgtatgaatgaccaagctttggcaataaccacaattttttttttcatgcttaaaaaaatcaataggtcccatcagcacacataatcaccaccccactccagaggcagaaaattgagagttggttttatttaaaattgctatgtttgctttgtctttaaattgctatgtttcccacagatactatgtttgtgtttgagcatcagtgaggagacatgagtggtggaaggaacttttgcctatatgccatggggaaagagaaatagttttgaatgtagcttgagtctgggcagtcaggctttcagtttaaattggctgttcaagagaatgatagatgaactgaattattttttcccagtaagagagtgaaacactttaacagagaaggcattctcttaggggttcaaagtgtgtagtactaagaaaagaagttaaatgtaacttccctcttctacttcttaagaaatttcatgccctctttggaaccccttgtagcatttcataaatacattctatttttcttaagacaagataggttataaggagaatcttacagcagcagtctggcttagactaggtaggttttgcatctttgttcattgtggtcatttgagtagaaccaagtgcatgcttaagttagtgttccttttaagaaaacccactacataaacgttttgatatagaaaatatgtatgctttgagtttctgtgtgcataaaggaaggaaaggtggggaaaatggtgaatttatttccttagtgtattttactgttcagttgcagattattagccacttggcagatgactgagagaagggaaactttagattgcacattgaatatcaatttaaagtgaaatggtaatgagttaagagagtaataagatttgatttacaataagtttaatttgtaatcagttttggcttaagctgcataagtctacctgtaagttgtcaggtgaatcatgggcagcattgatctgagatgcagaggtagaagtcaggacaataagagataagatgaggttgtgcaaaaagaaacagcagcaagaagagcaaacaggcctcttctgagcttccccatctttatgcctctgctctcctcttaatcctttacttcactcaagatccttttcaaaatgttaccctcagaaataaagccatgtgtgatcactacccacaaccaatgagatactgcctattgcctgtttggacaaaaaatagctaattttaggtcagtaagtttgggggttagaaaggttggatgctagttcctgcaacattacttactattatatgatgtgaccgtataatctagggtatgttgcttaatctcaccggacttttctctgaaaattgtggttaataaaaagtcctaattcatagggtccatgggaaagttaaaggaagcattgcgtgtaaataagatttcttagtttacagcttggcacatagcaagtggaaggagtattagtatgattgcgattataattttaaggctgtttttatagatctggtttagttacaaaaatattttataagttggttttggagaaaatctactggaaaatttcatttgaatagaagggctagcacaagtggcttggggaaaagccacactttcacctgactcagacccggggaaattctgtcttaaaaaggaagggaggagtaggtttctagtctaatctcagaacttcagaatcagcatctctggagaatgtggccaagattttgaatgttcaacgaagattccggttgattcctatacacaagaacattgaaacacacaagcttatatacaaatggctgtttcctcagtactctctaactaagaggctggcctctaaatataaattatttcagcaaagtgattttattagcaggagcatatttaattgattgttgttttgaagtaaggctactttttgacctgcacatctacagaggaataattattcctatacagacccttttagacatctataggaggcactggcaatatttttaattttctggttatttttactatttatggataatttccttcttagtcttcactagtgcttcttaccatattttctatcttatatgttccctataagtttctagcacataacaggccctttaatgcatgttcttttggactgaattttttcttctctattagactgtaaatttcttgaggacagaaatcatcttgcttaatatccagttccagtcacaccttcaacactgccttgcttggtataagacttgattttttaaaatttatttttatttttttcttagggtcagtgtcttgctctgttgcccaggctggagtacagtggtgtgattatagctcactataacctctagctcctgggcccaagtgatccttaagaaaggatcagtagctgggactacaggcacatgccaccatgcccagtgaatttttattttttttgtttttgtttttgtttttagagatgagggtctcgctatgttgcccagcctggtctcaaactcctgacctcaagcagtcctctcacctcaacctcccaaactaccgggattacaggtgtgagccaccatggttaaatacaaaccaacctgttaggattacataacagtctgtatgtcagaggtagatcacaggtggcaagacaaagaggcccaatgcagtttcatgattattttgaaccctggagaaaactggcttttgatgtgaagtcttttatagagaagtcacatcccaggatattcttataattcagccattctccatctggctaatcttaaccataggaagggagttcaatagtgtccacttttgtgggcttagcaaattgtgctatgtatgtcatatacattatctcatttaacccttaccaaaaccagtgaacccaccaatagataccattatccccatttatgtctagtgatatgaaggggcttgccaaagtcactaagcaagttagcaccagcacggcaatttgaatcgttcccccgattccaaatctagtgtccgtctcctacaccagtggttttcaagtgtggttcttggaccagtagcattgacatcacctgagagcttattagaaatgcacatgctcaggctccttctagatttcctaaattggacactctttgtcggacccaaatctgtggttaagcacactctccaggtgattctggtgcacatgaatgtttgaaaaaaaaaaaaaaaaaaaaaaaaaaaaaaaatcacagcatgacaccagctgttcctaatagtccttccttaccctgagcccttgctactcaaagtctggtccacagaccagcagcattggcttaacttctaagcgtgttagaagtgtagaatctcacactcttctacatacctactgaatcagaatttgtattttagtaagatatttggtgattcatgagcatattaaagtttgaaacgcattactcgaaattatgtattttctctctgtagtcttatattggcttttcttagtctcagtgtccaagattcttggggtttttgttcacccatgtacaggaacaaatgaaagttcttccattttctgccttgtgaccaaattgagagctgtgcttactcttttctgataaaagtccacttttcctttctatatccctgctcctccagcctaaatgcatgcacacacagacaacaaatgtttttgtttccctttgatgtcaccttaagctaggcacaacagcaagggagtagctagagttgtgttaacatgttataaattaacaggaatgggaattgttgcccattaattaggaaagagatggctaatttcttgctattttctatttcagaaactatatgtagaacctgaaagcagcagctcattgctccacagttgatgctaattatttctcaaccatgttttgagcaaacaggtagtgtttagaaagcctaaaacataggctcttcagaggaaaagacacgcaccttctggggcttattgtgtagtgaagttacaataagaataattggaaaccccactctctgacagagcagtggggaatcaaagattattcagaggaggatagctaaccaaataatgtcccaattcctaaatgattagttctgcctcaatgccacatagttttcttctgcagtgtttaacttctcactgggtctaaggaactgacccatcatggtgaaggctctgctgaattacatattccattttgtatactgtgagtcttccacactctctgtggccatacccttgatggggggctaccaggcactggcagtttcctccattctgcaaggaactggaagcaagaaaaatgatgtccttgctgtaggtattctaaaacggtgatgctcaacctcatgtatatattagaataattggagtgcttgttaaaaggtagattcaggactttgctctcagagttagaaattcctatttaagatgtctaaggtaggatccaggaaaatgcaatgtttcacaagcacttcagacagtgctgatggcattttccaggtgccaccattggctaacaattataccattggtacctatgagattttagaaaggggactgcatttgttacatgtcctccactgtgtgttgggatagttgagaaagatgatcttagacttccctttctgctctgtaatagttttcccagagttggttaactattactgcatttagacgtatctattaacatctacaatgtaccagacattgtgctggatgccagagataaaaaagataaatcaggctaattactgttctcagagacatcatagtctgatgcagtcacagacatacagagcaataaatgacacaaaagcatattagctggtaaaatagcaacctaacataggacccagtggggactcagcattggaaacagtgacatggagtaaattcccagtgtgtgctaatagctgtctgtattgggcaaggccaggaaaattgggggactcttggtcacatgggaagttcaaggttgtcctaaaaagtttcagttgaatggaggaggcagatatgtatatatatatttgaccaactgactttccttcaactgatagggggtttggttacaaataagtaaaatttttaagaaaatttatgcatccaagagggaatctcaaaagggacactggagatctgtgtaatttctaggaagaaaattgtggtcctattattaaaagcttagaaaagatatggttcactccattgcctggagttttgaaggctctctgttccatttttcattatccaataataaatatcatagtgaaagccacctttagcacttaaatattgctgggattttatgggattgaattgaagggtattaaaaagccaggtgggtgagatacttttataacacatgcttcataaagctgtgtatagtaagtgcctgtataccaactttttaaatgagagcattcgggcatagcatttgagcatgagggggcctctgcttgttaattaaacttgttgataatactaattgttaagaaataggaagaagcagcttgtggcaagtagaataggatttgtttctgagaagagtagtccacttggaactgtcatgtacatcagcaggacccagcctgagctggaactgggcatcgcggaaaggaagcagacctgcaacaagtttcactagccagtagctggctatggggtcagtgtagctgttcacctggtggtggtggcccgtgctacctgtttagattgactgttattattattttccattaagcagagggatttcattaggagacttaacaagctaggtgggagttagttttgtacttactgctattttttacttaacattatcatcctagtttttctggataagtgagaaaggctgaaaccaatgagtcccggacccagttcttttatttatatagattttttgaagtgaaattcacataaaattaactaaaattcactattaactaaataactaaataattaactattaactaaaattaactatttttaaagtgaacaatttagtggcatttagtacatgcacaatgtggtgtaatcactactatctagttccagagcattttatcacccccaaaagaagccctgtgaccattaagtagtcgtttcccattcccctatatccctagtctctggcaatcacccgtcggcattttcttcctgcagatttccctattctggatatttcatataaatggagacatacaatatgtgaccttttgtttctgctgcttcttacctgccatagtgttttcgaagtttttttcatattgtagcatgtatcactacttcctttctttatatggctgaaaatattgagtgtttaccaaaatcagtttatccattcattcattaatgaacatttagattgtttccacatgttttggccacattttgtgaatagagctgctatgaacaggcatgcacatatatttgtttatctgtttttcattcctttgggtatatacttaggagttaaatttgtattatttgtacaaaatattccctgctactgggtgtctccctttgggaggattagatacctcaccctcaatgagaacaggcttggctccataacttactttggcccatgaatgcagtgagagtggagatgagtattgctgaatggaataagaacaatctcaaaattctgccttcactcctttccttcgtccaagactcctgcagggatgacctgggggcttcttctggctgggttcataaatgcaggcaccatggagcagagcagtccatcttttgagccctccctgaaagacaataaattgggctctgagaaggataaaaagaggagaaaaagttcttcttgccacaaaagagcttacagttttgctgtaacttaagcaggtaattttaaggtctacaaagtactacagagggctgaggaagaatccacagagctttcttagaggtggtggcatttggatatggccttgagggagtgataggatttacgggtatggagtgtaaaaaagagccttccaggacaaagaataactgcagcaatgacatcacaatggtaacgtgggatatttggggaactgtgatttaggtgattcctttcaggaatataagcactctggggacatggggctggaacattctattggaaccagtgagtgaactatgtgacctccagactaaagagttggctctctataatccgacattacaaatgacaagtttgtctcagtaatggattactgtcccactcttcctttctcgttcttcaggatgtcacatccttctgcaacagtgtttatcagcctttacattgttgtttttacttcatacatctcagctgtgcaacccaagggactcttgtccttacacaaactgattctctgtgtttgcgctcatctcatttgaaagtaactgttcggaaacaccatgggacatggaaggcaaagaaagccccaacatttgttgaacgtatatgtgacaagagttttccaaatgttatttctccttctcatcatctcctctcaacccaccatggtggtggtggtggaagtgattttttttttttaaattttacagttgagtagaactgaagccttgaagtcaaggagttaatagatgatggaggtggggtttgactgtgtctttctcatctgtgtgttccctgtttactgtagaatctagcccatagttagagcctcaataaatgaatgtgagggaatgattgaccacgtaactgaatgaccaaatgaaaaagcaaggtctgtttgattctaaacccaaaggtgatgagattccattaagaccaccgacttattctgtgtaattttgttacccccacagacaccaaaatgaataccctggagctatagtgagtgtggctgggatccgatgacacagctctggttgaagagtgtagggtgccctgaggggttcctagataatttggctctgctaagagaatattctcaattatctcttgtccaccttctctggacagaatgctgggtgcatggacattcattgggtgatccttctcaggtacatcattcaggacattttctggccctttgctttgggattagagtatttctaaaaccctagctcaaaatgggctgagtgcgggaagtgaagaaagcaaggtgaaatgtaatttcctctttaatatagactgtcatttaatctaatattatagaaaatgattcgatcttaaaaacctataaattacacttgacaactctctggtgttcctctgctttccctttcagcaattataaatggcaacagtgggctgtggcagaaaggagccttctgaatgcggtttgtttattggctcttaatgagaagcgattaatctaaatcaccataggggtggatcctttgtggagctttgaaatcagaagtggcagttggaccttttgacaaatgtgctgttctgtccttaataacaacaaaaagtttgcgagggtttgtgtggtattgttttctttctttctgcaataaggaaagaaaacacacacacacacacacacacacactcagacctgtcactgggacaaaatacaaaaccatcacatttgggctcctctgtttcttacctcttcagtccttcctctcctacctcttcccaccctctctggctgaggcagctggggctcctcattatgtagttatctggaagacccttttctctgtttattactgttattgtgtttttcttttccctgcctgtctggggaccacctggcatgggatgatggatcattacagagactacctgcctggcaaaattgctaccttggtcccctcctcttctgcgtcacgttgagaagggaagcaaaaccaaacaaccaaaacaccctaaaaaacccaaacgcctatgatcacaagctcttttgttttgagataatggggtcaaatttgcagccgaagggatgatcccataaaagtaggatgatggtgggtagagcaggatgagagaacacccacggagaagacctgttaggttaaaaaaagaaaaaaatctcatttttcctcctgctttctatttggttcttttctgcctttgtttgcactaattctttgtcattgccttgctgtgccctctgtctcctttgctatgtcaccaatacagagtacagcaagaagaataaaacactcaacttgggagggagagttctgaatttgaacctgtcttaatacttagtaatcaattgttactgagtagccaattgtcaataagtagctgcttgccactgagtagcaagtcactgagccctggcattacttttcctgtagaatgggtgtgataggcagaataaccacctccctgcaatgccccgctccccagaatttgtaaatatgttcagttatatggcaagagggaattaaagttctagattgaattaagaatgctaatcagctgatcttaaaataaggagagtaccctggattatcaggtcggccattgtaatctagagaatgggaaagagggaggaagaagaaccagagtgatgtggtatgacaaaggctggactagctgctgctggctttgaagatggaaggggccaggagccaaggaaagtgagcagcctttggaagctgcaaaaggcaaagaaaacagatcctcccaatattagtctgttttcacatggctataaaaaactaccagtaatttataaattactgagtaatttataaagcaaaaatgtttaactgactcacagttccacatggctgaggaggcttcagggaacttacaatgatggtggaaggtgaaggggaagcaaggcacatcttacatggtggcagaagagagagagagggaggaagtgccacacttttaaaaccatcagatcttgtgagaacgaactcactgtcacgagaacagcatgggagaaactgcctccatgatccaatcacctcccaccaggttcctccatgaacacgtggggattacaatttgagatgagatttggatggggcatggagacaaaccatatcactcccctagagcctccagaaaggaaaacagccctgcagacacctggattttagccagtgagactcattttgggcttctgacttgcagataggtaagataataaagttatattgtttaaatcaccaagtctgggatgatttgtaagagcagcaacaggaaattaatagaggggatactatggaactgaatgctattcacccctacacataccaaattcatataaatcgtaggattcatataaaattttaaccacccccagtgtgagggtatttggatgtcgggcattcaggaggtggttatgtcatgggaagagccctcatgaatggattagtatccttataaaagggacctcagagaactctctctcctcattacatcacatgaggacacagtgagaaagcactagttatgaacaaggaagcaggctctcatcagatgctgaatctgccagtgccttggtattggactttccagcctccagagctgtgagaaagaagtgatgggtatgcataagccacccagggtatgatattcttttataggagccccagtggactaaaacaggggtaacaatacctgcgttgcattcctcgcagggtagagcaaggatcaaggagacaagagctgtggaagaacttggcaagctgtaaaatgcaatgcaatccgaagactttggtaggaattaactctgcctgtgggtgaaggcatgcagcacaggtgtcttgagctgggggtaaaagcacagaccaaccaagtgctttgaacatctgccaactccttgcacagcctgactacttattgttttcatttttttctgggagctaaatgtctctcctctgggtgaacaggatcagtccctcttgtcctttcctcagtacagttcctgcatgggtgaacggactctaaggcaccattggttattacagcctggtctcttatgtggtccattgtctcaaagggttgttgcagcagcaagttgcccttgttctgcgttgatcacatctagcatttagatgtttgagggcccgtcccatcagttgagttctaaggaatgttcatgtgatacgatacttactgggcaatgcaatgttcccagatatactgatgttgttaccaatgctgatgaagctcttggctgtttaggctctttcagctagaccaggatataggatatttctaagtatatttactcccaagattgttttcctcacgataacttgaaggttatcttccttctcctaaatataataatcctccccagatatctaggtttaggttcctgttttagttcattatctgttgcttgtagcagaatacatgaaactgggctatttataagaaacaggattcatttctcatagttctggaagctgggaagtccaaggtcaagggggtacatctggtgagtgtcttcttgctggtggggaccctaagcagagtcccaaggtggcacagggtatcacatggcaagggggactgagcacaccaacatgctatgctcagatccctcttcctcttctgcgcccataataatccattaatccattaaccatttaatccatgaatccatgagtggatttgatacattagtaaggacagaaaacctttatgatccaatcacctcttaaaggctccacgtctcaaaactgccacgtagggtattaaatttcaacatgagttttggaggggacaaatatgtaaaccatagcaatcccttaaaatatcctaagtttgaggcttcctataggaagaatttaaggtccaatggaaaaaacagggttagcaggtgaacatatgaaaacctcccccttttttgatgttcactggaagaaatactaaagataatacaataaataataagtattagtgacaatctgcagttcttaaattagccataatggatgctgtgcaattaatttccatttaccatctcttgtgcacttgaattttttcaggcttttcctcctacgcagcttcaacaagatgcttataaattaggtttgttttgtggtagataataggcatgttggtgggcattttttgctttatcttttcatatagtcattgcctttgtgattttaggctttggaacagtgattcttaattctggggtcccactgtggtcccagatgtgcacagtagcaacttggatgcttgaagcaacaaacgccttggatgatcttgatttaactcgttagatatttctgaaaaccaaacacacctggttatgtatctatgcctgtgacaacattgtgccaactcacatgtcttcatcctatttaacctgcgccttagtccatctgatcgtagaaatccatgtctgggtttacatcttcctttaatgatcctaatgtggagaaaagaaacaaagaaaagccccaaatcaaaacatcaaaaataagcaaaatgacttcaagaccaatcctgtatcctgcatttttttgaattatgaaacttctttatacttctctcctggtgttagatttgctttttaaaattactggaaataaatatctggttaaaaaataatgtggccaccaatttgttaaatttgtctatatccaacttctacaaaagaataatatgaagtagcagaggaatactgacctgaatgccaattactgcatatgcaactggtaatgccttggctggcagagggacagtgcctcaggtaaaggttttgctgactgcccttattgagatgaagctagcttctctgtctagtagggcactgatgaaccccaaatacaatgaactgaatatttggtcaagcaaactgagaaacctttgagtgaccttcactcagtcatgcatcacatgatttattgatttattgagcacgttcttcaggcagtgcagcaaagaagaccagagaacattgtttaaccaaagctccctgcctttaaggaacataatatcaaggtggcaaagtgaggtaaatacaagtaaaacgtaaaataaccaatattttaaaatatattaatatatttataaatttcaaatatatttaaacataaaatcgcagttcaatgtgattatgaatttgctgatggagttcttggaagaccgagatcattcagctggagcactcaggaggcttcatggaagggattgagttaaaatgggacttgaaggaaggcagggaggatgctgggctttctaggtaggggagtggcatgggcaaagataggaatgttgcagtaagcacagtgatttgaaaaaactctgaggcacagcttggcttgagcaagtggttatgttgaagaggtcaagcctgaaaacagcatgggagcccactaaatgcctgagatgctgggtatgtttttaaagacatgtagagagtattggtgtttcttgtggaggggagattccatatcagagctgggctgggggaaatccattcagtgtatggtgtgtgggatagtttggggcagcagattcttactccataggggaggtcagtaacaccactccctgaattgggagatgctgtttttcctgtccacactgagtcttcttcactaccccaccctcatgacacacctgtcctgcaccacgagttgtgctcaccatgtggatagaaatttactagcttttcaaattttccaagagcaggcaatgcgtagcatgttttatcaagaaggtatatgtatgtgtatatgtgtgtgtgtagacagataatgttttatgattgtaaaggaaatgtgtgctcactgccgaaaatttggggaaaatagaaaagtatagagaagaaaataaaaaatactcataatcttgccacttaggaataaccactgttaacgtgaatgtttgtttcaagttatctactatggataagtacagacaagaaatataagcaatgtttaacaaaattgagatgatgcttcatgtgtgtccagcctgcatttcatgcactgtttaaatatatggttgtttttcatatgtcataaaagtatttgaattcattttaatggctgcataatattccattgaatggctttagctcactttagtcattatcctatcaaatatagtcattatttctaattttgtattattataaaaacattgcattgaacctacaggtgcataaaccttttattgggtttctgatggtttccttagatagtttgctagaagacaatttacagggttaaagttatgaatatttataagagtctcgttccatattgccacattggttttcagagtggtcatggcaatttatgcttgcatcaacattgacagtctgcctagctcactccactggctttgccatggtcaccaataccctccctgttgctacattcagtagccaattctcagtactctttatacctgaccatcagttgcatttgacacagctggacactcttccctaatatactttctttccttgattttaagagtatctcactctctgagttttccttctccctctcaggctcctttcctggtctgtccctatctttttgaccctaaacatactatagagctcagttctccagactctcttttatctgtatttgctgtcatggttatctccagattcatgtctttaagtgttattcagactctgatgtctcctagattcttatctgcaggccagccctctccccggagtataaaccttgtacattgctcttctacttaacgtctctgtttggatgtgtattaagcatttcaaaaccaaattctttatttttaaagccctgaacctgtttttctatccataagtgttaattccactttcccagttgttcaggccccaaatctatcagataatttgagttagttccaatttgtaattattagaaacattgagatgaatgtacagtttaaaaatcttttaaggggtcacctcactttctctgacactctacatctaatctgtaagcagacctttttaacttttcttccaaaaatacacccagaaactgaccacctctcagcacctcagtgctccagcttggtgcaggccattcatctgtcccttctgatcattacagaacctctccctggtctctttgatttttttccccacatcctccaatgctctattcgacatggtagccagagtgagaggattaaaaaacaagccctagactatcacagccatgctcattgtatgtgtatcatatgctttctatgtaacttgtgataaagccagagtccttatatcaatgcctgggtctgcgtttccttgctgacctcatttccaacactctacgttgttcattctgttccagcctactgggctcctacatccttttgcaaatgctactttcccaatgaggcctttcctgaccacatgatttaaaactacacagcttctctttcagcacctccccttaccttttctgctttctttcactctaaaggccttatcaccatctgatatgccacatgttttacttatttgtctatctgttgtttattcttccttcaacagaatgtaagctctatgagggaaagtattttcattctgatttgattactgctctgatctaggtccttagaatagagcctggcatggagtaaggcctcagtcaataggttggatgaataaatggtgtgtatgtgtttgtttgattaaagtgttcattagcctgttactttatctctagtctcgtgtcttatttttatatttattttttactttaaaaaattgtagggatatacaaataatatgcaatttgccgtcttcccatttttaagtgtacagtttagtagtgttaagtacacattgttttacgaccaatctccaaatttcttttcatcttgcaaaactaaaactctataccaactaaacaacaactcctcatttctctctccgcctagccttagtatctaccattctacattttgtcattatgattttgactaccttaagtaccccatataagtgcaatcatatagtatttttttctttatgactggcatatttcactttgcataatgtcttcaaggttcatccatgtagcatgtgtcagaatttccttccttcctaaggcggaataatattccattgtagtgtataccacattttgtttatccattcattcattgatagacacttgggttgctttcaccttttggctattgtaaataatgctgctatgagcactgggtgaacgtatctctctttgagaccttgctttcaattgcaagagtcttgtttcatgttgccacattgcattttagaatagtcacgccaatttatacttgcatcaacactgactgtctgcctgcttcactccactgtcttggccatggtcaccaataccctccacaatgctacattcaatggtcagttcttggtactcatctttcttgaccatcaattgcaattgacacagctggacactttcacttttgggtattacccagacgtggaatagctggatcatatgataattctatttttaattatttgttgaaccaccatactgttttctgtagtggctgcaccattttttgttcccaccaacagttcacaagggttccaacttttcacatccctgccaacacttgttattttctgattttttattttttatttttaaacagtagccatgggtgtgaggttgtatctcattgtggttttgatttgcatttctttaatgattagtgattttgaacatctttttatttgctcactggtcatttgtatagctctggagaaatgtctattcaagtcctttgcccattttttaaataggattgttttcttgttatttttgtactttaattttttttcttgaatagcctaaatgactgcagttttgttggtgtgcttatgttaaatcctgaggaacaagtgtaaataagcttaatataatggattagggtggaaaggtggggagtctaattttggcaaagagaatggcatgcattgtggccataggtgagacaggatatgtataagcatacatgcatattggtgttccgtgacatttatatgtagtttacatattttacttgtaataatcccaactgcagcatcattgacattttgtgctggataattctttgttgtgagtcactgtcctgtgttttgtcacatgttttacagcatccctcgcctctgcccactagataccggaactctctcccctgcccccagctgtgataattaacatatctccatatgtttcaaaatgtccccttggcatgaccccttctttctcctcagttgagaaccactgttcgaagaatgaatgctggtatattgtgagtaaaagccgtatctacagtaggctctgtttgtatggaagtcaatattcaacaacttatcaattatatcagtgggtttagcggatagctatgctgtcattgttttatactctaagagctcatattgatgttattgttatttcttattgaacactaactttgctaaaagtctaccattaggactcaattatacaataaattatagcctttctttttttatatttagagaaaagtctgtttgctcctattctgagaacgtgcccaaaacattgaactagagtgttttccttgactttctggatctctggcagagtgagagagagactgagaaacgtttagctttcacttgattttaatagactgcacaaaggaaatagaataggcaactgaataaagtgacatattcatcaatgatattgtaagactcactcagcagcaagaaagggtgcattgtggaaagatttctggggaggattttgacatctccaatactaatgttgactggtttagacatagataagctgacaggcttttgagagtataagctgactaagcatagcccctgcctgactcctgacttccctgagtgtcctttgcaatttgcaatataccattaaaattaaaaccaatattattcaacattctcaggaatttccttcagaaagcattacaagtttttttttttttttcaaaagatactgcaccatttgtatgttggtaatctctaaagattaccaactctaatcttggacacagacaattcatttacagtgaatggctaaatcacaggaacttgattgtatgcagttctcaccctaaggcagtggcatgtttagtttcctcatggggtatagtcatccaatgaagagatgagagtgttcattcaaagcagcaattgtgtttagcaaattgacaattatctaccaattggtgtttactctggccgtattcatgttggttaatagggtgtgttttcttaaaatattaccagaaatgcaaaatgcatgtaaagtgaatgtaatatataaaacactaaaatatgatgtttttctccctgacactttcctgtgttttaaattatggcaaacaaacacacgtacagacaacatgagatttaccctcttaacccacttccacatgtacaatagagtgttaactatatgcacattgtacagcatatctctagaattatttcatcttgtgtgactgaaattttataaccattgaacagcaactcctcagtcccctttatgcccacctcttgcaattttctccacaaagttcaggaataatgggagtcaagagggaggcaaataatccccacatcacctctatttgtctccaacctgcttggcatcacttctgacttcagttgtgctcttatcctagataatttattttttggttggggggatggggtctggctctgttgcccaggctggagtgtagtggtgtgatctccactgcccgggctcaagccatcctcccacctcagcctcctgagtagctggggccataagtgcacgccaccacaccagactaattttttttttttttgatagagttgaggtttcaccaaattgcctaggctggttctgaactcctgagctcaaacaatctgcccacctcaggctcccaaaatgctgggattactagtgtgagccaccatacctggccttatcctgggtaatttaaagctaaaggttaacatttatttagtacttatgtgcctggtagtgtgctaagcccctttaatcattatctcatttaatcctttcaatagtactaagaggtaggtacaattactatctccttttttctctagatgagataacagacttgggataattgcgacggagtttcactcttgttgcccaagctggagtgtaatggtgcaatctcggctcactgcaacctctgcctcccaggttcaagcaattctcctgtctcagcctcctgaatagctgggattacaggcacatgccaccacacccggctaatttttgtatttttagtagagacagggtttcatcatattggtcaggctggtctcgaactcctgacctcaggtgatctacccgcctgggcctcccaaagtactggggttacaggcatgagccaccgcgcccggccttgagcaactttctgtttacacatgaaatatcagtctgaggagcctggcctaaagacatctgcattgagagcctataaccttaacaatctgcgaaaccatatttgaaaaacccctcttccccttccagcacacgtatacccactgcagttctcatgtcaggacaaactgctttataaagaatcaaagcagaatgatgaacaaaacaaaattaaaatctctagtgggatctctgtcctgttcgtattgccaaaatcacataaatgcagaactcatgatatctaaacagccattgccacaaattatacactagatacctataattatacattgaaaggtaagcttgtgaatgtctttgtttttgtagaaacatgctatcacagctttagcgagagtcacatgtctcatccataaattcagtccacagatatatttaatttgggcacaatgttttttaaaaacccaattttaaatattttgagggaatgatgtgtactttccgatttgacacagtcctcaccagtccctgtcttggcttgtctgcttcacttgctcactttacctgctttgccctcacaggcattgggatttgaaatccatgtgtaacaagaaaaatttgggtggacatgggatgattttctttatagatttggtacgtgaatatacaatacacgtattttaccttgaggcttaacttctgacaaaatatttgctctctgattatataaataatatggcctcctccttttttatttttgagcacctacaactaacctatatcttcctcttagattcctactctcttaatgcttgatgctcctgtggtcagaaattgagatgagtgaagctgcattttgggcgggtttctcagagatgctttcaaaaaggattgtgtgtgtgtgtgtgtgtgtgtgtgtgtgtgtgtgtgcgcgcgcgcgtacagagcatggaaggtgtgggttttgaggcaattagaggagtaataggcaagttgcttttctcctgagcctcagtttccttatctgtaaaatataactcatgatacctatatcacatgatttgtatgagattttaataaaaaatcaggtaaaatgcccagcataggttagaaatccagaatatgtcagtatctatctcccttcctttcattcttctcaaaaagttgaattgaatagagacactaccagtgatatcaaagtatatcaaataatttctgatgagaatgtcagagaaaggtagtaataaaaatgtactctcaccaacaaaagctccataaaactgccactcaatgtcaatatgctttattatatataaatttctttatgtgtgtgtgcacataaatgcagcatctctgtatatgttagtgtatgtgtgctcacacgtatgtgttgtgtgtggattaatgtgcatttgggtatgcaagtgggcttgtgtgtgtctctgtgcatgtgtgcacagaaagaaacagagctaggggaagaaaatacattgcacaagatattcaatggtaacccttatttagtatattgtaactcacggtatataaaataaagttcatttatggtgttggtcttatcttctaattaaaatcatgggcatgaagcttttttatacctgcataaaataagcagtttaatttttctgcaccaggggaaaaatgacttcattgcctgttctgtagaccattggtacatgatatggagcaagtgaggctggttatgaaagcttttttttctttttttgttttgagacagagtctcactctgcctgccacccaggctggagtgcagtggcgtgatcttggctcactgcaacctccacctctagggttcaagtgattctcatgcctcagcctcctgagtagcggggattacaggtgtgtacctccacgcccagctaatttttgtatttttggtagagatggggtttcacaatgttggccaagctggtcttgaactcctgacctgaagtgattcacccgcctcggcctcccaaagagctgggattacaggcataagccaaaaagcctccttcttacccattatattcgtcctttcaaactctgcgagcaccacagatgcttcctcaggttttctcaagggcagcttgagtgctttgacccgtttcccctacccctaccccttcatagtgccatgggaagaggaagttatttggtctatgattactctaagagtatttccctgcattattcacacatgagtgaaaaaaagtcattatactgctccatttcttaaaaatttgctgataactagtgatgacttatttcaatgaagccaaagcaaatatttgagaaaagaaagtaagcttgtcttagaagctgtaaaggaataaaagagggaaaggactgtgaattttagcacttaaaagacctaaatttgttttaaagcttattttataatactaatatatgctctgggtaacattgaaaaaatcctgctagttaacacttttattttataaggtatggaaatttagggggctatattttatactctgggccttatggtttagactgcatgatagaaaattggtggcaacatatgcaaagataagaaaaactctaagaggaaataaattcacttgcttatttaggaactcagagaagttgagttgagctggataataaattccaaaaaagttgtgcttctgacgaagccagagacataaacaggggtgcagcttttgctaagatgttttaaggattttggaatataggaacgttgattatgccatggaatggttttaagtgagagaatgtcagaatcagatttatattacaggttgattgttctggccacggtgtgaaacatggattggaagggacaaggctaacatggtaagactggctagagttgtcttacagtaatccaggagagagatttgcatgttttggactaagacaatcgcaataggtagggagataatggattttgtgttaagagttaattgaaaagtaaaatacactgtcctcacggacttattctttcagaaggtgagaaagcagagtcaaggatgcatcttgggctttttgctaaacatggatgttggtggaaacgctcatggagctagggtataccagagaagcagtagggctggaatcaggtaccactgtggggcatctggagctcaaggtgcttgtggggcatctaaatagaagcatcttccaggcagctcagcttccaaatctgtgactgagactcagagatttaggagttttcccaaggcggtgatgattttcaaaaggaaaaggaaaagaatcaggaatggaagatgtcactgagtaatagtatattgagtgcaaaagaagaaagtcaaaatggagggttaaggagtggtcacagttaagggataataagagaaaattgagtatccaaatgaaatgaaatgaaaaggaaaaatagatgaacatggtgttatggaagcccctggaagagaatgtttcaaaatagacggaattgttgtggtatcaaaggctgctatgagtttaaataatggaaaagtctgagtgtctaagcgtttattggtttaaatactaaaaagtttgtctatctttagagagatcaatgtaattgtggcactaggggcagaagtcagattgcactggctggaggggcagtttactagtaataatagctatgactgttaagaatgtacattatgttgggaagtggaggcaggcagatcacttgaggccaggagttcgagaccagcctggccaacgtggcaaaaccccatctctactaaaaaacaacaaaaaaagaacatacattatgccctgtgctcaaagccagtttggatattatcagagtcaggttattattgaggaagctgaggttaggtaactttctcaagatgatacaatattaacagagaactgttgagatttgaacctggtctctctgatgccaaagacttttcattacaatatttctgtccacttgactggaagatgataaaccttctgtgggagaaatatttgctcaaggacctttggggctatatgttttggaaaatatctctaacaaaggaatcataaaaccacttaattaaatgcataaaacaattcagaaagaacaaaacaaacaatgggatcatggcagcatggcagtgggggagggagcttctcacaactaaagaacaatataggaaaaatgctgtgattaacagtggcatggagaatgggatgggggagagagagagaaagagagagagagagagacagagagagagagatgactgtcccaaggacaggagacagaagaccacaaaaaatgttcccggaacttccaacactatgttgaataggagtgttgagagagggcatccctgtcttgtgccagttttcaaagggaatgcttccagtttttgcccattcagtatgatattggctgtgggtttgtcatagatagctcttattattttgagatatgtcccatcaatacctaatttcttgagagtttttagcatgaagggttgttgaattttgtcaaaggccttttctgcatctattgagataatcatgtggtttttgtctttggttctgtttatatgctggattatatttattgatttgcgtatattgaaccagccttgcattccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatgaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagagtcaacttcttcctggtttagtcttgggagggtgtatgtgttgaggaatttatccatttcttctagattttctagtttatttctgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaacagctcctggattcattaattttttgaagggtttttcctgtctctgtttccttcagttctgctctgattttagttatttcttgccttctgctagcttttgaatatgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaggaacatctttatttctgccttcatttcattacgtacccagtagtcattcaggagcaggttgttcagtttccatgtagttgagcggttttgagtgagattcttaatcctgagttctagtttgattgcactgtggtctgagagacagtttgttataatttctgttcttttacatttgccgaggagtgttttacttcccactatgtggtcaattttggaataggtgtggtgtggtgctgaaaagaatgtatattttttgatttggggtggagagttctgtagatgtctattaggtctgcttggtgcagagctgagttcaattcctgggtatacttgttaattttctgtctcattgatctgtctaatgttgacagtggggtgttaaagtctcccattattattgtgtgggagtctaagtctctttgtaggtcactcaggacttgctttatgaacctgggtgctcctgtattgggtgcatgtatatttaggatagttagctcttcttgtttaattgatccctttaccattatgtaatggccttctttgtatcttttgatctttgttgttttgaagtctgttttatcagagactaggattgcaacccctgcctttttttgttttccgtttgcttggtagatcttcctccatccttttattttgagcctacgtgtgtctctacacgtgagatgggtttcttgaatacagcatactgatgggtcttgactctttatccaatttgccagtctgtgtcttttaattggagcatttagtccatttacatttaaagttaatattgtgatgtgtgaatttgatcctgtcattatgatgttagctggctattttgcttgttagttgatgcagtttcttcctagccttgatgatctttacaatttggcctgattttgcagtggctggtaccggttgttcctttccatgtttagtgcttccttcaggagctcttttagggcagtcctggtggtgacaaaatctctcagcatttgcttgtctgtaaagtattttatttctccttcacttatgaagcttagtttggctggatatgaaaatctgggttgaaaattcttttctttaagaatgtcaaatattggcccccactctcttctgacttgtagagtttctgccgagagatcccctgttaggagaaggaaataaagggtattcaattaggaaaagaggaagtcaaattgtccttgtttgcagatgacatgattgtatatctagaaaaccccattgtctcagcccaaaatctccttaagctgataagcaacttcagcaaagtctcaggatacaaaatcaatgtacagaaatcacaagcattcttatacaccaataacagacaagcagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaagaaatggaagaacattccatgctcatgggtaggaagaatcagtatcatgaaaatggccatactgcccaaggtaatttatagagtcaatgccatccccatcaagctgccaatgactttcttcacagaattggaaaaaactattttaaagttcatatggagccaaaaaagagcccgcatcgccaagtcaatcctaagccaaaagaacaaagctggaggcatcacgttacctgacttcaaactatactacaaggctacagtaaccaaaacaacatggtactggtaccaaaacagagatatagatcaatggaacagaacagagccctcagaaataaagccacatatctacaactatctgatttttgacaaacctgagaaaaaccagcaatggggaaaggattccctatttaataaatggtgccgggaaaaccggctagccatatgtagaaagctgaaactggataccttccttacaccttatacaaaaattaattcaagatggattaaagacttaaacattagacctaaaaccataaaaaccctagaagaaaacctaggcattaccatttaggacataggcatgggcaaggacttcatgtctaaaacaccaaaagcaatggaacaaaagccaaaattgacaaatgggatctaattaaactaaagagcttctgcacagtgaaagaaactaccatcagagtgaacaggcaacccacacaatgggagaaaattttcgcatcctactcatctgacaaagggctaatatccagaatctacaatgaactcaaacaaatttacaagaaaaaagcaaacaaccccatcaaaaagtgggcaaaggacatgaatagacacttctcaaaaggagacatttatgcagccaaaaaacacatgaaaaaatgctcaccatcactggccatcagagaaatgcaaatcaaaaccacaatgagataccatctcacaccagttagaatggcaatcattaaaaagtcaggaagcaacaggtgctggagaggatgtggagaaataggaacacttttacactgttggggggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaacccaaatgtccaacaatgatagactggattaagaaatgtggcacatatacaccatggaatactatgcagccagaaaaatgatgagttcatgtcctttgtagggacatggatgaaattggaaatcatcattctcagtgaactattgcaagaacaaaaaaccaaacaccgcatattctcactcataggtgggaattgaacaatgagatcgcatggacacaggaaggggaacatcacactctggggactgttgtggggtgggggaaggtgggagggatagcattaggagatatatctaatgctaaatgacgagttaatgggtgcagcacaccagcatggcacatgtatatatatgtaactaacctgcacattgtgcacatataccctaaaacttgaagtataataataaaaaaaaaaaagttcccggtgcttaaaagatggacatcaaaaatgaaaccttcttctatatgcttctagccttgccccctatttttacctcaattcgacaatgagagactaaatcaggagaaaagttaatacaagtattttttacagaggcccagatgctcctttatgtgctatggtgtacaaatacagatgacttatttatgattaaagttattatatttattatttcctactaactctgtctgtatatgtccctctatcctttctttagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaaggtgaataaatactattttcatttacttcttgtcatccaggtaccaccatgtgaaaatcacttgcttgcttaatccacattttggagggaattcagtgacatttcatcattccaacccaaatcatttcatcattgattttgtctgcagcaactaactttcctttctgctcttaagtatcaaaatatgtagacaggtatatttcacttattgacaatgctattatttccttttcttttcttttttttttttttttttttgacacagagtctcgctctttcaccaggctggagtgcagtggcgcgatcttggctcactgtaacctctgcctcctgggttcaagcgattctcctgcctcagcctcctgagtggctcggattacaggtgcccaccgccatgcccagctaatttttgtatttttagtagagacggggtttcaccaagttggccaggatggtctcgatctcttaacctcgtgatccgcccgcctcggcctcccaaagtgctgggattacaggcgtgagtcaccgtatttcacatttttaaaatgactttctttataattttactcatttgaccttattcaaaacaaccctgtgaaagaagtaggacatacataatattttatagtgacatagtaaacgaaagtacagaaaagctatggcttattcaaaccctccaagctagaagctaggagccagggcttaagtacatgttatcagattccacctcgaggcatattccatcacactatgccaccttgatttggtgacattggaatataccattgctcttagttgagttatagaagggaagcttcaaacaaagtccattttgttattttctaaaaatacattaaagatctagtgaccccaataagacctccttcttgagctccaaatacgtatattcagctgcatacatagcattgtctgtctcttgtatgcctcaaaacctctcaactcaatgtattctagaaatgaactggagatctcgccccagcatagctggctctcttccagtattccctatctctagccatttaattgcaaaattagaaacctagggagtatctttaatatttccttgttctaaacccaccatctgtgatcaatcatgggatctaatacctttttattccatccacttctttctgttaccacttctaaatatcttttgattccatcctcttctttctgttaccaccactactcaaatataagttttgtttgtcatctgaacgattgctagagtctcttccagtatgttaatactacaacctgaaaaaatatttcccaaatataatgattgtgtgcctttgcttaaacccttctcacatttcctctttgttcacaaactaaagaccacagtccccagtagatattaccagcccctgcctgatctggtccctccttctctctcctggttcactgttatcacttccccttgaatctttcagttgcttgccctacctctgccccttgctcccttccctgtgcctggaattctcttctttaatgtaagtctcatcatcgtcagatctcagatccagcatcacttcctcaggacaccttccgtaaactccctgatgaaatcaaatcccttttgatgttctttttcgtagcactatgtatccctcattcagaacacttgtcacaaatgagattttgtgttgatttttggggtcatctgcattcctcactagattacaagctctatcttgtaatcagtcctcagtgtctatccgttagatgaatgaattagtggatgaatgcttaaattctgtagttctctatatttgatcaacttatacttaagaaaagacattttagatgatttcctctttgtatttcctgacatctccagaatcgtactacagtgcttgatgccaaactattatgtaataatgttgtggaatcaatcagtgaaaggaaacagataattctgagcactgtcttacatagagatatccacagaacaaccttggttgaaatagcttcttcactctgctctcttaaatactgaaacagttgctcctcagtgtatatttgaatatgtgattgtgaatttgtgtttgtgtgtgtgtgtgtgtgcatgcgatcatgtgatgtcagcacctttaaacaataatttcaacataacctttctatgtctcgttaaccaagcctcatggtgggtgccaggtgcttaatgccatcccctaaggacacccacatgacatttgcagaggaaaagccactgcaaatatatttctttcatggcatcaagtggatattgtatgaaagacttagccaaatgtcagatagtctgtgactttagaggcttagtatagccagaaattttgaaacagtattgaaaaaagtaaattattcagatgtcattaaatggttggatggtaatttatttataagaagctcagacctcttaaagcttatttttatttctatagaggcaagctgggttagaggcaacagactactcataccaagaggttgataaaccaaatgcaatatgtctcctgtgtatctaagagtatcctttgcctccatctccacagcactgagaacatctggggcattgctcatgaagtacccttatggatataatgcattcaaaatactttcagacttggtggctgctctttcacttgctaaaaatatttgaaaatgtggcagtgggtgttgatggatttttctaatcacactgcacatttctagatatattattccttaggtactctttcttgttgacatcttttgcgtaaagtggctgaatgttcttcaggcccataaagtttctaaccagtgcttggccgttcttcttttaaataaatgatgtgtgaaagcagatgatgcccctggcaacacttgcagagatggcataaaacacctagccccagtcatccaggttgcagaagagtttttctttattttgggggtaatttagtagtttagagtcaaggagagtgatgctgtgcagcagcaaatgaaaatgcaagtgtagttgagattgatatacaaatgtgttatttcagactagagccttctctgatgtgcatgcatgaaggcagctgtttccttctagagaaaatgaaaagtgctagtattaaggtaactgcagcatcaaagggagatgtttgtggtgaggagtgaatcgatgtttccattattgtgcctttgatgaaatgcactagaaatttctttagagttggtaaggctatctcgttatgttgtatgtattacaaaagacctaattgaatgatattttaaaaggacagtatccaattgctttactttcccaaatgctaccccaaagctacagaagacttgccagtagatctcactcagtaaaggcactgctggagaattaaagaaataccttgtggataaaacaaaattgcatctagaaatcgagagatgcacatcacactctgctagtgatatgtggctgttgggttgtgagttaactgggaaacatgtctacctgataccggccaaggcctgggtgtggggaagatcttctgagtcctccaaagctgcaaaggggtggggggcagatgtaccttccatttgaccttgctggagggtcatacctctgcaatcctgatgcaccccagtctactaaagtcctttctgatttctggtcagcttaatttgggcatttgatcaattccttctcttctgaccatcttatgagcttccccactccttctacctcccatgccagctccttctctggcctatagattctcctgccatcttgcattttaatttaaaaggactcagtaaagacaagagattcattcttgggtatctttgtagatattttataagaattcctgaagtttaaaaaagcagtggaagtaataggttatggttgaccaaattggaaatgacaaaagaaaagctactctcctccctccatcttagaacaaaagctctataacttcttttgagggctgtgtctttgtcagttatttaagtggtaggattctcttttgtttccatcaggctatttcctcactgatgactgaaacagcttacactgtgatgtgtttagattagctggagggctcaataatcttattaaaactgagacttttggaaagattttgagataggttttgaagacagtgcaatcctagaaatatagctgctgttctcattgctgtacagagctgaatgtttaaacattcctcattttgacaagagactgcagtttttaaaaaaatgggcacatgctcatgtattcacagatgcatacatcctggcacagggggccttccgtaggagatggagagctgaaaatagctattttttttctgcgtgagaggtaggattgcaaagctctctaataccgtttatattcttggcaaaatgaaactttaacagatacagctgggtttggagatcagagatgagctcaatgggattgcagactccattgttttcagacacttctgggccacagtggtctagaattgcccataattttgatgtaaaaagcactttctgaaatgctagcacacataatgaagggttgctgttatagtattaatagttggggagtgggcatgcagctaaggatttttgttgatcacctcctatccgacaagatcaatagtagctgacggattgacagactggttaagcagctgatgcagtgttaggcgtggtagctggcaacacaggacccagtacagaggaggtgcttgtcccacgcaggctttgccaattggactgtaactggggcaggtgctggagtgtatctggatttcagagggcctaaaaattcaaaaggaaatgtaaacttgacttctggaatgctggatccaaagaaactgtgactttcatttatattctcatttaaaaccctcagattaaaaatgtaattttgttgagatcctccaggattagtaggcgatgataagtttctcagtagctattggcagaaacaggcttcctgtctcctcacctggtggagataaagcttctggggattaactagggatgaccatggctttgaagcttttcctctgaggaatatgagtgggactgaagggcacttttcacttaaagaaaaacattgcatttttattaggtccttttccattcttataaaaatgatttatatataatttaagagaaatatctctagctctgctcacctacagcaagtggccactgctcttacaggtgtctcattagtacaatggaggtgtgctatcttcatcaccatagaaacaccaggaggtagagcaaccacctaatgggtgtggcccataatcagagataccctgtgatatttgaatgttaccactgatctatttgagcagagttctgaatgacagaactggtttaatgttagctatgaacttgtattcagtgagagaagggcagtaaggatctccattcatgtcagtgttgttttcaagaacattcattcgaatgaacaacctttagcaaaatgtggctctggtggcctgtgtcaccccaagcatgctttttcttttcttttttaattttttgaaatggagtcttgctctgttacccatgctggagtaaagtgatgcaatattggttcactgcaacctccatctcctcgattcaagcgattcttgggttcaagcctcctgagtagctgggattacaggcacctgccaccagacccggctaatttttatatttttatgtagagatgaggttttgccatgttagtcaggctggtctcaagctcttgacctcaggtgatctgccctcctcggcctcccaaaatatttgaatttacaggtgtgaaccatgcaccgcacccagccccaagcatgctttttctatatgatgtcctagactttctggtctcttcttcaccttcttggtgtccattttagtaacctgatacatttattagagggaaaatcacatttgctgaaatggaagatacggcatgtatatgctttaagaagggtactcaggcaggcaacagtacctttcccaaagcaattatgttcccatgatagaaattcagccatggcagtgttttagttaagataggtggctccagccacaggtgctccaggaggtagagcaatgcagcctcaggtttccctgtgtactttcatctgctgcctctatgagctgaccttgtctttatgtacgtgctgtttttttctgttaataacactgccctagtgctgactactttgcttgaatccagatcctagatttctcgttttccagttggactcaggaattcttctgcttgtcccttcctttgcaagtccctatgaccttaagctcttgtctgcccgaccaggccaggccacttatgctccctccattctctgcctatatcttgaccactcactgtggtatgaaggcacctggccttttaaactcagggtcattctttcaattttaaaaatgggattttaacatacataccgaaaagcatacatctcatgagtctgatgaattttcattaactgaatacactcatgaaaccagcaacctgatcaagaaacaccactggcatctgagaattacttgcgtgctttttcagccactaccttccaccctcagtggagccactctccgtcaaggtcattttttatttcatgcagacaaactaggaaagcaacagatagaaaataagttttctcaaaagaaatgttagaaggtagcaagggaggtaaacaatagagaagaagaaatactttaaatgttaatattagagaactagactaaaccaaatacaagaatttattgacattcagtaatcccagttaatcaagaaaattcataaggacaatttgaaaaaattttcatttaaaattaacaggtttcagtttttaaaatgtatcactttctgtacgataattataatacccagtgtcgggtattatattttgaaatagtattgatgggtgtgcaaatgaattttccttcctggaaaatatcttggcaatatatatcagaaaacatacacatattcataactttaacccaatggttcagttcagaagctctaggcataacaatgcttatcaaagtcatttataatgggaaaaactaggaagaaacttactgcctaacattaagggactttaaattatggtatatacatttactggggtattatgcaaccattaaaatagtgaccataatatccatgtagcgacataggtatatattaatacctattaaatacatacaggcgtatcttggagatattgtgggttcagttccaggccactaaaatgaagcaaatatcacaatatagcaagtcatgtgaactttttggtttccccatgcgtataaaagttatttttatgctatactgtagtctattaagtgtataattgcattacgtctaaaaaatgtacatatctcaacttaaaaataccttattgctaaaaaatgctaatgatcatctgagccttaagcaaattataatctttttgctgctggaggatcttaccttgttatagatgactcctaagggtggtggttgctgaagactggggtggctgtggtgatttcttaaaatgaggtaacagtgaagtttgctgcactgacaactcttcgtttcaggaaagatttttctgtaacatgcaatgctgtttgacagttttttacccacagtataacttctttcaaaattggagtcaatcctctccagccctgcaaccctgataaatcttgctttatcaactacgtttatggaatatttaaaattctttcttgtcatttcaacaatgtttacagcatctttactaagagtagattccatctcaagaaaccactttcttggctcatctgtaagtagcaactccttatctgttcaagttttatcatgatattgcagcaatttagtcacttcttcaggctccacttataattctactattcttgctatttctactgtgtctgcagttacttcccccactgaagtcttgaacctctcaaagtcatccatgagagttggaatcaacttctttcaagctcctgttcatgttgatattttgatctcctcccatgaatgttcttaaaggcatctagaatgatgaatgctttccaggaggttttcaatttactttgcccagatccatcagagaaatcactgtctatggcagctatagtcttatgaaatgtatttcttaaaataataagacttgaaagttgaaatttctatttgatccacggtctgcacagtggatattgtgttaacagtcatgaaaataacaatctatttgtaaatctccatcagagctcttgagtgaccaggtgcattgttaataagcagtaatagtttgggaggaatctttttttcttagtagtaggtctcaacagtgggcttaaaatattcagtaaactatacttaaacagatgtgctgtcatgcaggctttgctggtccatttatagagcacaggcagaggagatttagcataatttttaagggccctaggatttttcaaatcataagtgagcattgacttcaacttaaagtcgtcagcagcgttagcctgggtgagtcttccgtcctttgaagctttgaagccaggcattgacttctcctctctagctgtgaaagtcctagatgacactgtcttccaatagaaggctgctcattgaaaatcttgttttgtgtatccgccatcatccatgatcttagctagatcttctggataacttgctgcaacttctccatcagcacttgctgctttacctttcacttgtatgttatggagatggcttatttccttcaacctcatgaaccagcttctgctacttcaaacttttcttctgtagcttcttcacctctctcagccttcatagaattgaagagagggctttgttccagattaggctttagcttaatggaatgttgtgggtgatttgatcttgtatctagaccactaaaactttctttatatcagcaataaggctgtttaattttcttatcatttgtgtgttcactggagtaggacttgtaatttccttcaaaaacttttcctttgcattcacaatgtggctgtttggcgcaagagacttcactctcagcctcctggctttcaacgtgccttccttactgagcttaatcatccctagcttttgatttaaagtgagaaacatgcaactctttcacatgaacacttagaagccattgtagggctataaattggcctgatttgaatgttgttatgtcttagggaataggggtgcctgaagacagggagagagataggagaattgtcagtagatggagcattaggacacacatatttatggattaagtgaaccattttctacaggtgtaatttgtggtgcacctatacaaaacaattacaatgataacatcaaagaacactgatcacagatcatcataacagatataataataatgaaaaagtttgcaatgttgtgagaattccaaaaatatggtgtagaaacacaaagtaggcacatactcttggaaaaatggtgctgatagacttgcttgatgtagttgccacaaactttaaatttgtaaaaaccccaatatctgtgaagcacaatgaaatgatgtatgcctgtacgcattacatattacatatataaatatatacaactgcgtacataatatatattaagacatacttttaaatacaagtatgcaaaaaataaggtaaggtaaagaaaggaaggaatgaaggacggaacgaaagaaggaaggaatgaatgtaggaagggagaaaaaaggaatgagggagaaaaattattttaaagaatggaaggaaatattcccaaatactagctaggtccgttaagatgatggaactatgtttgtggggcttttttttgcataccatttcttttccaaattttttattatttcattacattgctttcataattaaaaattctttaagtaatataccatgactagtttatgtttatcctagttataaggcagtgctcttaaaaaatgctttagatgtgaatggggctgatttagtaaaaccctttcaaatcattatttaatcccttttcaagaaggagtatgttgtagaagaaaatttccctgaactaaaatatgcagcctgagatttctcttttcttcagcgtttttttcactgtcgtccttttagaactctgaaattctaggaatatttttttttctcctaacaaaaagtgtactcttgttggatgtaacctcaatctatattatttacaactcagcaacaaatgtagggtttattattcagaacgcacccaccataggtagatgttaaggaagtgatttattctggtagtttttcagatgaattttccggctccatcccaaaattgaattagtatttgcttatttgctttgacagctgtaatggaaataaatgattctggagccaaggggtgtagacaattctaatgcattgagctttgagcctaggaactcttacatgccccatgttactttactcagagttggacgtatagctgctccttggaaatagagatacatgtcctgaagtaccaccttcccatgtgtggcactgacaaattctctcatatatgtgattatgttgaattttcataagcagctgccaggtagatattatttccaagatacagaggagcatatgactcttgaagggcattctaacttgttcaaggtcacacagccagtgaggggactgcctgctctctatcctaggcctggctgaggtacagccaccacaccccactcttcctggttgataggtgggctttcccttgccttaagacagaaccgcatatgggccacttttacgctgaaccccagctccagagagcacaatagagtaagacaacaaaatcagccatgtggaaaccaaaccttcaaatgaatccagtggttcttatggcatatttctcagctggtggcagtttctggagtgggactttgagggtagaagccatcagactgcttgctgatgataagacataggactaattaattctgcctcaagcaaaaaataaacaacaacaaggcagttgtgttttaaggggattttgtccagttttgttcgcttttcccattaatttattcaaatctttgagttaatatatagattaaaccaaggtgtttgtcatttaaataggtaatactatgatctcaaatttttaaaggaagcttttggagacaacatctttaatatggtaatgaagagagaagttgaaatcatgtaacttcatttacaaatcatgaatatgtattatgctttaaatgaaaagaaggactaaaacagatatagtgtttgttcaatttgctaaagagaagacaatttgtcaagattctttccccaaaactcaagcaatatgcaaatgtaggaaaatcagacccccgtgttaattccatggcatgatgaatatttttataatcctaattagtaccagtcatttagtctagcaatttcccccaatctagccaatttgaaattaaaatagatgccttgattacaaaactcattagcaaagaagcacccttctcactaaccagttcatttaaaatgcacaaactgaatgaagtgtggaacacttgtgttgtcaattggcataagtgaagtgagtcttaattggaagcattgtgaagtatttgtattgctgcgtgtttcattgccgtataatatatcattcattaaatgtaacaaaagcaacttttaaatggtttaattaaacggagtttgtgcacttggtaatttttataaaatcaaatgtcacaattgtttgcatttgaagtactgacaggtattaatgtcaggaagatgaagtctgactctgcatgtatcactcagattatgcgaagaatggcaggtttaatgtgagaggagaaaattaattatagaacattgacttcttacttaaaagtaccaacgtgcatattgtccttgtgaatttgggcataggaatttcagaactacctgatttatggctggaaatggagtggaagggcctggcagaggactaggagtggaatataaggagaaaataacagtctggaatttttcttttgtaatttcatttttaatcaagggaggaagtagtaggtggagagaaatgctatcctgtgtattttcatctactccaaagagcaatagagatgtgtagcaatgcagactgatgttctgtctaagcagaatgtgatgcaagtgggatgggggaggaaattggcttcagaccagggaaatgctgcagatggggactccacagaagtcccgaactgaggccagagagcaaggagttcaaggatgattttccagtggaagaggaggcacaatgggctgtaatagtggctgttctgtaggcataaagtataaggcaaatatagaagctgaggttcccctgatgtttcttctctgtgtaatgcaggtgtcagctgttgcctcatatttatgttatttcaacccacttcaacaaggaggcaaaactcagccatgtcactgatttctgtgagaaatcccatgttagcagacactgttgatgtcctgcctatacccactagatatttctattctagtgtgctcctgctgatttctgactgccaatatttgcatttctttgcctgagggctttctctgaggcctctggaggctactctacccctctgtgcagaaagctatagaagtacctgggaattaggggcagccttagccaaagatagcagaatttggtgtatagatacctcagctctttcactgtcatgtgtggtaactctgagacatatgtcttatactttttatctagaatttcccaatggaatgaaactctagttgcccacaaagttggccagcttcgtagcaccacatattgactgcgttctcttacttgggtaattttctactttaataccaatgggttttattttttcatctcccaaataaactacttacactctagtccttggcttggggcctgctcctggggagactctaaccagttgtgccaaatattatgtgatcttggtggtggtagcggaagatttgtgaggtcaaggatggggatcacaaaacctaggtttccacccaggaattaccctttgacatttctatgttcctaatctctcctgaacccctccaactccccaggctgtccacctgggacacctgtgaatatgttactctagggaaaaagggactttatagaggtgattaagttttatcccagattatcttgagggacccaatatagtcataagggtccttttaagagggaggcaggagaattagagtcacagaaagatgttacacagaagcagaggttgctctgagctctttgaagatgaggactggctggaaaaggcaaggaaatggtttttcccctggagcctccagaaggaatgcagtctggctaccttgattttaacctcataagcctcatttcagacttctcacttccagagctgttctagaataaatctgtgttgtcttaaccactaagttagtggaaatttgttacagtagcaataggaaattaatacacttaccagcccttcccttggcttcactggacctcctgtcccagagcaagcaaaatcaactgcttgtctccaccagcttcttgaaagcccaggcatcgactgacccagagacggtgcatccaggacatacttttgactccagtttccattgatccctgtggtcctgaaataagaaaagtttctccttgcgggtggaaaaaaaaatgttctctatattgtttacttattgtagcagtttgtttggggtgctatagcaaagtaccacagactgagtggcttaaacaatagaaatagactgagtggcttaaacaatagaaatgtatggcctcatggttctggaggccatacatttctgagatcaaggtgttggcagggttgatttcttctgaagcctctgtctttggcttgagcatggccagcttctctctgcatcttcataagatctttcctctatgtttgtctttcctctacgtgatctttcctctatgtctttctatgtcctgatttcctcttcttccttttttttttttttttgagacagagtcttgctctgttgcccaggctggagtgcagtggtgcgatcttggctcactgcaacctctgcctcctgggttcaagcaattattctgcctcagcctcccgagtggctgggactgcaggtgcgtgccaccatacccagctaattttgtatttttagtagagacaaggtttcgctatattggccaggctggtctcgaactcctgaccttgtgatccgcccaccttggcctcccaaagtgctgggattataggcgtgagccactgcacctggccgatttcctcttcttacgtgaacattgcttatattggattagggcctgctctaataacctcatttgaacttatttacctttttaaagacccagtctccatatatagtaacattctgaggtactgggggttaggacttcaacatgtggatttgtggggatgcatttcagcccataagacatatgcatgtcaaggttgctgaataatgaaagtcttattgccctttgtgtccctgctgccctgtgtgagggggacagtagaagtctcttcctgctgtgtagcatgagatattcccgagacatatggaatggagccaaccaccaggaaaattggcagtagggtgtaggggagggagcagggggtagggcttatttctgagatggaaaccagatccatgtgagaggccctgagcctggtcaggaagattccaagctggtctttggccttgaccctggacaagattaggaaatcatggaagacacaagaaaaaagatggtgcccagaccatgaggaccccttggaagaacatcgagggatcagagtctaaaagaagtctcagatggaaactcgtattttagaaccatggctatttgttgtataagctagacgtgttttgtttcagttttggcattttgtttttgttctccctttgtatttgaaaatgtcagcagatctcagatgtgccagaagttacagaaagtttggttgacctgaatgtgttgcaaatcttcctgaagtttatcattggcttccccttagcttggaggataaagtgaaagcctttagctcagcacatgaagccttttaacgtggatcctaactttctacctcctctttttaagcactccattcactcatgcaacaggaaatgtgtcttcctatttcacaccaaagtgccctggcacacatgctttcttctaggagtcctttacttccccacttcatctagctagttctgagtcctgctcatctttcaaaactcaaagaaaacaaaactttctggagaaagctttgcctagacagactttacctatgaaaccctaactaatctaggtttttaagaaacgtctagaaagaaaccttttttgtttaatggttttacatttattaggtatgttttttttttctctgtgtttaggacatttaaagacctgaatgagagttaaagaggacctgtataaaggttataattatggggctggaaagaaagggaaaaattatcgagtgatttgaaaacagaatcaaaatttttgactgcctagaagtcacaggggagagggtgcctgataacactgaccatgacaagaatcaaaggacatcatagatctgatggtctgattgcctacaaaaatatctaaggccgagggctatgcctgctcatggcacacttctttcctgacaaaggagatgcttgtttcccaaatgcactaagtggaagaggggagcgtctggttggcgctgttgccgaggtgcactgtagaggggataatcaccttcctttgtggttgttcttccctgtagttgcttttctgacattttgcctcgtgcctcccttggctgctctcagagccggaggcaggatctaccagtagctgtctgagtaagttattgaaacaggctttttaaaatggagactttaatttgaagtgtttggtagagataccagggttgtaatctagaagctttctaataggcagctagggaatgaatgaggggaaaaaagatacgttagcttttatttcttcaaatatgatcatgtcaatattgggcatgaatgttttcataattgaaatgctgaaaggtggctgggaaattcactctcccttgagtctatctcaggcatagatggtctcttgaactttctagcccagaggcttcagtccctgaagggagctttaagatttcattagtagatcattactcttgatataatctgcctacccttaggtttgcacaatgtttttccctttttttgatgctgaaaatgccagtttaataatcagggaaaaagctcatttaatctccattataggtatcatgacttaatcattaaagatactgaaaagtatgccccaacatttgtcttttttcctccaaagtagcttactactcaatagcagagtctgacaaatgctaacaaatatccatttttaaatctcaaagaaattttctcatagtgaatactggtaaaaaggaaaatgaagaaaagaagcagagacagcaaaatccatctgttcccttccagcacatgtctttgagagtatcagtaccctactgtctattacccagataccaaatgaagtacatgatactcaacaaatacttattgagcacttaccatgtaccaagacctagagatgcaataatggattttgttaccatctttgctatcatacagagagaactgctgatcaaataagtaactgatggcaattgcaataagtgctgtaaaatagaagcatggatggttagagtatatattagggaggaggtctgacctatctacaaaaatgtttgatatgatttctgtattgaagagttaaggtgttcactgagagtgaaatctttttagatgctcataagcattatttaacataaaactagggtcactctgtgagttgccttcagattttttaaacaactttattgaggtataattgacactcagtaaccgcacaaattaaaatatataaacttgataaaattttgatatgaatacacccatgcagtcatcactacagtcaagaatctgagcaaatccgtcaccttcaaaagtttccttgtgctcctttgtaattcttttcttccatcctttttcatcccctcaccatattcacaattggtggtactctttatatcactagagatgagtttgcattctctagaatttcatataaagggaatcataaagtatgaacccttttttgcacagcctgtttctctcataattcttttgtgattgatttatgttgtatgtttcaacagtttcctcttttattgtttcgctgataatattatgtggacatagcacaattagtttatccatccacatgttaacgggcatttggattgaacctaggaaaataaagttgcaatgagaattcatgtataagtgtgtttatgaacatttctcttgatttctcttgggcaaatagtagtggaatggctggatcatatgatagaggtagtttcaaatttttaagaaaatgtcaaaccatttcctaaagtgtttgtgctattttttcatttccactaataattcatgagatttacagtttctttatattcttagtaacacttggaatagccagtctttttaattttggcttttcttttttctttttcttttcttttctttctttctttctctttttttttttttgggatggagtcttgctctgtcgtccaggctggagtacagtggcatgatctcagcttactgaaaactttgcctcccgggttcaagcaattctcctgcctcagcctcctgagtagctgggatcacaggtgcacgccaccatgaccggctaacttttgtatttttaatagagacagagtttcaccatgttggtcaggctggtctcaaactcctgacttcgtgatctgcacgcctctgcctcccaaagtactaggattacaggcttgagccaccacacccagctaattttagcttttctagtagatgtgtattggtagctcattgtggttgtaatttccattcttttagtgactaaggatgttgaacatcttttcatgcacttattttctatctatatgttttctatggtttttgcctattttaaaatgggcaacttgtgttcttactattgaatattgagagtgtttctatattctggataaaagtcctttttcaaatgcgtgatttacggtgctttctcccatgtcatagcttatcttttaattctcttgacggtgtctctcaatgaagagaagttcatagttttgatgaagtacaatttatcaattttttggatcatattatttgagtcatatccaagaaatatttgcctaagtcagtgttacaattatctttttattttgccttttactagctgctattatagttttaagttttatgtttaggccaataatcaactttgagttaaattttttatatagtgcaagatatagatcaaagtttatgattattgcatatggataccaaattattctaacacagtttatggaaaagactattctttctccattgaataacctgtacagttttgtcaaaaattaattggccatatatgtgtgggctctattctatgtctggactctattctgttccattgatctatttgcttatcttgacaccagtactacattatctggatttcttggtcactgtggtacttcacattttcatatgaatttgagaatcaatttgtttatttctaccccctacctccaaaaaaatggcttttggaattttggttgggattgcataaagtccagtagactaatttgaggagaattggccttttaaacatattgagtcttctgatttgtgaacacagccatctctttatttgttttagtttccttttaatttgattcagtgatgttttatactttttagcttatagatcttgcacctctcttttaatcaggtttattcctaaacattgcgtaaacttgactttttaaatggcatttaaaaaaatttctgctgtttttgttgccagtacatagaacaaatggaaaaatcagtaagaacataaaagaattgaacaattcaaccaactaagttaactttattgacatctctagagcacttcatctaacacaagtagagcacacactcaagtgcccatggaacatttatcaagataggccatattctggtcatttgtgactgagtacaaatattgtaactttaatctggaaaatggtactattttactagtttctgagaaatatgaaaattacttaatgtgtgagaaagcattttgaaataattagagggattttcagagctaagacttaataatagaaaaaaaaatttttactaccaaaatgtgtcttcaaatgtcaagcaagtacaaacttctgccctcacctgtcactgaagaaggaaagttagcatctcaagagttcagtggagggagatccagcggggatgtgtggatgttgagaagagtggcatttattttttcgatgatccctggaagaggtgtgagatttgcacatggagaggatattctagatagtgcaaacagcccaaataaacttgtgaaggtggagaaagggggctatagctaagattagcaaggggaataataggggaatgtgatggagaataataggaaatgtgatcagaaagttactctgaggtcagagagtgaggtatttgggtgctaatctgggaaacttatgctttattatgtagacaggaaactatttcttttaacacagttcacatggaagttgggaactgtctatattaaagtaacaaaggctatttcagtaggtaatttctttcgtatgaactaaccattgaaaacctaaaggaaatcttcagttttgcctttcatcaatttcatatgaacccctaatttgtgtcataactttagacatgaacacttctgattgtgtttcttttgttttgagacttaacatttccatcaataatctgatcccatctaggaaatcaagtctagatcaggcaataccctgactctaaacctctgctgttataatcattggaaaaagcccactgtagatgcttccagtcttgggagaagaagaaggtacatcagggattgagggtgaggaagatgcatatatgtgctttttgttttcttggggtctgtcccttgaggattatctctacagcctttagaatctgggattcacagtcgagcacttacagatctcctcttcttcaatgtctgtgtcatgtgtgtatcttagctctgtaacatggctaattttctcatgccagagcctcctttttcattcagcaaatctttactgaggacttgatggatttaaataattgtacacaatgcttgtgtggatataatgatgaatcaatgaagtgtctccatctggtagaatggaaaaagtaatgaactgttaatcacatatggtgctattggaaccttagggacccagtaaagttctgagatgatcagcaggaaatggcctttgtagactgtacagaatgggaaaggcagaatgctgaatgttggagaatgagggggattttaccagtgaaaggaacctaccgggtgtttattaggtgctcaatacatacctgatgacaggtcagttatggaaaaagaggttcagttgggaagaacatataatttggtggaaatctcatagtttattcccagttgaaagtagacttccttgaaagagacagtgcaaggctctggaaagagaattggacttggattctaaaggcctggatttaattccctgattctctttttcccagatgtgttatgtcgggtggatggcttaacctctctcaacctgcctcattttctgtacattgaaaataatgatggaaagatgacaggtgtgctgtgagaatcaagcaggagaaattatacagatgtgctaagcactgttttgttgagagatctctgcttgtcataaaccagctctgcagaattctcctccaggcctcacagctgagcagaggatgtcaattttcatatgatttgaaattttcatatggttaacccaactcagaattcctgctccttcagggcagttatttttttgtatctcttcttctttgctactttgaattttaacctttctaagacttcaggggttgctttctctggactgaagtcatctgctaagattctttgaaccttcagtctccttaatgcttagtttttcagattcagaactagaaaggccagaggtctcaggcagaggaggccagctgggtaatagttggctaatgggaccgtacatcactgaggacagtttcccagtggagaatcatcggcccttgagtaatatgaagtgtggacatctgtgactggcttatctttactcgttaagtcacaagctggggttcggactccatttgcaattcatcaaggctcatgttctctaattacagaattaaagacaggaatactcagatgatccaggtctttgtctttatcgtggaagtatacacaaagggggaagttatgatgatgtgtgaatgatgacattttcagcatttcagcagtgccagtgtcacttgatggcaaaccttcgtattactggtgtagatgcatgccctcatgctccgttgtaaaagtggaaaaggagagaaaaaaatacatcatttattttaaaaccgtcccttttttgtttttactaatacttctaggtatataatttattttatatgctctcattggtaaattctttttagtcatttttgctgctgttttatcctctactttttcttaactggttcatacagaatctttgagctagataggtccaaccctgaaaacgtttgtatattggctctgaccagctgccaagtagttttgatttacatacttccagtttgagggagctcaatccctcagaaagcagacaattccagttttagaaaactctagttattagccaagggtttatggcattaaaataaaatctgcttcatctaaatttctgcctgttggaaatagttttcccttattcactaccttgttcaaatattgtcctgtgctctgaaatccataagcaagtcctccccactccctgcacaacttcaaatagatgtccttaatacctgttcctttacccttgtcttatggaggttgagcatctcttgctccacaggatctcttctgaaaaccctgatctacaccccatcatataagggggaggcagaagggtttattccccaggaggccacccttggccattcagacacatacaaagagtttggaagaatgctttatgatcctttactctgggatcatcgtggtccagcccattagtccacaagtgggactcagattccaaagtggtttctctgctccatcccactagctccttctcctgtgattattttatcccaggggttttcatatggccaccttcttgtgatgggcagatgagtttcctttctctgtgactacctgccttttacttggcccctggtcctccaaaaactttttttttcaataatgaacaattcagtatggtggtagcataaagtacagtcttcctaaagctcagctctggtcatgcattcacctgctgaatgaatgaatgaatgaatgaatgaatgaatgaacaaaatacaacaaaattaaaaataaatgtcccaagccaacaaaaagacaaggacagaatcctagaaccaatatttagggtacagaagaaaacagagtgggaatagaaactattaagtacctaatctatatcaagcactgtgctaagtgtattactctgctatctaattgtaatattctagcctctatttgttcattaatcccaagcctcatggtacttatttttgtgtgggtatacgtgtgttcatgtgtgtgtgtgtgtgtgtgtagctatgtgtgttttaaatattagcccattttcacatggacttgtctatgctgctttattataaggtgccccggattgtagaatattccccaccggtggtggtggtagtggtgtttgttttctttgttgttgttttgttttgttttttgcttctgtgtgagccatagaagtatcaatggacatagacagttttatgtatatttatctactaggaattccggcatctattgtgcagattttgtgagtccaaatcatattcatagctacagctagcttggggttttattttcttttgtgtgtcaattcctatgctaccaccaacccctgcaccctaatccaaggcactgatcagaagacagtttgctgctgcatgctcagatagtggccaacatattggagggcaccatatcatgtatcagataacacttcaaactttgtatattgggctcatttcccattgtttaccacataaggcataaagataagtgtcttttccttatgtaggtattatcactcacccatcagttcccagaacttaggtgtctttcccaaaacaccatgggtcattatcgagtcagatactgctttatttttgaggtcttagtttgattttgacactcagcaatttaattcgaggctcagaaattatttaagatttttgaattatactttatctattagatcaaaatgtttgttgggagatggggttctatccagttggaaatgtggcttttgtatttctcctagataattttcagactaaccatgtaaggtaggtatcattaactcagctttacagataatgttgtgaaggttcaggatagttaagtaagtttttggaggtcacatagccagtaagtgacagaggagagacatttaggagccagcaaaggagagagaagaagaatgtttctggaagcaggaagaaaaccaggagtgagcagtgcctttgaattcacggaaggagaatcgtgtaaagtttggagaagaatcaaatactgtagaggggcaagggctgagaaaattattggatttggcaattttctagagagaacagattgtgtctaagtggttctttgaagtgtgcctggagggcagggattgtgttgtcctgtatgcttccttcagcaccacttgaaaatgtgcacttaaatgttttttgatggtgatgttgattatccaaaacatttccttgaaatagcactttccattgcaaaacttatgcaaggatgtggggtcaggttcagcttcatgcttaccctttgaatatacttgttctctgggaggatgcctatagaacccctttaagggaaaaagatggaaaggaaggatcagttagtgacaggtcaattaaaagaagcagtttcgctaactctagccttgaaagcagaggtggaacattctttcatgaacacagacaagttattttgtagtatgctaagctcttcaggcacaatatgtctttcaatcctttggaaaaggacacaactgttcccatttcagagaagaggaaactagggttttagagcatccaagtgactcaaattatcagagctagaaatgacagaattgagattcacagacatgtctgacttcatagcagagcatcttaattcttcaggtcccacagtgggatctgttttaagtggttcttgaaatttccctggacacgtggggaatgtgactgccaaaatcaaaatgagagagatcaataggtttcaaattatctttcagacactaagatgtgtgcccaggtaggccccaggtgatggatgattaaggaccttcatagcctctgattttggcccactggtctctcctgaagagcagataaaagagtgtcgcaggctggagaatgggtgcctgcatcgtgacaaaggaggggagaccaagagattcaccctgcttcatatgaagccgtttctcaacctagctggaggtgacaggttcatgcatttaattattcattcttcccacaaacatttatgggttcattttcacagaataaccttttattgaagactgacttgtgatggcagtaacctcagataggtaggaataaggatttatatcctagagagtaacatgaaatgcctaccctgcatcaggcactgagccggggtataagggccacagaatgaataaggtagtgaagaggtgagctgttcaatacagaaacctctagacacacgtggctgtaaattaaattgaattaattatgaataaataaaacaattccatttctcaatggcactaaccacatttcaagtattcggtagccccatgtgactggttacctaccctcttgggtaatgcagatgtagaacttttgcatcattgcagaaagttctactggacagtgtcagtgagagcgagtgttggctctggagtcagaaggcctggattggaacctggctctgttccttagcatctgtgtatttgtatgtacttgagtacgttccttagtatttctgcttttcttcctttacctacaaaatagggagcacaattggaacagcaaaataaggaatatcatatagagtactcgctgtgttccaggcaccattgtattggctttatttgtattaagtaatgtaatactgacaactaccctactaggtaagtgctgttactatccccgtttcatagatataaatgcaggcacagaaaagttcatgcagctcatgcatggtggcactgggaagtaaaccctgacagctgggatctggaatcagggctttccatctttgttataattcctaacaatggcatcgctctcatagtgatggtgggagaattaaatcatttactccactaagattgtaatatctgcctggcatggagtgaaagctgaggaaatgttagttattataatattattctggccttcaaggaatttagagaaactctactttttattctgttcaggagtctaggagcagtggacagcctgttcctcttgttagtagaaaatagcaaaacatggcagataaaggagcttagtgggagacacagcccttagccttgctcttgcctaccctagatgtgtcactgcccttctctgcctcagtttcctcatctgtaatatggggattgaactagaatgtccccgaactctgcttgctttttccaaactctctgattccatgattaaatggagcctaatttgtgttgtgcaattcgaagttatgtataaatattagcttatgcaactggttaatcacttagtgtcagataaatatgcagagcaaggtgtttaatatgtttacataaactgtacaaaccacttttcattaattgtgcttttccagcgtcctagcaggagcgtgttgaagcagggaacttgacatgggtgcctgtccccctaacttttcatctggacctcgctttgatttattccatgggctccttcctgtgcacttgggaactggggctttgaaaatgtttatgccaacagttcagcccttagaactggcagcacacaaggtgttatctctgtcttcagacaggctatgcttcttgtgggcacttcatttttcatccagtcagggaaaagatgggaattaccactagtttacacctggatgccaaacctccttgtttcctcttatccctttcccctcctttttttctcttctctctcttttttttttttttaccagagaagatccaggatgatttcagggcagttatgggaagtttctcaggtgtgataaaagttctctgagtttttgttccattgatttttatgggactgtgggtggctataaaatcagagtgggtacagtgcagctgtctgcctgacagcatggactatgtaggaagcctggcggggttggggccagagcaggatggacagagaagggatgggctttgatgctgtaccagccaggctctgcctgggagcagaaggttgaccttggctggaatttcagtaagaactgagtgaagggactctctacggagggatgtgcagggtttaaggaagcaacatggcatggcaaggcacccaggaactagcagcagtaggaggcttttgaacctgggcctgaaggggcaaggacaggaaaccatgttactgaatttctagacagagctggaattaaggggtagggggtaccgaacagctgaagtcaaagggattggagcttctgccagaaacttggggactaggcaggataggaagtggagcagataaactctaacctctcctctcctcttcttaactaccagatccctgctgtttgtttttgtttttggttgaatgcaacaggatggcaaaacgcaaggaagccaggtgggctaatgcagccatatgggtgagccctgtgggggtatagaatagagtagaagaggtcagaaaatgactttggggtgagggcaaatggagaataatcagcacagacagatgtggagagctgtgtgtgaatgtgaggtaatagagtgaggtggggggaagtggggggcggggggagtgcatcgagaatgcaacgttcagtcttatcaagtctccccttcccttccaccattcataatcagctcctctctaaacaggccagcatgaaatacttactgaactataaccatggagaggcaaccatgaatatggaaagggcatttgatgtgaattaggtagatctgagttttctttgtaatcgtgatatagttccttattagctaagtagcctttgaccagttactcaaactttctcattctcagttttcatatctgtaaattatatgaataccacaagattgctaattatatgaataccacaggaatgctattaagttgaaattggttaatgaatataatacacctagcccaggacctggtgtttagtctcacattcattcaacaaatgcacccttgggtgagtagaattagccagggcttttgcattcaggtagccaacaggttggttaaaagtggatattcactgtatatacatagaaacaaacatggaactacacaaatttttgtgtaaaattatgttcattacagacatatatgcatagattcatacccaaagtgttaagaaggcaaagaccagggtgatataagataaagggaggaaagcttatattggggattagggaaatcctctctgaggaagaaatacaaaggctgagacttggaggatgagtagttgctagccagtgaagtgttcagtagtggggggaggaggaataatagcaggggtagaattatatacaagatggaacaccgttctcctttagatcttctccttcattggctattccttccagaagactttcatggttctgtctcatctttgtaacctctctaaataaagaagagcccttgagcacagttctcagacctcttttatctctgccctcactcactcccttcatgatctcatccagctctcagttataccacttatttgtcctaattatcagcccggatctctcccctaaatgccagacttgttcatttaactagctacttgatatctcaacatggatatcttataaatatgccaaataatccactctaaaatttagcaccgggtttctattcatttcctttcactaaatttcctcctctcgcagtttaattcttcaatttcttttctttaagatggagtcttgctctgtcgcccaggcttgagtgcagtggcgccatctcggctcacaacttccgtcccttgggttcaagcgattctcctgcctcagcctcccaaatagctgggattacaggcacatgccatcacacccagctaatttttgtatttttagtagagacagggtttcaccatgttggcaaggctggtcttgaactcctgacctcaggtgatccacccgcctctgcctttcaaattgctgggattacaggcatgagccaccacgcctggccaattcttctaatttctcagggcaaatactttggagtcttggctcttttcttcatttcataccctgcaatcagtccctaagcaaattgtcttgacctacttttaaaatacaaacagaatcacaacactctttacttcctcctcctctactcacttctggttcatgtcaccttcatccctctctcacatggattattgtaacaacctcttcctccctaatccacataccatctactctccataaagcagccagactgatccactaaaatataagtggtattatgtcatccttgcccaaaaatctccagtggctctcatctcactcagtatactttaggtcttccatggctcataagattatacataatttccacttctctctgccattgccacttctctggccttatctctctgtgccccaaccacttaattttctttgctcttcttccagttgacaaacacagtcctgtcttgcactgtttgggatatgattatccacttggttcaagttctcactccaggtttctgctgaaatcacatctttttggaaatgccttccccaaccatcctatgtaaaatctaacttcttctcaacttacaacaggcaccccttatcctgctttatttttcttcataatagtttggcatcattcagcatgttaattcttatctgtggcatgtctgttactcccagtagaattagagctctaggaaggaaaagacttggtctcctttgacccaggctgcataggatgggtgatctagacttacctgttgaccaacagggtaagtgagtgtgagaaagtcccagcacaagatcttcactctagtgacagctcacattctagtgaaagctccttccccaaagaagaaaaggaagttattctaatctagtgttagtgacttcctttcatcctgaagttctacctagtggttgggcattttaaccagttggttaattaatatttatgaggaatctacttattgtgcagccctgtgttcagtgttatgagagatacagaaaaatatgtgatataatttctgctctcaaggatctttacagtttagttgaggtgaaaatacacaaaacaacaacaacaattaataccaggcagtggtattaatatgaatagctatattccaggcagtgcaccaaacctttacattcagaatctcatttaattcttataacaagataccattgttatacccatcactcatcctcctcccagagaaacaaacaaacataagaaaacagaatcctagaaagcagaagtaacttttccaagatgaatgtgtgagtgtgagtttgtgagagggaagaaagtgagtgaaacaacagaagctgggttcagatccacctgcctgacattcagagccataattgcagaccgttttttctgaaccccctcccccaaccccccaaaaaatctggccacaaggtcagttcatgacatgaacatttattgtcatgtcttgaaataggtagtcattggttagttagttataggagtgcttactaggtaccaagcagggttgtttgtgctgggcataaaatgatgagtaacccatggcctggtcctgccttcaaagagctcagaaggcaggaaagaaatttgaaatcaggacataagctagaactccagaaatatggggacctctttcctgggaagaagtcccctctgggctgtataactggacttatcacaataaagaagggacttaaggttgacctaaaagatggggtggggggatgtgtagctgcagaggaatggagaagcaagaacaaagaaattgctggcctggcatgattctgattgcatggcgtgatttctgtttagcatttctgattcagcttgagtaattctgggaagcttttttgatctctaccaagctgccttaggtcctttacagttgctgcagacatatctccatcttagcattaaccacttcatattataaccaccccattttgcacaagactgtgaacaatagtgaacaagacaccttgtcttttcttctgggaatccctagtagtcatcctatagtaaatacttaatgatctgttcttggatgaaggtgtgcatttcactgatgtctcatgaaaactctctatgaagagatctccttcttcactttaacagcctctgaccaaggaaatatattcaaacctggctgaaattgaaggctgtgacaccattctggatgcatctatcattctgatgtggctttaagctgtcgtttggtacctgctatggtttttgttgcattgactcatgagaattccacagtgaggtgcttcataggcacaatgttgttagaggatgctgtccactctactgaatattactgaaactataatgaaaggtagttttgagaaggtaggatcaagctgaggttttttgtttttgttttttctttttctgagacagagtctcattctgttgccccggctagagtgcagtggcgccatctcaagtcactgcaacctccccctcgggggttcaagcaattctcctgcctcagcctcctgagtagctgggattacaggcatatgccatcactgctggctaatttttgtatttttagtagagacagggtttcaccatgtttcccaggctggtcttaaactcatgagctcaagccatctgcctgccgtggcctctcaaagtgctgcgattacaggcatgagccactgtgaccagcttgagctgagttttggctgcatgttttctttttctctttccccctttagcctaaggagaactatgaatacagacaaatactgttttagattctcagatctaacgcgtagttattgagcagttactatatgtcagtcatgtgctaagtgcttccatgtgaattatccttttttatatcataataacctgacaaatttggttcttattatttccaagttgaagaatttaaaacagggcatagagaagtcagtgatttaagactaataggaggagctagtgcatgtcagagccaaaggagaaactaattttttaggagaatctggaaaagtgcagagcttaaattgtggtagaaagaattcaagaaacagaggaaacatacttccaatgtaattgtatcctagatgtaaatgctaaatgctgaggcacatccaaaggggtattatgtaggtttctgccctcaagaagcttataatttagttggggagaaaaggtattcaggagatacaatttttgctgcagagaataaaagaatagatcaatagatcttcttccctgtaaaaaacaaacaaacaaacaaacaaacaaaaaaaaaaaaaaaaaaaaaaaaccccaaaaactgtagtgagaggatatgattttgtgttggcaaggccagtcagaaactgtagggaaaggaaaacagttaatctgttagagttattgattaatgtttgattgtattttgagtgttttttatgactttttcaataattttcatataattcaaatttttcaataatttttttcactttttcactttttttttcatttttttcaataattttcaaaaactgaaggaaaacctagcttttctttgtagtacaacagggccctggctgggaagaaaacttgccattcttttagaagatcatgggacaaaactccctttctccctgacttcccatttctcagtttgtggaaacatagaaagacttagaatttaataattgaaaggctattgaaatattccctctttatacagatgaggagataaaaacccaaacataatctaagatttgtcccaaagtcaatcaaaccctgaggcacaatcagaacagaaatctgactcccagctctggggtggcagaaagagcacaggacccaggttcaggggtgtggctcaagtgcacctctgctctttcccatgcaccttgactatctcactatgctgtgagtctcagttgaggtaatgatatgtactccacaagatccttaagaggagctcatgaagaaacatgaaagtactttgtaaactgtaaggtaacatatgaatggcagggattgttgataattctactcccctatactacttttgcaaaccctctagtaactggatgttcttctggttctatgtttctgctagagatgaaggatggaatctcagttagacaaaaagacaaagtcaaacatggtctttgagaaataattgtttttctcagacaagacctactcaaattgacagaaggcatcttatcacactggccattaaccaagatcattctgaagattatataccttttagaagcttagaagatcagggaactatagctttaagttgtgctctagctaataagtgattttccactgcattaccccagctactcttgcattcaataaacatgagagattgcactgtaatagcaaccagtgcacacagacacacactttaattaaaggaatacatcacacagtgaagtgcatttaaatgaaaaatctttccattggaagcatagtttcttttttttttttctctctttcagtggcacttttctgatgtttaaatacttctaagagtatggaggggcaggctagggtcaaggtgagattctccagggagacgctcagggttacagctgccttggctctgacagagtgttagctaaacctcatatagtggtatagtgacaggtgatataaacagtatctggtgtgattatacagtgaggctggtgaagggagctggtgcatatatgagttactgttagaggatttcttagtctcaggaggaggagtgatggctggaggaaggggaagggcagagaaaatcatcatacttcctggctgatgtaacactttgtggatgtccagcctgatgactttgtatgaaaagccggactgctgttgttctttagataggaaaccaggctaaaaagcccatgtgctcctctctgtgcctgttacaatattttatcccttacaactttattgaaaaataatttatgtctaataaactacattaacttaaagtatctagttcaatgagttttgagagtcataagcattagtgaaaccaccatcatgatatggaacatgtctatcaccttcaccaaagattcctcatgcctttgtagtccttctctccttcctcctctgaccccagaaaaacagtgatatgctttttgtctatttgcattgtatgcaaatacagcatacaatatgcatttctttcgtgtatctgacttctttcactgagcagtgattctcagattcctccatgttggtgtgtgtatcaacagttcattcctttttattgctgagtaggttatgatgttttaaggtaaacgcagttatttatcttaattgcgtggctcctattgctgattccagtaccaaagaaactccctatgtgtatctgaggtgaggtagtgtgtctccacattttgagagcctagggcctactctagtggccaacagtggtgagaagtatttcccagtctagattgcatagtgagagatggcctcccctctttccaaccgtcctttcacgtttccattcctctttccaccagtgtttattgaacactgactatgtcccaagcactgctcttggcacttgggtacatcatgaaacagaaccagaaacccttcccattgtgaagcttcttacgtctgtaatatttttaaaagttatagcatttattgttatagttggcctaacaacatatattgttagttggtcataaatactataaggaaaataaagcaagaaaggagcatagaggaagttaggataaaagagctgcaacttacatagggtgttcagggaaggtctcatcaaggcagtgacatttgagagagcataagtttcagagcattcttcagccagttctctgggtctccagcacagcattgacatctagagcatgatctactgaatgtgggcagatttttaagcgcatagaagggatgaagcatcatggcacccatacttgtgtttccaaaagcttctgtctccctagtgctaggtattctccctggttcatctgagttctttatgatgtttgattctggctactattcttagaaaacaatgtgaggaaactggagcaggtcaagaaaaaaatgcatgttcaaagtgaaggaaaatcatggtaaggaggaaatatgattggattcttttgacattggatggtttgtcaaggtcttgccatttttttttcctggtgaatgttctcttgtcctgaagttcagtatggttgataatgttgaaggttctgacaagaaagtctggatggaaaagagttaaggaggccttcttaactattaagatagtaacttgagactcctctagtcattcccccaataacatgcctaaagtcttgattcacactccaccctctggtttttaaacattttaatgccaggagttccacctttcgttttctccctccacacacatatctatgaggttgacttcaaaggtccaccagtcaagcgtaagtaaattatcatctcaagaacaaaagaactggattagatagatgcctagtggacactatgaaaatattgtacgttgaagcattctcgtgagttgttaacttcaaagcatccagagaagcatgaaagacgattaaaatcttgggctttaaagtcagacagacctgaggccaagttttacctttattcatggtcatatcattactaaataacaagctgtaaaaaaagattgtaaagcacctacctcataatgtgaaggttgaatgagataacaaactgaacccagcagtgtatacaaaagggaatgcgttatgattgagggtggtttatttctagaatgtaagatgttaatgttagaaaaatctaaaagtggaatttagtatactaaaggtttaaggagaaaaactacatcagtctctcaattgactcatgaaaattattgaataaaatggaacactcattaatgatttacaaaagaaaaacaagaaagcaaaacaaaggagtaaacaaaaaattattagcaaactaggagatgagtacttctttaacctaataaagattatccaccaaaaacatataacatattatttttaatagtaaaacattacaaactcttttaaaatcaggactaagacatggatactcagaaccacagctttaaatcaacaatgtactgggaggcttattcatcacaataaaataagaaaaaggaaaaaggtcatcttctatacataatatgattctctacatttaagactcaaaagaaactgtaggcaaattattaaacttaataattttaagttatttcaagcaaaatcaaatggatttttattccccagcaataatgagttagaaaacacaattaaaatataatatacacagtatatcttgtttcaatatccaacaagaataggtaaaacaaaagttgggcaaggtttttattgaaaaaatcttaaaactcttaaaagatactaaggaaaaacaatttgaatgaattaaatacaccatatacatttactggaatcctcaatagcatgaaaacataaaatctctgcaagtttctctgtttcaatacaaatcaatcaaaattgcaacaggtgcttataggaacttatcaaactgattttctaatgcacagaaaatagcaaaggtccaagagcaaaccagactcacctgaagaggaataaagggtgtgtggttggagtgggttgctaacttaagagatatcagaagttattgttctgtacttctatttagtttgtgtagacacacagacacacagacacacacacacacacacacacacacaggcatgggaaaattgacaaatggtacagaatagagaccccagcacagatctaaatatacatatatatatatatacacacatatatatacatatatatatacacatatatatacatatatatatataacaacgtaatataaaaaaattcgcatagcaaaaaaatggttattgagtaggctatttaattattattctgggacaattgggtattcataggaaagaaatttggattggaacctgttaacagatgtaaaaagcaaaatttcagatggacttaagacttaactgtgtaagacaaatgccaacatttaagaagaaaattttggaaactatcttttataccttatgacaggtagaggtttctgaattaagatgcaaaaatgctagccataagatgaatgtatataatgctattaattaaagtttattataatgaagaatagtagctcattaaaagattccaaaaatggtatgtgaaaagataagccataagcttggaaaagattcttgctgcacataatcctatcaaaggataagtatctattttgtataaagaaatattataagtttataagcaaaagatagacaagccaacaaaatgattgccaaaggagtgaatagccataccatttataggaaacactaacaaaaaatgctgtggtctgaatgtttgctttcccccaaaatttatatgtgaaacttaatctccaaggtgatgatatttaggaggtgggacctttggaaagtgattaggtcatgaatgtgattaacacacctataaggggctgaagagatcaaagttctcctcttttaccatctgagaacagagctagaaggtgccatctatgaaccatcaaatgggccctcactagacactgtatctgctggtatcttgatctgggactacccagcctccataactgtgagaagtaaatctctgttgtttataagctacccagtttatggtattttgctacagcagtctaaatggactacgacagaaaattaacatgaaaaaaggcataaccacattagtaatcaatgcaatgcaaattaagactatagtaagggactatttattacccacaagacttgcaaaattaagaacattgtaatttcagtatgggtgaggttgaggttcagtgggaaccctagtatgtcctgggtagcagtgtagatttgaacaactactttggagaacaagctggcagtacatttgaagccaaataagtgtaaattctgcaattgaacaacctactcctggatataaaccctggagaaacacttgccaggagacacatgcatgaatgtttacacataatttcttgttatagcaaaaaggctggaagtaactcaaatgcccatagatcgaagaatggataaattatattgacacagtggaatattatttggccatgaaaattgatgaactaagtctacatttaaccacatggatggatcttagaaaaacaatcctgaatggaaaaaaaatcacatcaaagtaggctttatacaggatgatgccattttcataaatttcagaaacaagcaatgcctgacaatatcatgtttcaagatacatacctatggggtagaattatttttaaaagcaaagagacgatggggacaataaagcccagattctggcaaatactcaccttttgggttcaggaagaatcatggagatagcttcaatggaagaagtaaggttctacttctttttttcttttttctttttgagacacagtcttactctgtcacccaggctggcgtgcagtggcgtgatctcagctcactacaacctccacctcccgggtttaagcgattctcctgcttcagcctcctgagtagctgggattacaggcgcacaccaccatgcctggctaatttttatgtttttagtagagatggggtttcgccatgttggtcaggctggcctcaaactcctgacttcgtgatctgcccccctcagcctcccaaagtgctgggattacaggagtgagccactgcacccagctgtaaggttctacttcttaacttttggtggtaggatcacaagtgttagtattgtttgtttcataacttaaatttatgttatgtattacatattagaaatattatataaatatatatatatatatatatatttttttttttttttgagatggagtctcgctctgtcgccaggctggaatgcagtggcgcgatctcggctcactgcaacctccgccttccaggttaaagcaattctcctgcttcaccctcctgagtagctggactacaggcacacaccaccacgcccagctaatctttgtatttttagtaaagataaggtttcaccatgttggccaggatggtctcaatctcttgtcctcatgatccacccacctcagcttcccaaagtgctgggattacaggtgtgagccactgtgcctggccttataaatatatattttataaacctaaaatattacatgatttttagcgagcagacacataacactgaagaaattgtagagctgaaagggctcagcaccatgtctgtagtctaaaagcagtaacaacaacaacaacaaaaaatagctgtcaattttataacggtatctatttctttcaaatggtgatgacttttttttgtgttccctcttatatgaattattatagaagatgaagattgctgaaggctctatcatgctggctggaaggtggaccctaccgccaatgtagacagtattatttctgtccgccacttcaatctcttgtcctggcagaggttgcattatctctctactcattgtgtctatggggaatggagggctggcctactcaaaactcacaaaataaatgttactctgagctgaagtttaaaaaacagtttcctaaaacaacatatgcaatattattaatcttgaaaactgcctgggggaaagatgtatttaaactgatttgactcttggaatcaagagagcagtgtactcatttggaggacagcatttttaacaatgactttgatgcaatacaagaaactccattacatctcacttaaagattcagttttacttattctcccatgctagtaatatttccttctgccactttgggtaattatcaaagttattcgttataatgaaggggattttttttttttgagggaaccgtctgcttctgctggtctctgcatgaaatgattatacaattggggtttgtagctggggtggagatggaggtccccacacaggaagtggtggtggtaccagtagaaaggccctgccttaggggggcagttgtgtttaagtgactcacaggactccaagatgcagtgaaagaataggaaggtggtttcccacttccaactggtgctgacaaataaagagtcttctctgctgattcagagatgagaaagagtatcaattaaccacaaagtctggttggattagccagtctgcaagggtttgctagcagcataggatatggttaaaacatggacttttaaagatggcacagtccagtctaaaaaaatggggaggcactcatgggctttatggcttctattattattagtagtattattattggaaatagaatatggagatagagatgtgagaagtcctagcacataaaatgttgctcaataaatgctgcattctaaagtgccatggtcttccttaagtttcatttgtttcacaagggtggatccttgtctgttatgatccactccttatcccttaaactttgctcacatttatgttgggtctaaacatgcagttgtttaccacttgaaatcatgaggtccttgattagaaggaactcactgagatcattttttatattccctgtagtggaataagaattgtatcagccaaagcacaatggaccagcctctaagacttggcctctttcatggggtgttttctggctgatgtaatctatggaatgcatttctttctctggacctagtttctaagttttacatgtggttgtatgctgtgtagagtaaggaatggtagttgaaaatgacaggatacctcaactgaattagccaaaggtgaatttatgggctaagttagctgtgatgttcaagagaagacctggcttcaagtttagccaggtctaagagcaaatattgtgccagtgttgctgtcttgttttgctctttcaatgctttgcttctcttttctggtggtgtttttgttctcaggcgacgttcccctcagaggggcaggatggctgctatcaactccatgcttctgtcctagtctctcagtaactctggtggaaagagagctccttcctctagcacaaagtcttgggattggctctgactgcctctcactgtgtggcatgcccaccctaaactaatggccaaggccactgcagttggattggacctggatgatgtgctaatccagatctcaaggttggggagagttttatgcaaatcacatgaactaattggaggaggagtggtcccagggcaattaggggttgctggtagatgcagaagttggcatagggcaggaaaacaacaaatataaaacacagatatgttgctccttgtagaaatgtggatttgacatttttctgaattaaattgtaaggttattacatatgagcttatgtttttcttcttccctaacttttgaaaacaaaatatagcaataattctacaggctcaacaaaattgaattgaattgtctccctcaggagaggctagaagaggccatagatatagttgctccttcaaattctcccttgactaattatagttatatactctaagtgaatctctctctcactttctattacctctctctctctcaaacttatattattggttacacttatgaaatattttaaaaatcatccacatcatctgccaaactccaatctgattttttttccttatctcccctagttgtatcaatgctccatccattcttcctgtcactatcttgggacttccccctcttccttgtcctccatgttgaaattattatatctggctgtcctatcactgtcttcacttcctttttattttcattgttatcacctcattttttatctttgtttgacaacacctgtagtggcttgctaattcttcagatgtccctctttgcctcttccatttaagcttctttatgtactgacaccagattaaaatttctacaaaactacatatctgacccttcttcagaagccatttctactctttgttcattttacagatgaaaaaactgaagggagaatatgaccattacttaatgtcattaaatcagtttgtgctactctatatcgtatagtatgtcattccacataggagaatggccagttgtctccattgcccacacttcaggttggcatttgagtctttcagtctagatcccacctagcatttctacttctcttcatatacttcatgttttagacatgtttgagttgcattattttctgtaaacatttgctagccttcctctttccatctcttctcttacctctgcaactcacttgctaatatatttccatgatcaagtgccacttttccatgaggcttccttcagtcaccagtgaaattgatcacacccctctgaagctgaacattcctctcttcctttcatctaatcaatgttaagcgtggctatttatcaagtgtctcctatgtgccacaaatattttgataggcaattattctaccctgttccatgatgcacattttgtattttcacataagaatcatgttggagagaatttgtcttatcatcattgtgactcttccatcacaataccttgcacacagaagaccatcaataggcatttgttaaatgagtgaataagtgaataaataaagaaaatgtaattattgctgaattaaagattagcttgttgcaggggctcatttttctggactgaggttgcagatgattctcttctgtattaaaagggcattgattaccatagaaatacattcacttctcttgccttccattccatgaattttgcagcagtagcagctacttacaattgaattttaaggccttagagctccaatgctttatggctttacttaaaccaagtgacgaaaccagagcctaagttttcactctctaggaaatccactgtctcatttccaagacctagtggccgtggtcttgtttcagcatcaggaagctttttggctctgttattggtatccatagggctgttcatatacctgtcactggacatccaagacatgggactcgttctttatggaaagaaagtcttttaaattaagggcctcgtaaatactgaccacatagaatactttcttccaaatgaagttaccaagtcttcattggctctcctttgctgtcaggatgaactacaagcttataaacttacaatttcatctattcacagtttgcatcatacaagtgtcactcatctatatgacataggtgtgtcatcgtattctctgtgcaaaccctctaccccaggtttatgtcagatgaatattggggatagtaagaccatatagataggaatagtttcacactatggtaaattagagagcacatattctgcctaaagatattcaaactcattaaaatactacttcagcaacataaaaataaataaaccaaaacaactctcctttctccaaaaaacttatcacggacaaataataaaaactatgtttggcccatggatcacagtattgagaattctgtaccaattaatcaataaacaaataaggtacctgattctcaccgtcacctccatttaccttatgctgtgctgttactgtgccattgtttatgaaggactttctgccattcgtggagggataccacatcacatgtcactcagccagaaagatttcccttccttgtctgagttcgtatgatactcatcatctatatccttggccacagtacataatgtctaactttgtagtaattattgcaagcatcaccctcttcttggagatcatatactgcaatgttcagagtgtgtgtcttaggcatccccatgcccaaatgcattgcacaaagcctagccattgctagattctcagatggcacccattgactggcacttgagccatcagcatgtatgtacactttcttagtttgttttgtgctactatgacagaatacctgaggctgggtattttattataaacaaatttattgtctcatggttctagctgctggaaagtccaagactgaggggccagcattgggagagggtcttcttgtggtgtcatcccatggtggaagggcaaagagagggcaagagagagcaagaaatcaaactctcagccttaagcccttgtatgatctatattaatccattcatgagagtggaacccttatgaacccaaaacttcccattaggccccacctcccaataatgttgcactggggattaagtttccaacacatgttttctgagggacacattcaaaccatagcataaactaaaatgttattaaccagtcaatagaatgtatatcttttctttgctcttttagaattcaagcgctcttttcctctacctgaactctgacacattccaattttaataatgaataattcgaagaactagtaattgtaataatgttccctgagatgggataattttgggtgactcacatgacccatttataaatacataccgcataatataacatccatctctgtggttttgcccttacaagtaccaggaagccaccagctttcatctgttttctcatggtgtctccattctgctttagagcttgcagttaagagaggagaaagttgagagagaaatttcataattttaaaagctgctacttccagccctgtgcttacaagcttcctattctagcaaccaaccaaacaaaaagcagttcttccatggaaagacccaaaggaaacttaaaatgcgtattgctaagtgaaagaagtcaatctgaaactgctacataatgtatgattccaactatgacattttggaaaaggcaaacctgtggatacagtaagaagatcagtagctgccaggggttgtggggaaagagggataaataggcagagcacagaagatttttggggcagtgaaacaattccacattatagtacagtggcgactacatgtcatccctttatcaaaacctgtatgaatgcacaaggcaaaaagtgaaccctaatgcaaactatagacttttagttagtaatgtatcaatgttgtctcatcaattttacaaatctgtggggtgacagggcatatgggaactatctgtttactttccattcatttttcttttcttttttttttttttttcgagacggagtttcgttcttgttgcccaagctggagtgcaatggggcaatctcggctcattgcaacctctgccccctaggttcaagcgattctactgcctcagctccctgagtagctgtgattacaggtgcccaccaccacgcccagctaattttttgtatttttttttggtagagacaggtttttactatgatggccaggctggtctcgaactcctgacctcaggtactttccactcatttttctatgagcctaaaatgtctccaaaaatattaattttttagaagcaattctcaatttaagtcattaagacaataaagatgtatcccaattgtcaagaaatgacttcttagaaattttatccagaatgtcattgtgggacacactgggagtgtggggaaaggacattgttattgtgaccgtgggcaccttgatttggaagtatacccagtaagcccaaaatgagttacatcctctaagcacctcttccaaacatggagttttaaaacaggacttgagttaaaacaggacttgagttttaaaacaggacttgagttttaaaacagcactaaggtgccttgatgatcactgaggctgtgatataataaaaaggacttgagaagaaataggatttaaaaaaaaataagagtgggaggtctgcagagggtacttcaagggtggcctggttttaatatgctcccccctctaccagttaatgacccacattaaggtaccttttccactacctgcctcttctcaggctcaccttctgataggagaatgtggctatatgccactagtgtaagctgttcccacaaactcttctatttggtgagatggcacaattttggagttctcgccattctcaaatcaacagaattaagtgaagccaaagcccacacatatatgggtctatttattttcattcagttactggcttcatttttttattactatgtgtaaacaaggtctggaaatagaagcacatatgcagatttattttttaatcccccaattcctgtctgctggctgctgctcctgaaattgcttggcccatgacaatgactgcctctaagctcccagccagaagaaagagatcagagagtttccaatggttggagggtggagaactgtggggggagcctcctttctgagttaggaaaacatctcctggtcttcccatctttggcactgatggattgagtgattgttcttggcagagcagtggttttttttgttttttgcttggggctatcagcagtaagctgtttgagtcgcaggctgtgcaccatgccatcttggcaattctgtattttcagcattttagtcaatgcaaagagtaagagaaattgtaattgaggctgcctttctataaatcatgccacagagagtgagcacatccaaatgatgggtccaatagaaacttgtgttcctcgcctggggacaatggtggggggtgttgcaaaatcagtccaaggcgtctctgtggttgctgagcaatgcagtgaggaagaaatggaaaataaatgctaagtttcctggcaaattatgaactctggatagggataggatggtggggagacaaatagtatgaaattatcaaaccgtaaaatccagttggaaacaggagggcaagatcacatgcagagtagttccaattcacttactcacgcaggcaaggagatgggaaggcactggcccaaggagaagccagcttctcctgtcccagccgaattatgtttatctttgtaatttgattttgtcatggaaacactgtcagtgttcagtgttctttgtgcaataatgttcatgtcaaataagaaagcaaagtgatgggaggaggcatctgtagctatgtgttcttcacactgtattgtttgtgatattcaataacacaaaagtaaactgtgagtgagagtaaattccatggaccctactgtgcttttgtgagtgtccttactggttttcctcaaaaggtggcacactcttttttttgttgttgtttgttttgttctcatgtccattaaaatagctgcctttgacttttgtctctcactgttctttgaggtgtcatgttaccaacattggagaggtgtggggtcactgtgcagtcagacaaggatgtaggcccatctgtcagggttattagttttagaaaaggactccagcattgatttcatgggaacccacagccctgaaataagaagagaatggggcaggagaaatggagaagaggagatcagatctttgcctaacctgtgtctttactgttacatgtttgaaggcatatgagttttgcatttttgtttgccaagggaggctccaacagccccaatccccattccccactcattaccctgcaaatagtcactggattggagtttccacttcaggcatcatccaaaatggagacagcaaagcaagcctcattattttttatatataaatgtatgcatgtgcaccaactacctgcctaagaattaaacaaaggtgttttctgggtttgaagctttcagaccgaacgtgtaacaaaacaggcctgtgtgcctggtaagtaacatttcttagctattgtaaggtcaggaacttctgctttgttaagtgcaatgattttacagattttatactttctttatttccctcttgaatttctatagtgagttctttttgaaaatgctggcctctagctgctgtaccgggagaactaaggaaaaggattttgtctcatttttccatttcatctctgccggtgctgggaccagacagaagggtagaaacaaactcagaggaaaaagtacccttccttcaacagagatattcctcaagagagctgttttccccttgctcaaaccttggaggaatttgtgttttgttggtggaggcaattcccttgcataagggcttttagctctgttggtgtctctccctgagagtggccctttacactttaaaagcaacaagcacatctggaggcaagatcagctggtagaatgaatgaatatggggaggagagccaggtcctgatagctgtgggctgtcctttgagcaacaagtcatgtctatggcactacatttacggtggctatgggcttgcctgtttaggtttctcataatcctttcttcccaaggagattctagaagcaatttaatcatcagctgaaccacctgagctgaaaatttttgactgtgtgtttgaggccagcaaaattatactttctcgtgtctttcttcagataaattggagtttctgtacactgggatttttgaatctcactccagtgctctttctgtgcagcctcgagcattgcctggcattttctagcttcggaacttgtattgagagctttttcttttaatagtcgcctgtttggttgtttccccaaatagacttcaggttcctccagggcggttgtgttttgtttctgccttatccccagcccttagcagagcacacacaatagacaatttataagtattgggtgaatatccgatgcctgtactgctttataattatgtcttctcaaacacacacacacacacacacacacacacacacacacacacacacctgaagaacaagttaatgcatgcaaatcttgacaccctcacaactcattactttcctaaatttaagttacagtaagtgacacccctttctgcgggctcaaaatcaggaagtcatctttgactctttctctcaaacccaacttcagtacagcagcaaattgtcacttctgccttcaaaaaatatcccggatgcgatcagttctcctatcctcctccactaattagtcaatggggcccacagtctcagagctatctgtgactcctcttttttcctcagacctcacagtcattctgttacacatcttattggtgttacctccagaatattttgcaaatccctccacatccctacctccatgcctaacacactagtccaagccaccagccctctcccctggacagccacagtcttctctagactcgccgctccactctgtgggttccccactttctgctccacagagttgcccgtgatctttacaggtcactaaatcagattgtgggcagtcttctctttaaatgcatcagtagacttccctgatgcatgaaaggaagcaaaatggaatcatcattcaaccagcaatcccattattaggtaagtacccaaaggaaaataaattgttctaccaaaaggacacatgcacttgtatgttcatgacagcacaattcacaatatcacagacatggaatcaacctagatgtccatcaactgtggactggataaagaaaatgtggtacgtatacaccatggaatacgacacagctgtaaaaaagaagttaataatgtcctttgcagcaacatggaatgcagctggagaccattatactaagtgaattaaggcagaaatgcaaaaccaaataccacgtgttctcacttataaatgggagctaaacattgggtacacgtggacacaaagatgggaacaatatatactgcggactacaagaggtgggtgggggaaggggaccaaggggtgaaaaaccacctattgggtgctatgctccctgcttgggtgatggcttcaattgtaccccaaacctcagcatcacacagtatacccctttaaatctgcatatgtacctcctgaatctaaaagaaaagttgaaattaagcaaacagaaacgccaagaccctgtccaggtaaaacctgcctttgacgtgatcttgtccccagctttctctctaacctaacctctgttacttccctcctgctcgctgtgctccagccacactggcccatactgttcctcaagacgctgtgggtctgtatccttcccatccttccatcctaggtgacttcttcagatgtccacatcacctgccctttcatttccttcaggtttctgctcaaatgatagctcctcagagaagtctcctctggcttgtttaaaaacgatgccactggactgtatgaaaattagcttgatttaattcttccacattgtgttcacggatcataatatcacgttgtaccccataaacttatgcaagtacaaattgtcaatgtacaataaaaaaagtaccactgacatgctctatccactttctctgctttaattttctttgtagcagctactgcttcatgacactatataataatgagtggatcctcattatttgcaattccctatttatgactttgcctacctgctgcagtttatttgtaagcctaaaatctatactcaccatgttttttttcatggtcattcacagacatgcagagagtggcaaaaaatgtgagccacatgatgggcacatactcagctgaggttcaacaagcaacactctgccttctggctccagctctgatgctgtccacaagtgtcctttgatggtctattttgtgccacatattttgcacttttgtgctttgtttggtaatctccttgtttaaaatggcccaggacatggtgctgaagggcttcctagtgctcctgagcacaaggagactgtgatgtcccttgtggagaaacacatgtggtagagcagcttccttgctgttggccatgagttcaatgttaatgaatcactatatgtatttaaaacgttatctttaaacagaaaacacctaaaacaatgtcgcatattgattgcttttataaaaatattgtgaccagagacacgtagatacttaaccttgtatttcccctaggaactatagtcagtattcactaaatcaggttttgcagtggctttatagatcataactaccacaaataatgagactcaattgtgtgtgtgtatttgcttacttacgtatatataagtaggttttcttattgcccatttctctcattaccatgtaaactccatggagtcaggggtcagtaccctgtgttttcccagattcttattctctgctgttttctcagaatctagaaccatgcctggctcatggaaggtgctcactcaattactgaatgattaaatggttgaacaaatgaatgaaatgtagtcaagaatgtctcagggaaagaaactctgacaaaataacagtttcctgggactttattaggcatcatgctgatctccagtcttgccatgtctttgcaaagtaagtattattagcagcttctccactacctccccgtgaaatggcccacccaagatcacaggacagtctggctcaggcactccatatatccaccttgtgaatcttggtgggtgtggtgtttgagcacatgggccatgaaatcaaacagcctggtttgaatccaacttcaacccttagtctgtgtatttggaattaatcctctccaaaactttatttttttgtaccataaaatgaggataatcaaacgtcctccacagggtggtcgtggggattaactgggatgatgcaaccacttaacctagcacctgacacataataagtatttcttagacattagttcttattgttatatgctttgggcccctggtgttagaggtcaaagagatgcaaaaccaagccaggaggcactcaggataaagttccactgtcagcagcccttaacaagttctcaagatcggtacctaagagcaggggtcagcaaactttttctgtaaaggactgaataagtgaatattttaggctttattggccatcagatctctgccacaacagctcaactctaatgaaagtgtggctatgttccaatcaaactatctttacaaaaacgggtgggtcatagttggccaacctctgctttagatcaaggctactcaaccctgcctctgcattagaatcagctggggaactttaaagctacctctggccaggtattctattcccagagattctgatttaatttttctggggtggggcctaggtatcaatatgatttacaagtcacaggtaactctaatgcagagttgagaaccactgatttggatcattaaagccatgggtagaagagtctcaaagcagatgctgtcttcctgtctccacccaagtttctttctcaccccattttaaaatccaaggacaagcattgtttgagggctttgggtaggaattggccagtctcagtaaatcttctttgcttaatgcacagaccatatcccttttgtatctagagggaaacctaattatctgtctaataaatgaattgtactttcaggaaatacagtccagctgttactctgcattttagctgaggctgtgctttttgctgtctaattgtctttcagcattggcagttagaatggttttgagtggaaacagtcttccaatctcctttgtcaaagccgtggcttctctgatggagctgggagtgggctcccaggagtcaaaagatctctgtcttaaggccaaggtactcttctttaatgagtcctagaagaagcttatgacattcccttctttaagaagcttcaaatactcagctagttgtcatcccccatttgatataggggtagaggttagctgaagacagggggataaacttagtcataaatatccaagcttcctcaagaattacctgaacagagtttctcccttcttccccatttgcattaaaatcatctgggagcttgttaaaacgcagacatctgggttctattcctgacccactgaattggattttctggaggggatactggaatgtacatttttaacaaggtatctggataactttgaaatttgagagctgctattctggggtgagcccttcaccctacttacataagactgagattgaggaatttaaagtcttcttcaaaacagcccagttagttcattgctgaagctaggagttgggtctgactctgtgtatcagctagttaatgctatgtaaccatctcccccaaaacttaatgattttaaaacagtaaacattcattattgctcacatatatatgggtgatgtttctggtctcagcgagattcacttctgcgcttattgttaactgtggttgagtaggcagttctgctgatcttggctgggctctcttttacatttgggtaggttggctgcatgctggtctgagatggtctcagctgggatgtctggattctcttctatatggtctgttacctccagcaggctagcatggctgtgctcacctaatggtcacaacattctgagagattggaagtgtccaaggctcctgcacaaaacagggaaactgtcatttacattgaattctgataccaaaacaaggaacaaggacaatctagacttagggggtgaggaaagaaatcctagctctccaaagaagatgctgaagatccttttttttttttttgagacagagctttgctcttgttgcccaggctggagtgcaatggtgggatcttggctcactgcaacctccacctcctgggttcaagcgattttcctgccttagcctcccacgtagctgggattacaggcatgtgccactatgcctagctaatttttgtatttttagtagagttgaggttttaccatgttggtcaggctggtcttgaactcctgacctcaggtgatctgcccacttcagcctcccaaagtgttgggattacaggtgtgagccactgcacctggcctgtggatcctttttacaaaggtcttagatacagggaggctgaatgaatctaccagagactgttacacagagtcctgggccttttccacaacattcaagtacctttaaaacatgtatgtttggccatgtgtagtggctcatgcctgtaatcccagcactttgggaggccgaggtgggcggatcacctgaggtcaggagtttgagaccagcctggccaacatggtaaacccccgtctctagtaaaaacacatgaaaaaattagccagggttggtggtgggtgcctgtaatcccagctactctggaggctgaggcaggagaattgcttgaacccaggagttggaggttgcagtgagccgagatcacgccactgccctcccgtctgggcaacaagggtgagacttagtctcaaaaaaacaaacaaacaacacacacacacacaaacacacacacacacacacacacacacacacaaaaacatgtatgtttgttttacaaatgtttagggagcatcagtagtgaacattcccttgggttctatttctagaattattgcttttggatgaagaatcaaaaattatatatctaaaggaacctaagaattcattgttttaaaccctagcagatactttaatttcctgttaatgtccccttaatcaaaatgttcatccatcttctgctgaaacacatcacattactccctggagaacttgctgccgtgtgaggcagctccttccagcctcaggaaattcttaccaagaggatattatttcttacattaagcaaacatttgcttctgcctagatttcaccttttgtttctgcttctgccctccaatgctacatggaagaatgtctcattgtcctcccaacctttgcctgcacctgaaaacagttataaacatctttccttattgttcagtcttctctaccagctaatccaagtttctacagtttttccctggcgtatagttttgagctttctcaacaattcaggttgtttccttgaaaatgtttctcagggccaggtgcagtggctcatacctgtaatcccagcactttggaaggccgaggcaggcagatcacttgaggtcaggagttcaagaccagcctgaccaacatggagaaaccccgtctgtactaaaaatacaaaatgagccaggtgtggtagcaggcttctgtaatcccagctactcgggaggctgaggcaggagaaccgcttgaaaccggaagacagaggttgcagtgagccacgattgcgccactgcactccagcctgggcaacaagagtgaaactccattttaaaaaaagaaagaaagaaaacatttctcagtggcagccaaggattttgggatgagcgttggttttagaatcagataccctgaaatttactttgagattttgagcaagttcctaaaacccttggaacttcagtatcctccttcaggaagtgtggacggaaatcaccatcagtatgtattttgtgtcagttaaccactacaacatacatagaaatgcctgtcagggaaatcctccatatatatgagtttctttccttttttactcctctgaaagaatagcctttgaagtacaagttttcttcctataatattttgaatttgaatgaactcagattttctgagcgctactaatactaaaattatgaggatatttaaatgtccttctggaattatgtttcaaatggcatttcatgtggtaggaatagcaaggttttcatttcttccaagttgaacgtagctattattattttgatacttagagatagtaatttaaattaaataaatgacctaaaactaagagatttaagttcttctcacttcttttagattcaggcctttgggaaggaaaaacaaatctgaacctggaaaataattaaggacaaattgaacacagtgaggaggccaggaaagcaggcaataaagtagatattaacaataggatgtgatgtgaaactaaaacccttagagaaagagaaaacataggtagagggtggggtgggaatgtgggcccatcatctcatggaggagtatcagtttttgttcaaagggtatggcttaatatgagatatttatgaattgcagcatataaaatgaataaaatctgattgcagaggaaaatggttgagggaattggactgtggagacaaaagaatggacttcagtaaatactgtgtaaattgtaaggttgtcttatgtgactattagctcagaaaatactcttcagtataaagaggataaaaggaattgtggaaatgatttgtaaataaaggtgctagataaattcaaggtacactgccattcatgcacagcatactcaaatgagacattagtcctgtgaggttatattaatttgtttttctttcaacagcaagaaggtaacataaaagatagtatggtgtagtaaaaagagcattgagtgaagtcaggacctctgggttcaaattccagctctacagctgactagctgtgtgaccctaggcaagtctcttaggttctctgagttttagagtctccatgtgtgaaaagaactgtccaggttatctctaaggccatgtttatgattctctgatcctatgttgttaagcagctcagtggcagtttctatggggagattaagatttcagatgggattcctctcatctaggaacttctattctacttgaagagacagcctggagttttgatgcataagtgaatgaatgagtaggttgatgtttggatgagttacatagagacaattagagagctataagagaagcctgttattagaagctagttggacactgtcattaaatatcaaaaaagagagatggtgtttataggatactgtttcttcctcaccgacttcctatggttttataatttttctgaactagttcataatttttggtattgtactcttacctgttttggccaaggatggcttcatggaaaacagagaattagaactaattttgagagaaggatagaatttttacaaattcggaaaaggaaggaggatttttttcaggtagaaagaatagacctttaaaagatctgaaaagggatattcatgtgttcattcagcaaatagtcattgaacatctgctcttcccatacctggcacagtattaagcacttggggttattaaggaaggaattcccactatctagaaaggaagatatacattgatcatgaaattatacaaatacatgttttcatgctttgatgaatgttgtggaataagagaacggagagccgtgagagcagatgacagtggacctggtgctgtctggggtgggaagtgaccaaagaggacttcccttaggaagtgttatttccgatgacacctgacatatgagtaggagttcagtacaccaaatggaaataggaagaagtccaagtggaagaagggtgttctagatagagggagtagcatgtgcaaaagccctgagactagagagttcatggcatgtttgagaaactaaatgggaaccaatgtggctggaacttggaagataagtcagggaggggaaaatactggaggaaaaggcaggtgggagatgagcatgatgtcatccatttgacagagggtaaacatcagtgttagtataagccagtttctgcatgcttgactgaaggaaatcactctatttcatagggtaggcactggggtatatatatggggcaagcctcatctatgatctcaaatggattttgaggtgcataagcacgtcttccagagaggaggatactgacttgggaaacagaaggtttgatcatccaaagatacaaatgtcctttgaaattggaggcaaagtcagaaggataagcctgaagaatcatacaaagccatggcaaaaataaggctgccatattaactggcacagtctgctagaattgctttcttggaagtatgacactgcctaagactccatgtttctttccctcccccttgttcatataattaaggagacttaagtggaaaccctgcccatacagtatctcttcatattcaagtctaggattctaattgccataggcactaaggaatgaccctagtcccctcttgtagtcaccctgcacaaaacacacttgagacaattaaatgagtcaacccaagcattagcacctgctccctatcatgaggatatcactgctccctaatcacatgtcagcaatcttgttgtcactggccctatcctcctcaaactggggctcaaaaacatacccctgggggacagtggtaaaaagggagtatgatagacacagtgtttttctggagggtctgctttaactgaagatttatgaagaaatgtattctgagcatgggtacagtatagaacagattacaaaatacccatggaattttaaggtgagaattattagagaactaaacatatttgcacttgtgtttaagatcaagtctccagattctctgggggatgctgtattcgtttggcttttggagatgctttgatggaaaactttgggaagctgtgatccttaagctatctttttaaatttagtcttgttttgatactgtttataaaataccctgcccttctcaccaagtttttttttttttttctttttgagatggagtctggctctgttgcccaggctggagtgcagtggtgcagtctcggctcactgcaacctccgcctcccagattcaagtgattctcctgcctcagcctcctgagtagctgggactacaggtgcccgccaccaggcctggctaatttttgtatttttagtagagacggggtttcaccatgttggccaggatggtctcgaactcctgaccttgtgatccacctgcctcggtctcccaaagtgttgggattaccagtgtgagctactgcacccggccatcaagtgcttatagtaatttttgtgaatttgcttgaaaagtactttttcatttttggtgctataatattgcctctttcaggcttcaaggggagatgtgttgaaatttgaaaaccaggtgtgcatctacctacgttgttctgcttttatagcctttgctgtcacagctcattttaaagtcctcattttgtccttaacatatacattcttatggagttgtctctttcccttctacttgaatcctttagatgaccttgtttggatccttttccacttctgctctttttctctttaagatgtggcacttagaccaatgcacactgatccagggccaagtgaatggtacttttgtaggaagatgagatcatgtttctgttaggtttccaaactttttcctaatgaccagaattttagccacaatttttggggaaggacatatccttcaggccaactctggctcatccatcatgactcagcttatggacctgcgcccaacccagcagaactgatcactccttcctttgagttctcagtggtcttctacctccgttggcacgagcctcactgtgctgcacttacctgttgatgtgtgtttcttcccatctaagttttgagtttctggagatcagggaaccttgtgctattcacctttgtatcaccacactttggcactgagccttgcacatgctgggtgcttaattaatatgaaaccagctgggagcagtggctcacacctgtaaacccagcactttgggaggccaaggctggtggatcacctgaggtcaggtgacagctggagatggaagctcttgtctgggtacccagagcttagaaatgttcccaccagttatcaagatctgttgaagactttctgaggaaggaactgaagacgcaggttggaaaggactccctgctgctgtgagactctggtttctttcctgtctattacaaatgccaccacaaactaagggattctccctgcagctccgtatagcccagccaagctttcctactctacacttgtgcctccagggaaagagaggcagagacctcatttctaagagaaccagcctcattttatttgaaagacaaaagaccatcatgaacacaatacagcagaatgctacctaaactccacaagttttgagtaaagaatcagcacagttatacattaagtttaactttcctatgaggaaagtttatttcagcccatcctttcacttctaccggggagataccttggcttaagagaaactgacctgaacactgaaagatcccatgaagtcacattttgttgcctcttctgactaagtctggtctaccctcatatgatcattataaattcacatttcttagaaagtatcctgggggtggaggcatgatgaaaatgcacagtacaaagaaatgtaggcaaatgagggtttaacttccagccacagatgtaaaaatctggcctcacaactaaatgcctaggtggtgacagggaagccacagagaaatgtagcatctctgtcattgctgtctctctccagactgcctagtcctggcagggggtgtgagatgcccatgttagtttcctagagctgctgtgacaaagccccatgaacttggtgacttgaagtaacagaaatatattatctcacatagaattccaaaatcaagatgttggcaggtgggggctatgctccctgtgaagcatttaggggaaaccttccttgcctttttctagcttctggtggttgctggtttagaaaacatgtcttaagccatccttggcttgtagatgtgtcactctaatcctccatcttctcatggagttctccttatgtgtctttacgtaggattccctgtctgcctgtctgcttatgagcctacatttctccttatgagaacaccagtcatactggattagggcccaccctaacaccctcattttaacttgattacatctgcaaagaattatttccaagtaaggtcacattctgagatgctagaggctgggactttaatatatctttcttgagggacacaaattcaacccataacaatgcctgtgactctcctatgatctcatattattctttgaacaggctttccgggtacagtcttttgttcttcctgtggaatattctattgattaaattgcctctttagttcttcagctatcagatgcttttctctggcaggccaatgtaattagggaactaataacggaatcaataaggaaaagagtatgttctttcatattttccagctgttccagtgattcatttagtcctcgctctgtgtttgttgctgctgaatttgtgcttgttaaaagatatgtggccatgacatacagtggaaagaagggaaaggagaggatctcgattggtctctggtaatgtccaggagggacatctttgctgggagagggtatcatgtggcaggatatggaagagaacatggcctcatttatgtaactgtataaacaaggaaagtttttaaagatgtttattgtttggaaaacacactttattttaatgttgcatgaaacatgttgagttgaagccatgcaggactgtataaacatcctgtgagctgatgcattgcctgtataaggaaggattcaacactaactgtgataatttctgggacattgtcctatttttggaaaattcaatattgctttatctaattccagtttcctcatgaaaaaaatagaactttaattcatggccttttaaaaggtagtttgagagataaatatacacatggtaattagaaatttactgtaacaaaaatataaatagaataaaatgtgggcttaagttactattgaaatataatacatatttattgttcaaacatctaaaaatgatggaaacttcaaaaatatataaattacccgtaatctcacaattcagaggcgaccactgctaaaattttggcatatttccttctgatatgtttcaagtttttgtaatactttaacatcgatatcaataaatgcatgttttataacatatttttaaattaataatgtcatgagaattttaatatccttaaataatcttctaaaacttactattaaatgttgacacatgtgttttatttctattttaatgttagacctataattttgtaatcacaaaagtaatatttatttataataatttaaagaaatctagaggacaaaaagaagaacatactaattgcccacagtcttgccattgcagagataactaatatcaataccaaggcctactttgcatggcattataattgcatgcatttctgtttccactgatcatggcatttttgacctttgtaacctcagctcttagttcagttcctagagcatagtagttgtttgatacacttttagtgactgaatgaataagtgattaaatgaagaagtagatgtgtaggtggagaggttttcaagatccaactcgtggtagaataaaatatgtttcagactcagcaacttactgcagattgagagacaaggtagctaactcaaagcccttaatgaataggagcctgctctttctgttcatctcaatcagcctccaggaggataattcaatttaattttttttccatcagtcaaactgaagagctgaaaaagcaaaaccagagataggcaaggtaggaggtgaaacaggcctgagtgaggagatcagcagtggctctctcgctctctttttttttttttttttttttttgagatggagtcttgctctgtcacccaggctggagtgcagtggtgtgatcttggctcactgcagcctccgcctcccaggttcaagcaattctcctgcctcagcctccccagtagctgggactacaagcacctgctgccatgcccagctaatttttgtatttttagtagagatggggtttcaccacgttggccaggatggtcttgatctcctgaccttgggatccacctgcctcagcctcccaaagtgctgggattataggcatgagccactgcacccaggttctcgctctctttatgttagaaagagcgtgagaggacaggaaccatgctgctctcaagggtgacccagcaagagctctgccaccaccaggtcgtccgtgatgaaactgatgatttctctgaggatggagactctaacagtgtcagtgtgaccctcatggtttttacctggcctgtttcaagtgtttgcagcagaggaagacacaatcatgttgggttttgttgaaagaatttggtactttgctatgtttggaatcagggctggcagattttgaactttgggttatagaaggttccatccaaagtctcttttatatgtaattggaaaacatgtcttaagtctaagcatctgtccctcaggtacctgtcataggaaggagagtgatccattttttaaaaccctacatgaaaaacttagtctttgcaataaaatatatggatatattcttcccaatgggatggtctggtccttaaaaacctgctgcttttccccacctctcaatataaatatacatacaagatatagaaatatccacaaatagatgggcagagggatagaaggagagacaggcagatggaaggacagacagacaaacagtgtccaccgcttttggccaacaacagtcatcatatcccttctttttcttaaaggtgctcgtagagctaacctcgaacactaggccatattggcacctttgctcctgttgtctcaaggcctggctcaaaacatatttttccaggaggtctcattgtttaatttctaccccggttaatctttcccatctgtcaacctctagagctttagcccttgccccaattttccctttgacatggtgtgtctgtaagtgtatatgaagatcagggagaagctactctgtttgcttcctaaacaattgaatgggttttgtgtactatgtaatttagtggttgtagagctttgtagtgttttattcaccaggttggtgaataaagaaagtgactagagggtggtaagatatttcttgcatgcataattgaacatatattgtagttagtacttactcatgtactgagagcccagtttagataaatactgtgagagttagtgtaaagtcagtgtggtatagcagaaacttgtgatcagccaaatcatgtatatattttctgtatagttgatgtagtcactatgcagcaccaagcatcagtaccttcatctataaaatgaatatgctaaatatatatatttagcatatataaatatatatatttgtatatatatttagcatattcattttatatacatttttagcatatatataagaaatatataaatatatatgtatgtatgtatatatatttatatatatatataaaatgggttcaagatcttttattttcagagcttgcaacagttggttagcaatgctagctaagctgatataatctgaaggccatccaacctttctctttaggcactcaaccagcagaatctctttcttgcaaacaggatcatagaccaattgggatctgtctccatgtgtgtgtgggaagaggtcctcttccccacacttttcccaacaaattgttttataaccaaatgcaactcaaacctataacacagctagtagtcagctgtatatacctgacaacattacaggctattttgaggattaaaaaaaatatatatatatatatacacacacatatatataactatatatatacatataactatatgtacatatataactatatatacatatatacctacatacatacatgtttaattatatgtgtgtatatatacatatataaaactgtctctactagacaaaaatagttttatggctccgttgttcaataaatatttgctgaattaaattgaaatgagtcaaaacttttctgagccccacaaaacttttttgagattaccggaagtttatacaaaaaattatttctgtatgagttgtaacattatcgacttagaactttccagatggcgaagttatccaactgtggtgtgctgggaagaacagccctataggagagcagatattggggatgtgatcacaggaatatacttcatgtggtccaatttctataaacttgatagccactctggcttcctcaatgctcccatctgtaaaagtttttgggaaaaacataaggatggtggaattctcatgataaacttgggtcatgattccatggaaggagacttgagccaggcatcagaaaactcaaatcctagtttctttgaccaagacttatcttctccaagattaagttttgttaattgtgaaataggaggtttatgttctcacctgttagaggtgtttatgttctcacatggcattgtaaaactactgatgcacaaaggtgactaaggcatgatccctgcccccttatgactcatagtctagcagggtagagacatgccaaccagcaatggattactatgaacagcttcttagaggcaggcagtgaatacagtggtggcaccgtggaagcttagtaactaactctgcctgggcagattgcagaatgcttaagagcagggatttaagttagtaataactgtcctaccttcctttcaggattgttgtaaggcttaaatgtatatgaaagaacaacatggtagaattattattattatcgttattattattattccattggcagttagaatcagatgttttacttctagactttcagttgaaaatatacccaatactcctagttagtcacttatagggatgctggcttatccctaaggtgttataaaggggtcagactctacattcaaaaagtaagtgaacatggaataataagaagagtggcctagccatcttgcaaaaacataggagtgtgaatgagcctggtctttttggtgacaatgaagagctccatttcatttagatgatctatagagcagtaagaaatgaaagtaaaagcatgatattttgcatgtaatattggctcatatatcagctgatgagcatttttatatgtagtcttatttttcctgggagcacagaatctgcctcttcttgtctacatgacaatggagacagtgatggccatcagaagtgtatttatactctcctcaaaagtatcagttgattggatgtatattgagaacccacgtaatgctagaagataccatgataagcagtcatattcctacctttttatctggataaaataaatgcctacttgggtgtgttgggcactctggtgttgggatgctgcagggaaaacatctgtattcatgcccagcagtggttccttgagacttacattctcacttcattgttttgcagctctacagctccatggactttggaagacggtggcaactcatgcatgaacgcatcacacccaacaggttttattggtaagccctatccacacactcattacttcttagataaagaattatcaaacagcgtagcactctagacagctctggacagttgcagttcttgcagacaaatgtgttccagtcctttgctacacagagtggtttgtagaatagcagcatcagcatcacctggggacttgttagaaatgcagaatctcaggccctattaagacttacgaaactgggatttgcatttaacatgatcctttgctgactcatgtgcacatgaaagtttgagaggcactgggcttaaagagctctgtgagaagggtcatgatcaggtgctctttgctatgtactaaccccctctttttggaaaagtgcatatattttatgtacatattctaaaaagcagtattttcccaaaatgtactctggagaacagcagttccacaaaatgcttcttctttcataagagtttctgtggtcaaataaattcaggttatgataattcaattttatactcctggaaactcaggattcatgttatgatattaaagactctggagaagtgctgaatgaagaattctgccaaacttgaagtcactgattcccaaacttatttcactacagaatccttttctcatgtcacatgtgataaatccttcagaactacctctgtagggcatattttgaaaaaccttttatgggaatgaatacatgtttcaaatggaatataagcccttcctcctaatcaggaagtgttttattaattagtattcctttatgcatgcatactatttttatcttggttgtaacaagttttgtacaaatttgccttttacacttgcttgctataacatgaaaatgattcttacttttatcttgctttcattttagcagaagtgatggctaaaggaagggagattaagaggcatacaccaaagtatatagcatgcttaattatatgcttaatgaaaaaaaaagatttggttaggcacagtggctcatgtctgtaatctcagtactttgagaggctgaggtgggaggattgcttgaggccaggagttcaagaccagcctggtcattatagtgataccctgtctctacaaataaataaaaaatgagctggccatcagtgtcatgcccctgtagtcccagctactcaggaggctgagatgcagtgatcacttgagctcaggagttcaaggctgcagtgtactctagcttgggtgacagagaataggctactgccatcatagagattaggccaccgtactctagcttgggtgacagagcgagactctgtctcaaaaaaaaatttttgttagaagttgtactcattccgtatctcttataaatatcttatgaacactcccttaaaaactcatgtgatagccgtttatgccttacacaacttagggatgtgctgtgtgtgtgttgaagatggtggtaacaaataccttgtacatacacacattcataccaacatctttggaagcaatggcttcaacccattccgtctgcatccacaaaactatgtttagattttaaatgaagattgcctaagcattctatgaaaaatcaactgtttttttttttgttttgttgttttgtgttgttttgttctttgtacatggttcggagtagttgtgagagaaaagggagttggcagtattgctcttgactcaacacctggactatctccagcatgtttgccccttacaggcctactattatttcatctgtagctgttattccaactattattttgcctgtatttggaactatggaggtttttcaatagactgaggcagaaaaaggaaatatttgtttttctgctatttcacttatagaactacagcctttactgagctgagatagtccagtttctcagtatgccaccactcagaagtccagaattcgaaaaaaaaaaaaaaaaaaaagaaagaaagaaagaaagcgaaagaaagagccctctgctgtttctggaacaaactcttgagatgataaggcagttggccaactagaaagtcaggttagtagaggaggaaagcacactgggctagatgaaccatgccactgtgtctgaatgaaattaagtgcctaagaagcaacattttcctatattttgcaaagagcaagaggagaaggttctagcttctgtcatccaccctcttcctttatgcagtaaaaaagaacgagtccctaggtcctgataattgtgttttgtctcttctccactctgtgcttcttcatatatgctcccaaggggaaatataacagtttatgcctgtgctgaatagtcaagtggtagttttgaatattcaatttttgtaattatcacttctccatttctgatatataattaccgcgattattcttttaggtgtcgtgtgagtcatggcaaaagagcttattttacatagacatttttttttaatccaaagacagaattcagggttttctaaagctctaaaccgcttatattgaagatatatgttttgtataggttagggatgtaaatattaacttgttatctccttgagaaaagacaaaatatgcatttctctgggtatagaacaaaccttggcttaagtgggacctctttaacctatggttccctcatccatctaatgggaacagtatttttgttgtcaatttcataaggttattgaaaggagcagatgtatcaagtggacacttggctatttcacttctccattgatttaagtactatgtttattactagtactcaagaacatgtcacataagtgaattgtcattttgctgggcacaaatgtgaatctcgtgtacggtaaggctggtgcccatgggcatgtgataacaactgaatgggtctgatttattgccaagaatccacatctcagctgaacattattgttctctactttttgttgagtcataattcttataattcttatgaagtgatcaaccaaagcaaaacaataacatgcatgaaaatgatttctttgggagagagggtgtagagggaagaggtattgagggtggttggggaacgctgagtggaaagcaggcatggtaaaaacaagacattgaaatgagagacgatgttaaaaagacttttaacttgtggtatgtagacaaatagagtgaacatgggattcagaagaaatattacaaataacaatatttgattgttgtgattcatagctttgctcctgtgaccctgcgcaaatattgttatttataagctgcacatttgcaagtgtctaaaggatagatccttcatgagtgtccggtttcttctcccatgctactcgcagttgttggcaagtagcagcttagagggggatttgtgcagaaggacactgtgctccagaagtgatttctgacgaggacacagcagaaagaacgaaccccgtgcatgtctctcgtctgttccgtcatctacagtgatgattgttgtaatggttgttagaatacattggaaattgtaaggagttatcattattatccgcttcttcattagtgccccacccttcttgtgggttaggcagagcacggaacataatattcattagcatcaatactaagagcttcacctggaaatatttttatgaattctggatgttctaatccaatcaagataggtcacctaggaatcttacaccgtggagtgactcagccatcaatctcaggctacaagaagaaagacaactgacatgaacattccttgtttatatgtgacccttccactcacttgatacctggtcaccaggtaatcaccagggctgtctaatgcttcccccacttttttaacctcagctgcttccgaaattgtaatttgcatggagagcagataaatggagtaagtgtccttaacatattcccttcattcttcctaggctctgctatggcagagttgttgtcatgggggaaaagcttttctgttttttttaatatttaaaaaaatatatcctactgagctacaaatgaatagtattccactcttcccttgggggatatttaacaggcaggcatattctgcagtgggaagattttttttttcctttgcacatccaatgtgaatacttgttgtgattcacagctttgctcctgtgactctgcactctcctaacatgctcagcctctttgggcatcttttccaatgaagtcacaggtgtgctaggccttccagaattctctgtgtaactagaatgacctcaaagtgcctctggtctctgatggcattcacttgtatggtatcctaaaacacggaaggaatgtctccaatgcgtcctctttactgatttccctcctccgctccttaattattctttctcttgaaagaattaggtcccttttttgtccctcttctttatcattgctgcaggaaattgtgctgataaagtaatgtactctaaggtatcaggaacttcaattcttaccccttttctgagatatttggattgcaacatggactggcttgagcattaggaaacctttaagaagacaacagacatactataagttctatatcaggccatgttaggcaatgcagggaatgtgtatcttgaagactgctgtatctgctatgatgcctggtttaggatgaaaagtggctggtgtgtaaaggtaggtaggttgggctgtaggtctttattgtactttgcttaaggccggcttacacactatgggtttctagtggtgtttgtgccagcagcttctcatctggtttttcagaaaggccatgagggaagggaggaagaatggaaaaacaaagtgtgtccctcctggtgtgtgtagacaagaggtcctagggaaatgccctttaaaagagacacatgaaaaaatgctcatcatcactggccatcagagaaatgcaaatcaaaaccacaatgagataccatctcacaccagttagaatggcgatcatgaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgacccagcaatcccattactgggtatatacccaaaggattataaatcatgctgctataaagacacatgcacatgtgtgtttattgcggcactattcacaatagcaaagacttggaaccaacccaaatgtccaacagggatagactggattaagaaaatgtggcacatatacaccatggaatactatgcagccataaaaaatgatgaattcatgtcctttgtagggacatggatgaagctggaaaccatcattctcagcaaactatcgcaaggacaaaaaaaccaaacaccgcatgttctcactcacaggtgggaattgaacaatgagaacacatggacacaggaaggggaacatcacacactggggcctgttgtggggtggggggaggggggagggatagcattaggagatatacctaatgttaaatgacgagttaatgggtgcagcacaccaacatggcacatgtatacatatgtaactaacctgcatgttgtgcacatgtaccctaaaacttaaagtataattaaaaaaaagagaaagtggtgataatgaaaaagaagacagactaaaaaccgtttcaagacagtctttcctttccaatctttcatgttcttagttttccaagtctctttttgtatgcatatgttcttttatatgtagcctaaatatatacatgtgagtgtgtataatctgcctttctcttcttaatgttctatccttacaatttttgtgtcattataaaatctttataaccatttttaatttgtgcaatatcttattacacaaagatacatgctttattctgttttattttttatcagacattgaaaattttcacatttttgatgatcataagtaatggttttattgacatttgtatgcataggtctttaacatcaagaattattttcttggaccagtgttttaggtagcccaagtaaagacttgactgcatttttttgcagtgtcacatttcaataataagaccccaattcaacactaaaagtatttcagcaaagtagctttttactgaaccttttcttgaagagggttacaaagaagcattacatcagccaacacacgagtcttcctaaaactcctctgttcatatctgtcctgaccatcatgggagttactttctcatcctctccttccctttcatggactctaaagctattctgtcagtgatttattgtccacagtccatccccttccagaactccccttacacccacacacttctccccaagtatcatagcttttcttatgtaaaacaatctaccctctctccttaaccctccatctatcaccctcacccatcccagaaattaaatgtaatatcccttaggtgcacattccttacaacatggaggagggagaattggtaatagttagggtttaatattagttaaggtttagtatttttggtttaatcactactataagaagaagtttatcatatcaaaatatacacattttgaagaataaaatcatgtcctttgcagcaaaatggatggagctagaggccataattctaagtgaattaacataggaacagaagaccaaatagcacatgttctcacttataagcaggagctaaaccttggatatggacataaaggtgggaacaatagacactggagactaccagaagggtgcgaggagggcaagggctgaataactacctattgggtactatgcttactacctgggttacaggttcagtcgtatctcaaatttcaacgtcacacaatatacctttgtaggaaacctgcacatgtacccattgattctaaagtaaaagttgacattaaaaataaatagaacactagaaaaactatatatgtgtatatgtgtatgtgtatatatatacatacacacacacacacacacacacacattttgaacatcttaaaacctgtcattcaaaatattacccaaactgtgttctgttgtatattcccacctgtaacatatggcagtatcagtctatttagttaatatttacttcttccttttgggagacagcctccaagtgggctccactgatctctgccttctggaaatcctgccagtctatggtgttctcttcttgagtatagactggattagtggcttgcttctagtgaatggaatatggcagaggtaacgagcttttttggggagtaggttaccaaaagacaatgttttcatcttgggtgcattctcatgcttacttgctcaaagcaagctaccatgttgttagctgccttattgagagccccatgtgtcaaggaatggagggagatctccagccaaaagccaatgagaaactaatggcctgacagcttagttctaatgcagaaatgaatcctatcagcagtcacatgagtgagttcaaaagcagatccttctccagtcaagccttcatatgagacttcagccctggcaaacactttgatagaagccttgtaagagacctcctcaggcagaggcacctagctgagttgtgcctggattcctgaccaacagaaacagtgagacaatacgtatttgttgtttttagctcctaagttttgtagtaatctgttacacagaattattaagagataaccaatatgcttttctctgatccttattctttgcttgtttattttataacataatgttctacttctgtctacacgtagcctcctgtctacatacaactacttctgtcttggactacttcctctgttttctcttcattgttatcaactttagatatttcattttgcccattgtttgggtgtgtccttgaaatagaaaattatcaccatgttctggtattcctgacacctatgcccagactctatgggatttgacagttgatcagcaaacctcagagccctatcctcaacctgagtgaggcttacttaatatcatgagattgcctgactttgttataccttattattttatagtttgatggcaggattgcattttctaagaatattgtttattgtaaatatctgtgtatgtacatatacacacacaaggcatgtatgtacatgctcatttagagaagtgttaatttcattggtacaaatacttcactagaagtactaatataaatcacattgtctggattttagacacccgtgtcagcctaatagcagctgtgggtggaggatgaagggcagagaagcaggaagtgaaaattggggatggttaccttgagataatgtggttggagtgaatactcttgcacctcttccctgaatttgagctctatagatctcacctgttctggaatatatcctataatttgcttcaaaagtgggctccttctattcatttaggaacttcttttgaccctggaccatggttcttaaagactcagctgccaagtcatttttaggctattcatatattatccatgacagagccagagttaaggaacagacagaatagcttgagatggcttcctggaaaatgaagatcttttcaaacaaagttaacattatgggctgaatttttgaagctgcctctaaatgtgcatctacgattttgcaaacacagtcatttgcaatctcaagtaatgggatttaggcatcaacctgatataagggatcagattttaaggctattgcaaaccagggtatgctacaaataatatttaattcagctctcctttacatttttaaaatggtacagcaatttaaaaatacattacatttaaaataatacatgcaaggtcaggaggggaaatgtgaaagctcagcttgcaagcagaaatcagtttctactttgctgatgggggctacccatgctgtatgtctggttgcatcttggctgtggaagagctgtcttaatgctaagactaaaatgcagtgttcatatggtgcacgtggtagttagccatggcactgagcaagacagaatggtcaactctttggaagaagtcaagacatgccggacccttgatgattatgctgagtacctgtgagttatgtgaggtaggaggcatatgtagctaatgacttctttgctatgaaaagtgggagtcatgtttggtcctgccttgggagatctgaaaagatttgtgtgcattaaacatggaattcaaagacagccacatccactcacctaatccagtgtagcaaaaattccatagtgcacatggcaacaccggaaacactgttgttttctctttctctggctttgtggccagtgattccttagttagaggcacatggcttccaaatacttattccacccagatgattatgcaaagggcatgagaaatactcatttcgctcagaaatagtgaaatctaactttattttcactcactgataataaacttgcagaggggagcaaactttacttttgtcacagtgggtgagatttcagggccttattgtctatgagggtggtgggtcagaaaaacccccacataaagagactttgactactgccatcttcctggaactcagattgccttcagtacttgcatgttacattaaaaaatggggagagttgaataggttggtggtgatgagttgttcacttccatgagcaggaataggagaattggagggctagggagaggcctagagagagaagaggtcaatgttgagctcggcgcccaaggagaaagtaccaaattgaaggcttggaggctgtttgaaatgcaggttggatacttggttgcacggaggagaaaccatcctttcttccctgttgaggaaatctgttattgttctgctccagtttggtctggggctgtgcattagtcagtgctggctgccaaaacaaaataccacagactggttccaggcttaagcaacagaaatttgcagttctggaatctggaagtgtgcgatcagggtgccagcatggttggtttctggtgagggccctcttccaggttgcagagggccaccttctggatgtatcatcccatggcagagagagagagggcaagctctctggtgcactttcttgtaagggcactaatcacattatgagagccccaccctcatccaaacctaatcacttcccaaaggccttatcttcagataccatcagtttggaggttagagcttcaacatattttttttttggagagatacaattcagtccatagcaggatgtaaaacagggaacaacttgggaaggaatgcaaaatttctagagacacttccaccaagaggtgtcctggagcagaagtggctaaggcttgtcggggaagtggagaggcaatgccagaaatacaaatgtattgtttaaaagacacagacacacactagccattttttttttctggttggaaacacaatatatctcataatcattcaagggaaggcaagaaaataaaaagaaaataattacctataattttactgcccagaaaatacctcttaaaaaatcaagtacgtcttcatagccttttttccctattataatatagtataattttaaacatatatttaaatatttttcattcagatcatattgttgataaaattttatatcttttaaaaatgaaattgaacattctcctgtgccatcctctactctttctaaacattttaaagcttgtattgaattatattctaatctatggatatataataaatgtaatcattcttttgttatttgatattgatcttctgaaattttactattaaagtaaacattataatgttgttttagaaacatttaagtaattatttgttcaaggtctgattattatgatttttttaggatagactaccaaactatatatataaaaatattgtcgtgtcaaatccaaagagtttacacctgtttccactacaactaaaataccatttcactataccacataaaaatttaatttaaagaagtagtccattttaatatgcaaaaatgggttttccttgttttaatttgcatttcttatcagaccagtgagtttagacatgctttcgtgtatttattaaccattgtattttcttttatgtgaccatctgtttttgtttcttcttcattatgggttctttatattgtctctcattttgtttcaatattataacgtttattctttggtttttaattgcattatgctttttagcatactttgtacttacaaaaatttatgttatcgaatctttcattttccctttataatgttttttattattttatgtttatcaaacacccatagcctgtgatcatgtaaatacaaactttttatttgaaatgcagccttattcaatcatatatattagatattagatatatataaaaggcataaaaatatttagtattttccaacaatatattttagaaatctcatattaatagttaactatttcatctagtgactatataacaatttaatcattttaataacttaataattttccataccaatggatatttttaagatttataggatttcttttttttttttaagtaaaatgaaatgcagtgaacatcttttcacttaattctgtgcccatattttggactggtttcctctgacggttttttacataagataaactctggtcagaggttaggagccctcgaggtctcaaggttggtggcatttcgcagctttcgttttactggattggtcagtcttctgtgccctgtggccagaacacattgtgtttaatcgtggtttataacacaatagagtgtctggctgggtaagtctcctctctgcaaaatacaaccaaataaaaccaaaatagaactcttctttttcaaaatattcttggcttattttacttattgattcatccaaatgaatttagaatcaccttgtcatgttttaaaatatcttcctccccataaagcaactaattagactattgattagaatcgcagccaagctatacattcatttgaaaataatggaatttttttcaatatccagttttgagtattggccacatggtttgtctctctttttattccattctgtgagttccttagtaaagttttcttcatattagctctacatgtttttaattaatgttattcctatgaatgttcagttttggtgctattgtaagtaaagacatgttgcacacagcatctctcttcagattggcatgactgaacagggtaaccttgagatacatacgtaatttgcctaaggacacatatagttgctagtcgatacccttaaattcttcagactacagagagaatatgctttataaacttcaagttattagaagagtgtgatgtgagtaaggataaacacctgcggggatatttgggatctaaataaaaagctctgcccttaatagttttatgtggcttttggcagttgcatttaacctttgtgaccagtgctccaccagtcagaaaggataccagatgctacatcctgcctttgcctcctggctgaatgtcattcttcttagcctggagcacagtaagtgcttaacaaataccagctataaaattaataataaaacagcttataataagaggagataattggaataaatgactatccttgttaatttggtagcaaatggcacatagcatcactttgaaactaagcaagttagaaagcatctgcactttttttcaacattcaaatcccattgcctcatagtcagagttcatatttctgacctgtttttccagcaatcagcatatggcttattattatacttgctaaaactactatttttagaggaaaaatatttctggcttgatgttaacaaaattaaataaaattcaaaagtcatcaaactaaagattgtgttgtatcagatcatatgtactttagcagatgtgatgcaaatgttgagacaaattcttgcatgtctcagagggaccatggccagaaatggaaagcaccaaaagagtattgaaggaagtattaggactgctcagaaggtaaaggtctcacatcatcctggtgttcccagaaaagggttcctggaggagataggatggaagaatcttgaagaatggtttgaattggcaagtaagaaagtgaaacagatccttctggaaggaagaacaattggatcaaagctgaggtcatatgtctggagagtagttagttagttgatccgctagaatagcgtttctcaacctctatgtttttgacattttgggctggataattgtcatttgcattctaagatgttgaccagatccctggtttctactcagtaagtgccttctgcacccctctagttgtgcagaatgttctctgaggcacaaaatattttgcccctcactcccagcaactctgttaggaaaaaaaagtttgtgtcgaggagcaatgagaaataaagcagggatatagaccagattcagattgtgaagcacctcacatgccagataagtggtttggacttgtctatcttggtaatagaggacattcatcttttgtgcaagagaatggcatgatattcatgttttatgaagatttattaacatttggcactttcttgtgatgcttaagtgcatttatatgccactctctgtcaatagatgagctactgacttatgacagatgcaaatcttctaaagcatcctgatctcaagttccattctctggtgaaaaattatacagttgtacactttaaatgcgtgtaccaaatgtacattttttgaaaccatacatttttgtttaattgaaaacagcattaaacatttttaaaaactaaactgaagataatcattttaacacaatactttcttcctttcttgctctcttttaagttttgtacacatgaaaataatttctcacaaaatttcagttagattgtatgactattttacatcttttaaaaaaacttacacctaacattaacagtttgctgcatatgtacatagtaatcataaggatcattttggtagtggcagaatattccactgaattgatatactctcatttatactaaagagttatagaaaagttagagtgggaagaaccatgagagattatgtggtctagtgatttctccaacagtgctcttggaagccttatgggtagtctgatgcattgcctaagggactacattaggtatagagaaggcttgggatgcttagtgatcaagttcttacacccttcatttttgctccagccagaagtactcagattcttaattagctttgtatattggacttctgtataagttttttttaatgacagaagaccattcattaaagaagcaaatgaaaatgtttagaaaatcattgatctagaatggtcttttcatttcacacaagctacatatgggtataacagtctccaggttgtctttccttagtgcccacaccaccctgaagtgtctaattccatagcgtagacactgcttgaatggttaaagtctttgctaaactacccaaaccattgttttaggaggatgccacctggtgacccattgctctatcagtgggctcaccctgatttggcaagaagaaaactggccacactcacatggacatgattttggcaagtttggtgctaatgcactggattggaagaaatagaccccttcatttacttggtggcgaatggcactgaggatcatccactctcaccctagcctgttttgttctcaaagagatgcctaaaatagattcttcaagcaattaggctttttcagctgtcagtgtattgcttgtcaaaggcactggccttcttcctgtatacatgtctgtatttctgaacgtagcgtattctaccatttcaatcctcattgcttacaaatacaatgagggacaaaattctcatttaggaatcctgaaatctttccaaatcaggacacgttctccccttttaggcatctcacctgcttctgctgtttgaaaagacaatctggatgatggattaggggcttgtcccacctcctctcatctccccgctggacagccatgtcatattccgacattctccaaccttttcccctaacagtgtgttgaagagagctgtcaagtaatttgggcagaactgtgcacaatggaggcagagagagatggaacccctgggggatcccagctctgcagacttagcattttggatggatgcaaggagactgaagcattgaaaaggtcagaccctggaaccagtctgatctataaaaggcaccacagtgtgcaataattgtcaatgagtgggctaaaagcactgggggatttaaaatgggatggccttgcgcttctccaagtgatactgggaatgagaggtctgagatcccatcctgcttcctaacatttcttaacattgctatcttcatttaacgagtgtcatggaaggatgtgacagtgaaatagaacaaatggagttgggttatatgattgttttccacttttaaagaaagggaaatttagaacatgagttacattattgagggaaacataccttcatccatttttttaaatgagatttgttaggatttttccagagctgaaagaaactcaacaggttagggagaagaaaacacttcatggactctgcagtgtaatggaaagagcattggagtaggagacaggacttctggttgctaattctactcctgccactgggcagccaggccttggggcactagtaggatttctctggctttctgcatcctcatctgtaaaattcaaaggggtgatgaccaagggagaaccggcagtgaatacctgaggtgcttgctaaaaatgcagactctagatagaaggaataaatgcaatgttcaatagaatagagtagaataactatacttaaaaaatatattgtacttgggtgagggatgccctaaatatcctcagtcactatgcatcatatacatgtaaaaattatgtaccccacaactttgcacaaataaaaagaaattttaaaaatgccgatagtttcttcggccccacctggaaatccctgctctggatctctggacctgggcctcaggaatctccatctgaacaagctctcctggcaatgcctttgtacactagattttgagaaccagaggaggtagttaagaggtcattttgaaaaccagggagacaaattagtggagtcccaggtgttcccctttgagtagtacaaactggttcccccttatcaaaaaccccctcttttctccaccgtgcttgaaatacacagtggaaagggttgttccaaccaatgaagacattggcacctccaggcatcttttcaaaatacatacactccctgctagatgagataatatacttccgtgtgctttgcaggctgcaaagaatctttaaaatgcttcataactgtaaaatgctatattgttttagactttattaaaataatgcctgtagtttttattaacattatgacatgaatgaggttactgattttatctatgcctgtttagatgtacttaggaattccattgaaaagacacttttgagtccctactctttgaacagtgtatacatagaaagggatatgaaggacggtaggtaggggttgttccaatttctgactctctctaaggtaataaattatgcattcaagcccattgccatgggactctcagtgtttttccactgtatgcagtgagaatttccccaatcccttggcttgggatcatccatgtgacttgctttggctgagtttagcaaatgtgacacaagcggaagctctgtcattgcactgtagctgtggcccctcaccccaggccccatcacgaacccacagagcaacctgagccttcccctctatgggatgccaagctctgctggattcatagcatgaagcagagcctcgcattgagcccagcctagaaaagctgatcccagctggccttagatgtaccagcaaaatacataactgttggtttaagctgctgaatgttgaggtagtttattatgcagcaaaagctaagctgatacagtaggacaaagacaagttgagacaactggacaaatggctgatacaaaggattgttaggtaccaggagacagatacagcctgtgatagaggtgtcagaggagtggcatcagtaatgtgttcatggaggagttggaatttgaggggggtttgaaagatggtttcaatttcaacaggcaagcttgtgtgcgtgcttgtggatcctctggcatggtgggtaatggcggacatttcagtcacaggaaggagaaagaagagaaacagaaaagcatgaggtgtgtttaggaaattgttagtaggtcagtctgtcaagaagttcggattctatgcttggagagagagagattggccgataagcctagaaaagaagattaaagtgataacttagaggctttaaatgccaggctaaagattttgcagttaatacagtgcacctttaaagggttccactcaggggcagagcatgctcaggactggtctttaggaagctcatttttacagcagggtgaagggcaaattacacaaggaagagctggggacgaggtggccaattaaaaggctattcattactgggggcagtgagtcctggaaagagaagatggaaatccagggaattctagaagatgtggtttgcaatttaaaaaagttaaaaagtctgggcgcggtggctcaaacctgtaatcctagcactttgggatgctgaggcaggcggatcacctaggtcaggagttcaagaccagcctgaccaacatggagaaaccccgtctctattaaaaatataaaattagctgggcatggtggcacatgcctataatcccagctactcgggagcctgagacaggagaatcccttcaacccgggaggcggaggttgtggtgagctgagatcacgccattgcactccagcctggccaacaagagtgaaactccgtcttaaaacaaaaaaaaaaaacaaacaaaaaagttaaaaacaatttaagtatagaaaataaattcaaattcgtttgcagtcttaaaatgtttcctgtaatgtgtaacatctagaaactagagttctacttggaaacaaattcacaagttatggtggccaccaatttatagactttacaaataattttttaaacaagggctcaaattcagcataatatttacacatttgttggaaagctgtgctctggacttaggtatcatttctcccagggtaagaaagcactgaagaaagttctctgagtagttttgtgtttgttttgtgggggtgaggtagggtgggagagatgttttaagtggtgttcctttttttttttttttttgaggtggagtctcgctctgtcacccaggctggagtgcagtggtgcaatcttggctcactacaagctccgcctcccaggttcatgccattcttctgcctcagcctcccaagtagctgagactacaggcgcctgccaccacacctggctaattttttgtatttcttagtagagacagggtttcaccgtgttagccaggatgctctcgatctcctgacctcgtgatccacctgcctcggccccccaaagtgcttggattaaaggcatgagtcactgcgcctggccccctttttttaaatagacctccaaatagagagtgggtgacagagcgagaccctatctcaaaaaaaaaaaaaaaaagttgtgttcaggaggtttaggagctctcaggaacaccaccacctttgaggaatgagggatatggcatgggtggagaaagaggctgcctgtgatacaggtgcagcagctgatcctatagcacttgtgtagctgggatggcccttcagaaatgtccagccttgaaccaaaggattgggtctttatatctccacagtgactggccatgagatgtgggctgccaccaggggaggggtgtgaccctaatgaggtggctgtcatcagctgcggaaaattcccagagagtgacccagctgagagccatgagccacccacacctcaacacttaggataaattcctgggacagagggggattcaggtggcatccacctttggagagagttatttatttcaaattcttgttattttcctaagaggcaagattaattttgataataatggtggtaaataacaatgaaataatacatgaatagcaataacaataagacattattgtttactgagggcttatgtgatgtcaagcaatgtgctaagtccacagcatgcattactgcacttatgtttttaagaagcatgcaggtggaataatgtagtggcccagtgtatggggttggccgcagactgtgtaggtttaaactgctaattagctgtgtgtcttgggcacccagggcctcagtttcttcattgaaaaaacggtattctaataacaacagcaatctgtctcctagggttgtggtgttatacgaatcagaaaatagtggagctggtttgtgagctagaaagtgggagaactgttctttctgggttcaaagcccatgttgtcaaatttaacttttggtgtttgtgggagggtagaccagagcaggtgccacgatagggacccggtgtagtgggagggtgttgagtatttcagcggttggagaggtcaaggttaaaagtgcagtgaaggacagaagggtaagaggcagaagggtgtggaagaccgtcaagctcacagtgtttacctgtctttcccagcaagggctagccccattataaaaagaacaaaacctaaagactcaaaacttcattcctttctgtactgaaccccacccttgattgtttgtccaaggaagtgcccagtttcttgactgtcctccatggcctggatcatgcttgtgaggcactttcatctagccccaccacagtgccaggctccatcagacaccttttggtggagatgatggtcttttaggctcagaaatctactctggttatataaggaggcttgtcacctcacgtatggttgctgaactaggaagtgggtggaacgaaagaaacagcagccgggggaagtgaccatgaagaaacttactgttgtatgtcattaatcgctaattgctgaatgattttattatatggcagccataaaatatcacttgaggttttacagcctgtgctagctttaagaaaacaattccttatgtcaaaatgactattaaattaactgattccatattaaacatcctatggactcccgatgatttatgaggctgtataatgactaagaatccttcctttctgctgctctcaggaaaccagcagccatttttggaacagctaccgaccttggcaacctgagagatgtgctggtttctaagacatctggacaattggagttaaaacactctcattttacagataaggaaactgagccccagggagataaagtgacttaaccagaatcactgtgtagacaaagtggccacactgtatctgttgtgctgatgttactaataattatttatttgtcctgttattcccagccatccctactgtctctctttaataaaaggcaaattgaatcttggaaaactcttttgtatataacttcaaatataatcacttgtgagataaggtgtgatgcctttcggtcacacctatttacatttgttgccctgaatttgcttttacatgtttttggtggaggtagacccagtaaattgactgacaataattgtttgggccttgcaaggtatttccaccagagcatttgcaccttcacacttggagcactgtggggatgctgaatagacaccagccatgtcccctccttcaaagagctcagaatccagccaggagacctgatcctcgggtgtcacatgctgtattgataaaagactattgaaagaagcctggagaagtagttagcctaaagttactgagctagagaaagctgaacaagtcagccagtagcctatgcagccagtcgcagctctgcggtgttcctgtagtcctctctatggtagcagctctgagcatgctgctagttccccatagtgcctgcagatggccccagagtgctgccggagcatgacttcaccactcattaattgattacttcaagcaacatttgttgaacatctgctaggagtcaggcactgaactaggcattaggaaacaatggtgggtgaaacagacaccgtctctgccctcttagcacttatggtgtagcaaggaaacaggaagaaatcaaataatcagacaattaaagttgtgattactaactgtggtaagagcaatttaagatgattaaaggttgccatggtgagtgtaaaaccaagggatctagtgtagactggaactccgaaaggccttccttaatcgtctgtgaattagtcagggctctccagagagagaaccaataggagatagatagatacaaagctggatggatgattgatagatagatatagatggatgagagggaatttattaggggaattggctcgtgcaattatagaggttgaaaggtaccccaataggtcttctgtaagctggagacccagggaagctgctggcatggctcagtccaagtccaacagtctcagaatcagtgaagctgagggtatgaatctcagtctgaggccgaaggcttgagaacctgggcggggggttgctggttgaagtccaggagtccaaagttcagagattctggagttctgatgttcaagggtgggagaagaagggtatctcagctttggggaagggagggagatagctgcagagaaggaggtagggaaggagataaaaagggagagagaaagaattcacctttcctctttttgttctctccaggcccccagcccactgagtgatgcctgcccatagtgagggcagatcttccccacccagtccactggctcacacgccaatctcctttggaaacaccctcacagatatacccagaaataatagtttaccaattctctaggtattccttagtccaatcaagttgacatgtaaaattaaacatcatagtgtatatatgacagggaaccggaacctaacctagtcagatatataaacatacttaacaaaactaaatcacgtagggtgcaggtaatgagtctttgttgggggtgggcatccatctctcttgatctgtgtgagtgaatatggggagattcagtcattgtggctgacatcagtagccctggttagtagcctaactgacctactaggaaatgatgtgcttgtggttaattgcctcctccttgtgcacttcagcttccttacctaaagggtgagaagtttgcaccagaatcatacctactcagtgtgtggtcaggaaactgggtgctggttcacaaactgctactagtctatgatgagataagtgcacagataagtatatctattgagagtgtggaaactcgtgtagcaatttgacattctttaatattttattgcatttacaaaaaaaaaatcagtctgggaaaatgaattcatcccaggtaacttgagaaccaactgcacacgacgacctctgagaacccttccagtgctaaaagccttatactctaattggatgggggtagaaacttctagatcagcattgtaaaatactcagtgtaagttctagaggctggagttgagtggttatgagtgagacgatgtgattttagaaagaacatgttcttagcctgggtctagaacacagaagtcataataccagcagagtcagaagttggtcattctaagaagacagccacaccatgtcatttactggcaatacacctaatctccaggctaaagcttaaaagaccagacctaacttggagcatttgtaaaagaggaagaagaaaaaagaaagaaaaatccaataaactcaaataaccaaatacatatatttgatgtttgttctttcctaatccatttaagtcccatcaaattgctcaaaagctcctttgatttataaatggaatttaggtagtgagtcatctaaaataaaaacgatttaaactttgaaaagtagctcccatgaagcagaataaaggtacttaaaggatttctatttcccaagaccctagaaataccatgaattggagtatctctgtttaactgctgttatggatggtcccttgggtaaacactgtgctttataaaaagctaatactcagaaagagtttttaaaaattaatattcatgcatgggctcatctggtggaaaaatgcatggttgacattttgtgaccacgttgcacaaaaggcctgcattaacagtaagaagcacgccttcccctgtcccatccctcctgaaatatttccctgtgaaccttgatttcttagctctctcttcttcaacattcagggcaggagcatctattctagacctgtgatcttactgggaaacagtagacttgaggaggcagagatgaacggggtgagaaagatctgggtttagaggttgagagttggttttggaaaagctgaacatgaatcaggaacaggctggggcacccccttcactggccacaaaaggctgctttttccttgccaggagcagagctggtgtggggtcttggatttgctgcctcacatttggattgttacatctagagaccttactgtatttgacactattgcctgccatgtgtgtgttaggcaccctcagcatgtcatgtcattctggaagaaagagaatcataatagcccagcaccagtcaagactgctcccttccactcttcttatttgattagccaagaagcctttgctctagctacctggtgttgttttctaattggcttcccctcctattcctcctatttggaggagtcaggctcctccaaatcatgaccatttctttactactcaccttagcccccagtccttcccttcatcttccttccaggaatcattgagccttctctctcaccaaaaaagtagagcctaaaagacgtaaatgtaccagctttcctttgcccctgaactgccctccagagttcttgctctttccccctatttctctgaggtgttggaagaatagctgtaccttctttatgaacttaaatttccaggtacacttttaatcttgtctcttcccagctgttaggggttttgcttcatccgttaactctctcttggttcactatcttcaaatttcttattctctgccactgaaaacctcattatttctcttccatcttgaaaaagagacaaaaagaaaccattccactgtgcatctatatttcaaaacatcatattatatatgataaatatgttcaactctatctgtcaatttaaaagaataaacaaggccaggcatggtggctcaagcctgtaatcccaacactttgggaggccaaggcaggcagatcacctgaggtcaggagttcaggaccagcctaaccaatatggtgaaaccccatgtctactaaaaatacaaaaattagccagatgtggtggcaggcgccggtattcccaggtactcaggaggttgagacaggagaattgcttgaactcgggaggcggaggttgcagtgagttgagagtgtgccactgcactcctgcctgggcgacagactgagactccgtctcaaataaataataaacctcaattttttccttttccactcaggtgactttcctgtttgcctccttttcttcattgctaaattgtatgaaattagttgtaatgaatgtgcttccttaccttcaaatcacctttaaacccactcccatctggttcctccaccactacttcctttactgcaaccatcaggcacctcctaatggccaaatcccatgctttcctttaatttctcatcctacttgacttcagcagatgttaacacggttgtctacttccttcaggagtctttgtccttccttgatcatgattttcttgtttttctttttaccttcctgaccatcctctgctgcatctttgcttgcttctcttgggttggagatcttatacatgtcagtgtttccaggatgctctcttcattgtttcatttgcttgcaaagagacacatttccccactctcatcaatgcttccagtccctctaaagattaccaaaccctatctcacaccctactctctccagaatttcagacacatacttctcatgcccctcgcaacatctctaccctgatatggctctaatactgccagatagctctactatatacctcaaaacccaactgtccataacagaacatattgccattccccaaatgtagaagaactgcatctcctcctttccccaacttggttaaatgagttctcctgatttctcagattattttagttaacaatatcgctatccatcaaattgtctgacctagaaatctcaaataactccagactgcctttattcactgcatcagtccctctgaacagcagggtccagccgctcacaccctcttggcccccttgttgaatttattacaccttcaaaccccttccctagatgcatctgctttttccctgttggcacttccttcagccaggtcctcctcttcttttgcctggaccagcttcctctctgtttctctgccttcagttttactgccaaaacttgagtcagtcctttatggcttcttcttgtttcctaaaacaccggctaaatgaggttatcatttggttaaaaacttctgctgctgaagtcgagagaattatttaaaaaaaattaaagcgtaatgacacattagtgagtcatgattccttgtgaagtgtgtcacaaaaattttgtggccagtaataaagaactgatgttgatgagttatcaccctcattttctttttgaaaatttgaggcaattcaaggttatcagtaaaatgatgtcattcttacatacttgcattcctaaatgaatagaaatcaatggaatgacaactaatgtgtcagcttctttaatatttcttactgaccatagtaagatgcctttatagatcataaagagatatattgaatgtaaatcattgtttttgctatgcaggatttcattaaagattatttgagatttgctcaaaatcagaatatgctcacctgattttcttacatgtgaacagcatctaccatagatcgttttggaaatcaagatagacaaaaactagtctcaatattatacaaatcctttagcatgacacagaatgccttctcataacaaatttctggaacatctttccaaactcatagtcatgtactatcctaatctctccacccataccccacaccaatcactgttatgcttacatgccataagattgtatgccttcaagtcttttggcaagccttccttttgccaggccaatgaaggcagggaatgcaattctaggcaaatccaggaaatccacttatcttgtaaagttctgctcaaaacttttgaaactccctgaaccctctctaacaccttttcactgtggccaagagcatgtttctgggacaaacctcttggcttctctattgaaagctctaatatttgggtcagattttctaagcttcagtttcctcatcagcctaatgtcgataataatgccatctacctcatagagttgctgtaaagatttcataagattattaaccatgcctagggagttcttctgcagctcttcctgagtttagatctgttaatatccgcaactccttcagacagtgcttggctctgccacgctcagctggagtcaacttcactttgcatctttctgaagcatctaatactgtggagtaaattaattttcagtgactttgatgttgtcccaaggtaattctctgtgatactttccagcagggagcctttgaaatgtcgtccctcttataattaatacattgtactgtgctgcacctatcaacagatggatttatcattacacattcagacttgacagaggtcagccatcatctctctccatgtgtccttgcatactcctggcaagttggtctctttcccttttttctttccaagtctcccccgccccgatcccaacctatcccccagtctagccagatccatagctttctggctgaaagtaattatgatatcaggctgaagttttgaggcttggaagggctctactgtgttcagatttcacttctgactggagtcagtgagctaccacattatcaaacatgtacatatactccttctaaataatggaggacataggaactgggcttctcccaatgtctcttctctccgctcctgagattgattcccgagttctgctccatttaaattccctcaaatgtaattaggaaaaaaggtatggacatttatcaatatcatcagcatctttacctttcatgtcttactagacctatatcatagttgaggaaactaaggttgagagtggttatcagtccaagttaattagtaggtggtacagccaggatccaatgcaggcttactctaaagctgagattttaattctgattttataccacctcggtgtctccagtgagtgtctccttcaaggctattttcagattcaccaccagggaggtttctggatcaagtagatctgaatcagatatatgtgacaacttcagagaaagggagaaatcctaggttctttctttgagaacagcttcccagcctgtgatcaaggaacctcacatcatctctttcaatggaaccaatgtcccagcccttttaagaactctacatggaagagagggagttcatattttctctacaaatcacaggaccctcccttgatagttaaataggatgatctcagcaaagctgacaagatgtttccatgtttgttaaacaagaaccatttgtttagctcaggagcatctgttgaataaacaagatatctgatgtgccatttgctcattgaaaattaacaaaccctttaaaaatggcaatttgtcaggagttatatgaagcagaattcattctcagcaagtgaacaaattgaaacttccttcccaggctttctagaatcccccagagccagttgtacagaaaaagtttagtttaatttgccatcattaaggaaaatatgcagacagtgatgggagaagagaagcaagtatcctgctagggaaattgaagagtcctgggagaggtattgtccagtccagttgggatgagctattccccttctgggctgtgtttccatttggagagtgtaggactcctggaagggatcagctttttcttctttcatcctgtttccaggaatcatgtggtataataaaactgtcatcagtcagcatcattcctctctgtgcctccccatggggagggaatcaaatggagggttaatttactccaagagtaaaggcaacaaagaaaagcataaaatgaatgaaaggctgtcactactctcatgtgatggaacagctattagaatcctggctaaaatgaagtctgtgtatagttctgttttcctcatgaagcacacgagcttcctggtattggtccatcttgacctgctccttggaggagtacagtgtgctggcaccaggtggactaagcatattgggcagtgaatctagcatttagtaagtccagataccgtgctaagcacattgctgacatcaattaaatgctcacaaagctctcgtttgttaaatttttttatttttattttttgtgggcttatagtaagtgtatatatttatggggcacgtgagatgttttgatacaggcatgcgatgtgaaataagcacattatagagaaaagggtatcgatcccgtcaagcatttatcctttgagttatgtacaatccagttatactccttaagttattttaaactttacaattagttattattgaccatagtcaccctgttgtgctatcaaatagtaggtcttatttattctttctaactatttttttgtacccacaaagctctcttttatccccatctatagatgaggaaacgaaggcttaagtttgtgtaatttttccaaagtcacacaggtagaaagacatagaaatgagatttaaactaatgcagcttgaaagctcattggttttattttcatgttgcatcacttcagatagcccttgaagatgcaaggttcctgggtctcttggtgtaaagactgagaagagcagcctctgaattcatgagcgctactttgggcagaagtatcagcattttaagcaggatattactgagattcctgggaagtgctggctggctggaggttgatatgctattcttgctgggttgcaattcaaattctttatttagagagagtttggcatgggaggtggtgagctctcggactttatataagcgggtccctgtgggctctaattagaagctaaggagttagctgactctgggctctgagcaacttgctgcctcatcttctcacgttagcccttttagcaattgatcttgtaaactttctgaatcagagaaattaaagatgaaaaagcgcctattaagtgatcttgccccagccccagactaggcagaatgactccaaagagaggattcctgagtgtctagttcattttaattttaattgtcccagagggtgtgacttcttgatcttcccctgagcagcccttcccaggctgatggatacaagcatgagcagtatctcacaggaggctaaccgctctgtgccagggctatgcgtgtgctatgcatgctcattttgccctgttttccagggcctagattttttcacatattgccactggaatgtgctggggcttaggaggaaaccttttctttctttctctctctctctttttttttttttttttttttttttttggtggtgaggaggtagattaaatagccttgtgtgtaaataggatctggcaattttgcctgtttccccccgtagccagatgatgtgtctacagcaggatttatgcaggcaaaatggggttgaggatacatgacaataattgggatcaaggactgatgatcccttgggaagaccacaaacactgatggcaggcacgtagtgagtactcctaagcctatgctaagggtgtcacagtattatctggtttaactttcaccataaccctgcgaggtaaatattgctgttattccctcttcagagacaaggattctgaggcccagagaggttggaagcatgtcaaggtcatatagctattgggtagtggggccaggatttaaacccagttctctctgtgtgaactacatactttaccctactatacggtgttactacctcataataaaatgtactgaacaaggtcacactgaggaagagacaggaaaggaccagtgatgattaattggagctggctgttgttcagatcagccaggtttagctttctacaccaggaagactgggcttgtgacatgagctctatgtgcaggttccaggtgcggagatcttgcagggggatttggatacctatgttcacttagattgtgaccccttccaggcctaggcgaaggggatatttcacccttgtttctcctgcttagagaatgacgctggacacagggtgttcagtctggtacacacgtagaggatctaactgattaatgctggtgtgctctgcagccccacccaagatgcccttgcttgttgctgaagatctttttatttattccacttctttccttgggctgtttttggctgtgggcttgggcctttccatgaggctactggtagttgattttagagcacagaatgttaggcagcaagggcagtcctaagtggggaactatcttcagttctggggcagggagtggaggcatgagcgtgggaggcatgggggtgagaagcatggagccactggatgtagaggtcagagggaagagttctgccaggggagctggtacctcggactgggtgggggtgtggcatcagaaaagaattactcgtgtcacagtttgttcccaggtggtcgctaaaggatttgtttgaaggaacagggaaccacagacgtttattttctttccctcagtgttttgtgatttcaggatgcagtttgatctgtgtgtgtgtaactgtccgagaagccatgaagtaaagggaagtctcctgaggttaggttgtggaatcatttcaatcctcccacttttcctctgctgcctgaggaatcttgggaaaatcacttaaactgtccttcagtaaagacctcattttccacattttcaacttgtgggaaatacatactttataggttacttcttcacattaaatgatataaagaaataaggtgcctgccacagagtaggtcattcatacatgccaggcattttctttgctctctttttgtcttgtccagacaagcctgcacggtgcatcaccagatgtgctgtggagccaagtccgtgtgagctgtgtttgaattgggagctgtcatttatcagctgcggtgacttagacaagtccctagctcatctgagtctctagtctctcattgataaaatgcagacaaacatagtacattccttgtcggaattttgatcatttgttcaacaatataattgagtgccagtttcgtgctaggaggtgaagttatcatggtgggcacagcagccaagattcctcccttcaagaaacgtgtagtctagaggggaggcaggcagtattcaaatcatgaattcagtgagataacacacacagagcattatgttgtcgcaggaacatgtctctcataagatagtgcacaaatctctagctatcgttacattacccttggggctactatggttattgtcttcttcctgggggtccccatatggttacaacctcttccctgttgtcttcccacttatactatgaacccgtaaagcagatgcccattttctaccattgattccaacctcagtctgggtctgggatagctgtaagtaaggctttcccaggaagtgggctgtcagtgtagactctggtcaggtctgtctacaccaatatcatgtaccaaaatgcatgcccctagcagtcccgaggcaaagactaggaaattctgattttattctcttcagagctgagatacaattaaaaatgttaccacagtaattggcaacatccattaacttgatgaaaattgcccaaggcagcacatttttcccccttctgcacattattagcctataaatacacctggttcctttttctttcttctccagaacttccacaaaacatcctcccatcctcccaagctgtctccttaatgccctttgcctttttataattaactccccgaattcctccagcacttccagtcagtaccacataatcttgcatctaattacatgtggcatggtggctcatctgagaggtagcatggaaagcccacattactgaaaggagagcactgactcagtcagcagagcccagggtgagtctcagctctgccttcacctggcttaggatcttaagtgactcagctttctgagtttgctcatctgtggaatgggagcaatgatgtctacctcctaagatgaaggctattaacattagataatgtgaacatgctctgtgaaataccaagtgctgggagctcctatgcattgatcccagcagctccttcatctgcccatgccctccctgttccatcctctggtccctgcttaggggtaggtgcaggtgggttctggcagcacagggatgttcacagaagccctctcctaatgggtgtggtccttgctgatggggagtgacaccttggggacctcaccagcaggaaattccttttccttttaatatacttgcttcattagtttccctataaagaaggggggcgagaaggggtggagcagaacaggaggctttctaacaatcaacagtgtaacagctgtcagtgcagaggggaaaatcataatgcccccttcctcctgagctgtggagtcactgaacaccagagaccacagagggaagggatccctagtctccttaaagctcccagccccagcaacctcttcaatttgcagaggaagagactgtacccaaagagatcagtaacttagtcaaaactacacagctggtcagtatgaacgtggtcagaatcaaggtctttataccagtccagtgctctttccattacgttccaacacaagtttttattagtcactttctacataatcaggaagtgtggaaatgagtgtgtgtgcacatgtgtgcctgtgtgtctctgtatgttccataaagtgcttggaacctggtgtacatgttcattaatgtgttcttgcatcatttcatttcatcatttccaagaccaaatcaggaagatttttgattgttatatcaatttgaaggttcagagaggttaactataacttgcccaaggtaacacaattaataaatgtagagttgagattagaatctaggacctatgataccaaagctcctctctgaaccactggactatagaagagacgaacttttgtctaaaaatgcacgtgagttagaaatgatgcccagtgtgtaagtgaaatctccacaagtaccctgttatcctgagcttgagactgagaattgcagggcggtgagatttttgttcattcctaattgttttcctttaagtcgtctctatggcctttataaacctgtttctctctcaacttgcatactctccactttaccaaccccaccatccaccctggcctcctgaccttcacatcatcactggactccatgctgggtgcacaggcagccctcgggaagtacttgctttaggagacacagggccaactggtgggccagcaggacgatttgtgcctcatgtagatgttcctctcttttatacccacttttgaagccccaaccctttgtggaactgttcgttggagctatgctaggctgtaactcacacatatgctgtaaacaaatgggccatgtggtaggctgtgtaacagttcccagagtgcttacacacagtaggtattcagtaggtatttgccaagcgactgtttgtcctattcctagtagagcagttgtccagctgtctttaggtaaattttcgtggattttcactactttaacacaatcataaaatcccagggaccaaatctccatttaaaatggctactgccagcatatgacatggtggtggctacagttcactgagattctttaatcaaattgaatttctctacccgtggggattggcctcttgacatgcatatgctttgccctgaaaatatttcatgtggctgctgcatttggttccagccatatagaatgtataaagatatcagattaaattagaccatatagttttccacccttccttctttcctagtaggaattgtgtcatatttgtgacccaatataaacttatgtgtttttatcatgtaagcaaaagttacatgaaaagtacttagtctaccacatgagatgcactctaatattttctattccagtctcttctattttatgaaacattatttgtgttgtgattcactaagtgtatttcatgacccactaataagtcccaaccctatggtttgaagaacactaatctaggcagtgaactttttaatttgctggggaaaccagaaggatgaaggggcaataactatccaggtgtcattaagatcgtgcatattctgagcaacttcctagggggtgtatcggtaatgactctctggttgcacgaaactgactaaattaaacacacacacacacacacacacacacacacacacacacacacacagagggatggtattaggatccaagtaataaatacatatagttagactttaggcagaaccctatcctaggacctcacagagtgatctctttttgtctcttgtctctgcttcgctcttctatctggaagaccagcttaagatatccaagactaattgcttcaagtctcatgttatggtctcgtaaaccaatcctaatgtctgggaaaagaattctttgatgcagcttggtgtgtgggtgtagcctgatctactcagctgttgacaagaggcaggacctcatggtacagacatgggtgtcagtgtctgcacctaaaaatctgtgaatctggggctagggagcagttgacagaggcagggggaatatctataatttgggaggaaatcttccaaagtgcccacgagagaagccgtgttcatttgagctggatgagatccctgagttcttgctgccctagcgttttcacaggacgatcacatttgtcaagcaaatcacagatgactgtgtttgacagctccaatattgctttgaggataaatggtgaaaatagcagcataataatataaaatgaagactttattcagttaattgcctagagattaattaaatgaatgaaatctgtttcaccatattatgggactcttttcaacatttatcctaaacatactgctggggttattgttcccattcatgtatttattcagctacttaacagatatttaagaaatgcacagggaggcacggtgctaggcactagaagaaaatgcaatttagtcagatctagagcctgtctttaagaagaatgaaatcaagaaggagacaaaaatcaggtgtacaaataactaaaggtggcgtgagatagactatgcttgaatccaggctccatctctctttctcactctgtgtcaatagttacacaactggaaatttcaaaatctccatttcctcatctgaaaaaaaagaaaaaaagattatattactatctcaaagtttgtttaaagattgaggtcatatatctaaattaatagtaaaattcttggtacgttaaaggtgttctataaatattagttgcacttacgatattttgagcactatcatactaagtgttacatactgcaaagtgttaacatgtgcctctctttcttccaaatgttttacatacatttaatcaattagttctcataaaaacaatgacaagggtgccattattacctccccattgtgccgatgaaaaaatttgaggcatagaaaagttaagcaaattgcctagaatcccccagtgactgagtgatggagccaagactctaacccagggtctggctctggaatttatgctctgagctgcattagtgatctgtgaaaaggagcacctgttacagtctgagattgtatcttgggctctaataaatgattctcagctctgacttcacattcctatcacccaagagcatctaaaagctattgattcctggacttgactcctggttaatgattctcaaagtgtgaatcttgaccatcatcatcatgtcatctatgtatttcttaaaattcttgggccccacccagacctccagaatcagaaactctgagggtggagcccagcatcggtgttccaacaagcccaccagaagattctgatgctagctgctacaatcagaatcagaatgagaggactattgctccagaccaattactccaggatttctggaagtagggcctatgcatttgtatttaatatttttggaaagttcctcaagtgatactaatattcagcccgggtcatgagctttcacagaagctaaatattgagctgggccataagcagggaatatgtagagtggactagaatgaatatttcaggtggaaaggcagcttgaacaaagacataaaggaggagaaagtttgtgatgtgaattggggaaatatcttgagatacggcagggtgatgatagtcaatagtaacatattgtatatttcttttttaattggtctcaatgtgcctttatttttttaaacttttatgtttggttcaggggtacatgtgcagggttgttttataggtaaactcatgtcatgggggtttgatgtacagattattttgtcactcagatactaagccgagtaccctatagttatattttctgctcctctccttcctcccactctccaccctctggtaggccccagtgtttgttgttcccctctttgtgtcatttagctcccacttagaagtgagaacatgtggcatttgtttttctgttgttgcattagtttgctaagaagaattacctctagctccatccatgttcttgcaaaggacctgatcttgttcttttttatggctgcatggtgtaccatggtgtatatgtaccatattttctttatccagtctcccattgatgggcatttaggttgattccatatctttgctattgtgaatagtgctgcaatgaacattcacgcgcatgtgtctttatgatagaatgatttatattcctttgggtatatacccacaaattggattactgtttcaaaaggtagttctgtttctagctctttgaggaatcaccacactacttcccacagcagctgaactaatttacactcataccaacgtgcataggtattctattttcacctcaacctcaccagcatctattattttttgactttttaataatcatcattctgactggcatgagatggtatctcacagtggttctgatttgcatttctctaatgatcaatgatgttgagctgtttttcatatgcttgctggccacatatatatcttcttttgaaaagtatctgttcatgtcttttgcccactttttaatgtttttttttcttgtaaatttaagttccttgtagatgctggacttttgtcagatgcatagtttgcaaatattttctcccattctgtaggttgtctgtttattctattgatagattttttgctgtgcagaagctctttagtttaattagattccatttgtcattttctgcttttgttgcaattgcttttggcatcttcattgtgaaatcttccagttcctatgtccagaattatatttcctagattgtcttccaggatttttttttatagttttgggttttacatttaagtctttaatccatcttgagttgatttttgtgtatgatataaggaaggggtccagtttcaatcttctgcatttggctagccagttatcccagcaccaaaacagcatgatactggtacaaaaacagacatagaccaatgaaacagaatagagagcatggaaatgaggccacacatctacaactacctgatcttcaatgaagctgacaaaaacaagcattgggaaaaggactccctgttcaacaaatggtgtattgtatatttcaaaattataaagtatatttcaaatttatttaccacaaaagatgacaaataaatgaggtaatggatatgttaattaacttgacttaatcattctacagcatatacatacagtatatcaaaacttcacattgtaccccgtaaatgtatacaactatgatttgtcggttaaaataatattaataaaattatcatttttaaatttaaaatctagctaatcagtttataaagcattcatactttgaccttatcagtattttacccttaatatttccctcatgcataccccaatattcagtgtttttaattcctggggaagtttttgccctggaaataatactcacaaagaagaaaaacacaaaggatcttggtcctgccacccccttccaagaccaagagctaagtgtgttatgaagaggctggtactaatgttccaagttggattctagggccactgacacaagctctagctgtgtctttgcaaagggttggtttctggtctatggcatgaatggggttggacaggattgtgatgtttctgaggttgtagcgtccagctctcttgaggactgtcgtggctgggtgagcggttatggttcccaagaagttcctgtctgacctattttatatggtaggatttggagactgtttgcacaaagggttaagttgctaaaaataagtttgaagccacttgaccttttctggcacttctgttagtagcacctgtgagtctgtggttctaggagctgattccatttcttccctggagttttggctgtggcttcctatttccttttgttccctgcatcctttcttggtctttggtcagaactcagaagggctcccaattatggagattttcagatgattcttatgctattattgagctcattaattgttatccaattaatgacaataccctcaggaaggcgaacaatctacaaggtaaacatgacatgggacacaggcaggaaagtgagacctctttaggccataagacagtttgtctttgagatgcaaacaccatgcttatgaagtttatctaacagaatgaaagtattataaccgttcattcaacaaatatttactgatgatctaccatgtgccaagtgctataataggatcaattgatacactatccagtgaaagcctgtgaggtcaagcattgtgtctaataaggaggaataaaggtaatttcaactcagtacaaagatttctccactggggaggagaccagattgttacaggagccttgtgaagagttggttccaaggatttgtgatgtacactcaatctagagagggagaaggtgcctaaactgaacttcttagtagcaggggcttcttatatctagtgccttgaaaaacactaccattactagttacttaacaaatgtagaagtatcagtcggggagctgggggaagaagacaggcaggaaagtatattagtttatccgtccttcaaatagaaaataatattgtcatagctaaaatgtaacgactgcattatatgtgtcagacactgttctcaaggattactacttagctcattttaattcttctaactctatgaagtaggtattatgaacttccattttatagatgtggaaactaaaaatcattatttgcacacatgtgatgaagagtttacacagagggcctgatcctagttcccttcttgaagaagactggaaaaatctactggaaaacgttagtttttccccagtcattaatgttagtcttcagaaaatccctgtggtagaattcatgattgagtaatttttttaaattatttatttatttttagacagagtctcaccctgtcacccaggctggagtgcaatggtgcgatcttggctcactgcaacccctgcctccgaggttcaagtgattctcctgcctcagcctcctgagtagctgggattacatgtacacaccaccacacccggctaattttgtatttttagtagagacagggtttcatcatgttggtcaggctggtctcaaactcctgacctcgtgatctgcccgccttggcctcccaaagtgctcccaaagtgctgggattacaggcatgagccaccacgcccggcctatgaactttttaaatgttcataggattttcataaattcatacctgatcttcacatatttattttgtcctataaaattttgttttatagtcatttaattaaaagtaggaatacagcatactcaaataaaggcattattgattacttgtttacattagcaataataatatatactgaaacaatttatctttactatctgatgctttctagaaactttctaggagttttttttttcaggcagttttaataggatgcttgaaaattcatctttactcttttgcagacattaagcacagggagctttatgtgtcctgaggctagttctgcactgaatactgctcatggccttctggtctatcctggcctaaatttggtcctagaaatgtgaaggaacttggatgcttgagagggaagaggtgccaggggcaattattaacctgcttggcatatctgagcaggcatgcctctcctcccctccctaatacctgtggcaatgtcacggaccctcttacacatgcctcacctcattctatcatcacagacctcaaaaaagtgaagcccaagccccaagttttcttttcttcagccatgtttaatccttcttaaggtttctttgcaaaaatcttcagtcactactcctctactgttggcccaacctcctttttctattctcaacttttccttcttaccaattaccttcaatatgagtgacttccagttcatgtagtctagaaccaaaattttctgcaatattgaaaatgtatacagaatgcattcgtatttcctaaatgctgctttaaagggacttacatgttggagaaagggaggcaatgaggcatgatgtttatgattcttactctaggagagatggatgggcacaaatcccattcttttcgccagctaggagaggcagcttacaggagaagttaagcttatggctcaaagccacctgcctggtttgagtctgagttttgttgcttcgtggctacatgtctttgggcaagttgtttaagctcttatgactaattgtgcctttttaagtagagaaaaaatcattcctaactcatagagttgatgagaggattaaacaaaatcaacatttacattttaaatatagctaacacatagtgtactctcaatatcaatgaattgttattatgtgatattctcattttactgaagagaaaaattagataaatgataccttccttaaaagttcattttgaggattaatgaagataatgcttataaacaccaaacacaatgcctgacacaggaatggtctcaatacccattagcatttattaccattattatatatactttcccaaacatttccacaagtttaacccttatgatttccacttttccttaaagaagaaaactctgaatgtttgcatcatgtatttctttgcttggtgtatttgtgtgtacttcccttgcactgagtttctacaagtggagacttgggactttaagacgagggacctgattgcttacacccaatgaatgtcagatagtttcctggtgagttgttatggttctaaataacaataagttcatgggcttctcagcagtttgtgttaggtgaggaagtgcagttcttgaatgcctatttgtgctgccttgttactaggggaggcgcagagtgcaagcagcaattaagcgtgtccagctaaggcagtgctgcttcttctttttttttttttttgagatggagtctcgctctgtcgcccaggctgaagtgcagtggcgccatctcggctcactacaagctccacctcccgggttcacgccattctcctgccttagcctcccgagtagctgggactacaggcgcccaccaccatgcctggctgtttttgtatttttttagtagagacggggtttcaccatgttagccaggatggtctcgatctcctgacctcgtgatccgcccgactcggcctcccaaagtgctgggattacaggcgtgagccaccgcgcccggccaaggcagtgcttcttaactgggtgtgattctgccacccatccccaccaggcgatatttagcagtccctagagacatttttggttgccacaactgtgtgagagtgttactgcatctggtagaggccagggatgctgctgaatattctggaatgagtaggacatcttccacaacaaagaattatccagctcaaaatgtcaacagtgccaacattgaaaagccctaggctaacgccatcaacatggcagaaggtgggcggcggcttccctctgtgggctggaggagggcctcaggccacagctcagattgtggtgaagaatgttcttcctaccctcagcagccaagttattttactatacctctggccagctgagcagcttcatttcctcccctgtggacctagggacagagcagttttgaagtacaaatctcttacccctatcatttcatccaaaggggagcctaatcctgagcagtgctggagctcaggagaaatattgaagaaagataattagggtctctggccttaggaagtttactgtctggtgagttgcatatatttataaaaatcattctatttctaattgatagcttaagcaaataaatatacacacaccttcacaaacaaaggcaccctatgggcttgtatgtatcaagaaactgcaaacctgagatggaactaagaaatggattcagatttaaggacctttagctgtgtctagtggtctgtctgtctcttagagcatttccctgtttgtgtgaacctctgactctctgattctctagatgtatgtgtgtgtgggaggggagggtggtgaatgtgtgtgaagctgcacacatgtgcatgaactgtctctgtctctctctgtttctttctctatctctgtgtgtttctgtttctctctgtcttttggctattgtcttcatattaccacctctctctctatttctctgtcacactgtcaattttttttttctctctgtatatgtacatcgtttttatagacctgatattcctatcaggcaaggaatatttctcctggtgacaagatttgagagacaattctttcctaacagcttcagtaagagaaatcttgaggatgtcttctaagttgtgatcacctgatcaccatagccaagatgtctcatgaccctactggatcacgtgacattccagggcttcagaggcatgggctgctgtgattgaccagcctggccaaaagcacatagctggagtcaggtagacagctccataaaggatgacaggaaagggtactgagcagacccaaaccacaggtgtccactctagtgagccaagagcaactcaagagaacaacttaataatgcaagtgctggaggatgtgtgatctacattctgggttctctagaagtataaaggagagagatcagtgtgagctggtgacgagggaaggcttccaggaggacttgattcttgctttcaaccttgaaagatgtgtgagattttaactaggtggaaggaagtaagccttcctgatgagggaagagtttctttgcatgttttattggtttggttgccttgttttaagctcccaagaggcagagacttttctttctttttagtatagcatagtatttattgaccacaatcaggcttcgtcagtatggtgccaattctctgaatgctactctgccagtgaccttagggagagaatggaagaataataactgagaaacttctaatcctgagagtaccagcatgatataaagaaacagggagttgcttgtagattcttgatattagacctttgtcagatggatagattgcagaatttttctcccgttctgtaggttgcctgttcactctgatgatagtttcttttgctgcgtagaagctctttaggttaattagatcccatttgtcaatttgggcttttgttgcaattgcttttggtgttttagtcatgaagtctttgcccatgcctatgtcctggcccatgcctatgtcctgaatggtattgcttagactttcttctagggtttttatggttttaggttttatgtttaagtctttaatccatcttgagttaatttttgtataaggtgtaaggaaggggttcagtttctgttttctgcatgtggctcgcctgttttcccagcacaatttattaaatagggaatcctttctcattgcttgtttttgtcaggtttgttgaagatcagatggatgtagatgtgtggtattatttctgaggcctctcttctgttccattgttctatatatctgtttaggtaccagtagcatgttgtttggttactgtagccttgtagtatggtttgaagtcaggtatacctatgtaacaaacctgcgcattctgcacctgtatctcagaacttaaagtaaaaattctaaaaatattacagtggtcagatatatttgggatacattgggttaacaaaatgagacatttctcttctgggaaaaaaaaaaaaagaaagaaagaaaccgggtggcttcagaacaaataaagtatccatatagtcccttgtggtaccctcagtcctctgcgtgtctggcctcaagtgttttacattgaaattttggcattaacacaggtagatcagattgtttattaattcagtaaacacttcagtatcacctaatatgtactacacacataggtcccaatggttcaaaaataaataagacaggatcccactttaaagtttatatccaaatagagaagacacagaaatgaattagcaattgcatacatgatttgattgtgctgtgcaaagcagtggtcctcaaacatggctgcacatggaaatcacctgcgacctttaaaaaatactgacaccttggtcccatctgtgaaagtttttatttcattggtctggcgaagaggacacaggcatctgtatatttcagagttacctcccagggctgtcattagcagtaaagtctgagaaccactgggataaggatgctttgggagcagggaaagggctctgcagtgatactagggaaggaaggactgctggaggggcaaggcccagtgagcttggaaagaggaatgagagttcactagggaaggagaggggcagggagatgagtggataaggacgttggagctcttcctgctggaagtcaggaagtctttctaattttggcctagtccctgtgtggccttaggcagacatccatttttttctgtgcctcaatttctccttcagtcaaacatgactaatgatgcctgctttccttaccttaggggtctgctgttaggataaaatgaggtaaagaaaaaggaaacgatagaatgtcaatgatcactgggaaaaataacccattagagtaaagcctcatttattcagcctctttggggaaagaagtgttttacataaatgaactttcagatgactaaatttcgacctttcaagaagtaataattttattttaaccaataaaaatcattttagtttttctaaaacataccacttgctgccgaagtaataattttattttaaccaataaaaatcattttagtttttctaaaacataccacttgcagccttaatttcttaaacagagtaccctggatgccatcagcccctgtttcttttcttctgtgccttcagccccgcaacatagatgtcagcactgaactgtgctgtgttacagtaatgcccccagggctgttgagaagtgtagggatttgtggcatggaagattgggttttgagttcttaggtctgtttttcataagttttccatttctcttgctatccaagtatcagctcttgggtctcaccattttcaattctactttccatttctaacttgctgctgcttctctgctgaagactggaaaaccagaatacaaatcttagaatagtgtataaactctgagtcattagactataagtaagagcttgccagagagagtggattgtgtgatctttagtaaatgagtttttaatgtgtgtgtcagctcttttcagtggactttttgggccttactctggcctaggtctctaatttaggagacagctgactgggctttatgtgtggaaggtcagaggtccacgaggattgtttgtagggattctcaggcctccatcttctaggtgttggccagagagacctttaaggttttccatctttctcaccaggagaattttgtccgtgtcagaccagattttgaatgtctattgccaaacttctgttattttcaaggcaggaataaagaaggagacctaggattaaactcaggaaggaaggaatatcttgaagcaaacagcccaaactgaggcaataccgtgttccccatcgggtagaacaggcaggtaaagtgggagggcagaggaggaggaagtggtggaaggagtcaagaaagttaagacagaggagatagatggaagacactggggaagggagaacttctgggaaggtgcaagatggagaaggccaggagcaaggtgtagaccagcatgactatgcactctgtattcttctctattttctttgaatcgttgacttattgaccattcagtactcatgtctcatgacccttacagatgacagttccttggagcagccacactgtggggactgccagtggccacattctgctggttcccatactgcaggatggtcctctttgagaaaatggatttctgagtagcagttggccctgagtgcatcccactttgctgtctgctatcggtgttgtcactgagcttctgtctctcccttcctttcccaggtcggtggccggattggataaggaggcggacctggtgcacatggaggtgcggaccacggatggatgtgagttctgctacagccaggctaggcccagggagatctgcctgcaggtctctgtcctcccccaatttgcattttaatatcttgggaagatgaaaagctctgagctccattacagccacatccatccttaattcccagagtaagggtgagaagtcctttcctaagggagacttttcattgaaacaaactcttgggaatgaattgtctggggatatgagttaatgcaatgaattttgaggctcctgtttgtaatttctttggcatcttcagagtaatttgaagaggaatgtccataactcatcatggtattttacattcacatggcgaattgcaagggctgcctgcttcaaagtatgaaccctttatataggcaaccttaccaaaaaatgtaatggggcattatttgcaaaactgtttattcatccattcgagatatttagggatggcctgctaagtgtcagacataattttaagccctagagagagagaaagtgatgagcaagttctatactatccctacaaacaagggactcttctagcagtgaaatttcaggattttaaacacatgacccgctgtgtaccttgttcagctgtgtacttcttacacaaaattggactgaaaaagcatcattttgtaacaatttaagcattttattcttctcagagttgtttatacttaaagggctcttctccatccaggaaaaataaaatcagcttaaacaaaaatatataaaaatataattagcatagattgagaacagagccaaataatctactagtggtgaggcagaggtgcagcagaacaagcacctgtctgtgagttggggtactcggctctgttaccctctggccttgataccaggaaaaactccttaacctctctgggctgtaactccctctgtgacctgagaatactcatccttgcccggagcacctcccaggattataggttaatcaaatagaagatgaatattagagaaactgaaaaatgttgtataaatggaaggcgattctgttttgacctggctgttggcattgtggtatcgttcagagtttaagtaaaactgcatgtgctttctgcaggagaaatctactgttggaggccaaccgtagatgcatgccagaaatgtgcatttgggggaatatgttttatatgatttatttttatttttaaaagagttagaaggtaatcagaatttgttactatatttctgccactctgtactcctccctccctccttccttccctccctcctgtcctccctccctttttccctccctccctccttccctccttcctttccttgccccttcccttcccttcccttcctttcctccttccttcatccctccttccttccttccctccttccttccttccctccttccttccttccctccttccttccttccctccttccttccttccctccttccttccttgcttccttccttccttccctccttccttccttccctccttccttccttgcttccttccttcgttccttccttccttcctccctccctccctccttccctccttccttccttccctccttccttccttccttccttccttccctccttccttccttccttcgttccttccttcctccctccctccctccttccctccttccttccttccctccttccttccttgcttccttccttcgttccttccttccttcctccctccctccctccttccctccttccttcccttcctccttccttacttttcatctcattggatccttaaatagatgtaaatcggtgagacagccagggatgacctacactctttttaatgtattttttaactgaagagctattgggaatttaagaagatactgtcacacacttaaattactgatcataagggtggtggagcctggattcaaaattatattatccaattcttatggctgagaaagaaactgggagaagaatgagatgtaggggtttcagggagcatagaaggacaggaggaggacagcaaatagccagtctcagaaaatgacccacaggccagttttcaggacaactctcgcatgggttttgcctcctaagtcaacctgtttaggccatatttgtgatctgtcatggtcatggtatttcagagttggaggatggtctgagttctgacctggtgtaggaatcccttctcccaaaactctaacagtacattctcaggcttcgtgagctcaggcttaagacacattattttctgatgctggacagcttctttaaaaaaatgtagtttcttacattaagctaaaatttattttatgaaagttcaagaattctggtccaaattgggatgaggcctatggtgcaggacttccgtgaaattttatgagattacaaatgcaaaacacttagaacagtttctggcctattgccagaattcaataattgaataaaggcaggcagaaatataacagagataaatgtcttgtgctgtacttaggttaaagtatagaatatattagttctgttccatcttctaggttttttattttattttattttttcattataaatcctccactggaattctagggtttttaaaatcaatttttaatagctaaaataatgctttttcaatctagtaaattgtccctaactcaactttatttagaaagtacacatcgcaaaactgccttagtctgggcatgttttatttacataccctaacaaaatgcataatgcctttcctttgtggtatgcaatgagtgctccctcacacttgtgcattcacaaacacacacacacacacacacacacacacacatctctaccatcatttgagcatcatcaaaaatacaaaaatgttttatttactgtttttcctgacatggtagtttaactcaaatttgcccagattcacatagctaattggcgataggaaaaaacaaacaaacaaacaaaaaagcaagttagaacaaaaacctcccaatggactagtgagaaggaaacttctgataaaggacatctacaaaaaacctaaaattaacatcatcttgatgatgagatactgaatgctttctccccgaagagcagtaaaatggcaggaatatttactcttaacacttttattcaacattatgctgaaagtcctaggcagtgcaataaagcaagaaaaatgaaatacaattcatatagactgcaaagaagaaaataaaacttgttattctcattgacatgattgcctatgtagaaaatcctaaggtatccataagaaaatctcctagaactaatatgtgagttgagcaaggttgcaggatataacacattcggtgtagaaaggatattattttcaatcaatggtattggatcaattgggcagtaatctgggggaaaattaacttcaacctatgattcacaacttatacaatgattcacaacttatacaaaatttaactccaaatagatcatagatctaaatataaaacatagatttataaaacttttaaaagaaaacataggggaaaatttttatgaccttgggatggacagagttttttaaaattacactaacagcaaaattgataaaataaataattgataaattgagcttcatcaaaatttacaacttttgctcttcaaaagatactgttaaaacactgggagaaaatacatgcaaatcaatatccaagaaaggacttgtagccagaacatataaagaatgcttaaaacatagcaataaaaaacagctcattaaataaaagtttgaatagatcatttagcaaagaaaatataaagattacaaataaacacatgaaacagtgctcaacattattagacattagggaaatgcaaattaaaaccatagtgatatatcactatatatctattgttatcaccaaaataaacaaaaatgacaatatcaagtgctggcacagaagtaaagcaatagaactctcatacattgctggtggggatgcaaaatggtacagctactctgaaaagatattttggtagtttgttataaagttatacacatcttataacccagcaatcccacttctgctatatattcagcctagaaaaatgaaaaatttatattcacattaaaacctgtacacaaatgtctgtagagatttattaataatcaccaaaaactggaaacaaatatctttgaatgagtgaatgtattaataagctgtggcacatctacaacataggatgctactcggtattactcatatttgaaacaacacatgaattttaaaggtgttatgttgagtgaaataagctaatctcaaaaggttacatgctgtattattccatttatgtgatcttatgggaaagacaaactatatagatagagaatttactggtggtttccagagtggggaaagtatttgacatgaaaagctgcatgaaatattttttaggatgatgtcattgttctgtaacctgattgtggtggtggttacgtaagtctatatatctgttcaaacttacagaactctatgccaaaaactcactgtgtgtacattgaaaaatatgtttgtattaaaaatactaaaattaatatttttggttaataaaagctaggaggcatagttcctgacttctagttctatagcaattcctgcttttctcattcattcatttattcattcgcttacttatgcttttacccaatcaacatctacttaaaatctatatatactgtgcactgaggggacacacaggtgaatgtgatatcatccttaccatcaaggagcttctagacttgtatttgaatgatggacaattcaaatgatggacaagtattagaatgttgctagcacactctgacaaggactttaatggagttgggaatatattgtgttgaatcataaatgagattgagactaatgacctaagcaagttaggggaaccatctcagaaacagaatgtttgatttggtactagggattagtaggaaattatctgagcattctggatagagagaagaaacttgcaagttcccagaatcatgagaggtggtatgtgcaaggctgtaaattataatctggaaaagaatgaatggagataggttggtgaaggtgggttgaagaggatctatgagggaacaggtaggtagcttcctgagccacagttcatgctgcacaccaagccatctatggccatccttgcctgtttataatgataaagcttcatgaagcaattatatttcccccagctgcagtctcacatatggatggtaccaatcaatctctggtcacttcaccttccgttctacctgcctcttttatctgcttgtttcacatttaagatacaggaagagatagatgaaaagctaggactcatttcagctcattcagaccccagcctccatctctggagcacaaggcagcttttgctctgtttccctggtccccgatccagactaacttggctcataatttaggaatgattctgagaaatggagaagtcaagtggcttgtctagtggccccggacaagtggtggaggagcagactgtgactgtggtggtagagcagaccagagactagcatcagtgatgaggtcaggtaacatcctgtaccctgcttctcagggactgtactctgagcagacagacttatccagtaccctcagcactgcgtccaggtcttttcttgcttgatgacaccggacttgccaagcctgcctgcactatctgcccaggcagataggtgggcctggggagggtgttgaaatgaatgactctccaagccctggtagagggttgcactgccctggctgaagtgtgggcaccagcagccattaggtaccactctttctgctcaatctccatgggagccatgtttgcaatttgtgtttatctttttgagcagtaaagagatatggtcttctagctattcacagacaggcagacgtggagagtagacacctaaattctaattccggtttttccactgagaggctgtgtgatccagggaaacaagtaaacctctctaggttcctttttcctaattataaaatgaagcagaattaatgatttatttattcattcagggaacagaagcaagatctgctcatgaaacatcaattaaatattgctctatgtagttcccagagtaagatggggatactggcatctacgcaaatattaatatagaaatttgtgcttttcttatgtttgttcattggttcacaatccactcctctgtaatggaacactcttcaggtatagaagacaagtggtcctcaaaccaagcattataatcacctcacaaatacacacacacacacacacacacacacacagacacaaacaaacaagcaggcacacacacacccttacctgggccccaccacaaatcaatcaatgaagtatctcctgggaaaggtcctgggcattggccttttataaagttgtcctgctgattttaggacatgtaggattgagaaccaacgcactagatctgagctggttgaactttaacatgcatgtgcaccatctggagagcttgttaaaacatatactccccatttctgacaagctctcagctgctgcttctggcctggggactgcactttgattaacactgcactgcactgagctgccgggtatatacagataaaaaggacacaatcagcaccaagtagctcacaggctaatgggagaggcagatatgcacacagatcattgttgcaacacattatgctaaaggccacggagattctgctgtaagtatcatggaaaaagtgctgtggggaccaaaaggaagggttgtgcaactgctgaggagtgaccgaaggctgcacagaagaggccatagctaagcctcatcttgtgggatgaattggatgagtttccaccatccaaagggatggtagaaatggggtgtgggaaagttatgctagagctgtgctgtccattatggtagtcatttagtcacagtggttattgagtccttgaaatgtgctgtccaaatcaagctgtgctttaagtataaaatacataccaggtttcaaatatttattatactatgaatgaaaaattgttccttgataatttttatattgatgatatgatgaaatgataatattttgggctaaataaaacatataaatgaacttcacttttctatttacttttaaaacatgattactgaaaaatttaaaaggtcatttgtggctttttcttttaatatatactggatggtgctgctctagactgaaggagccccagagaagcagcacagagcatggctttttcagttgtgtggtgtggcattgacaattctgactttgacgctgactccaacactctggatctaacccaacatcagctggtctcttttcttgtttatatatcggaatctctcctctggcctactcctagtctccctctataggagacagacttcctgaattaaactgaaagcattaaattattattttttgccctggcaaggtttaaacagggcaaagccaaccagtttggttaacaactgtgcgaataatcctatttctgtcatgagattcaggattcaaatggcttttcctcccattcgcttctggaattcatctttctctgaatgtccctgcacatgctttctctctgacacagttactcagtcacagaccgacagacagaaggacacacacaccctccatttaagaggcaattaagtgtcaatagagagagtattaactcgatgacataaaagttggagaactaactgtcatttagaccttggacaaatttcttagccttcctgtgatccctcatctggtgttttacctatttgaaaatactaacaaacataagaagtatttttataatttatttttttcatcagtttactaatgatgatcttgttatagagtaaaattgtcaacaagggagatttcagttcaatgaacaaagcagtaacaacagagagtacccaaagatgacctgacctgggctgctttgtgaagtagtgagctcctctgcatgaaattcccaagtatggtgtcccatggggcactgtgataagtgaacctgaacatgggcaaaacattcgaagcatctagacattctagaaatgtgcagaatcaaaacccatagaacatatgccaccgtcctttgttttcttctcatcatcatcccgcattaagcaatcacggcacttcttctaaggcaagataaagcctaatacttcttaacagaaattccaggcatatgtaagtaatcaaatgagcttggcacacaagtgaaactattagctttgaagactaaactctaggctctagatacatatattattggctctttaaaatattgattaattcaataactttggaattgtgtgaactcagagctctagcagctctttaagacttcagaggccaaaacgaggacaaagtgggggctaaaggcaatgggactgcagactgcttgccttctgttcaaccatagaaggcagagtaaaactcactttatggattgagatataggattgtctttgatagaaggattccataatcaaaaagtcagaacatataagaaattcccacattatattacattccaaaaggtatcaaattgtataacaacttgcccaaggtcacatagacggctagtgacagggagtgacccagtgtgtagattctagtcaaatacctagcccagtttcctttccatgtttaaaatacgtaaaggttagaatcacaggtactggtgtaaaatcacctgggttcaaattctagctccgtcacttcctagagctgtggaacttaggcaaattacttaatcatcctgtgcctcagtttcctctgctataacagggaaatgataataattgtaactccctgggttgttgcaagaatgaaattagttaatgcatatagttcctagaacaccaaacaacacagaatgagcagtcaaaaatgctactgttgtcatcgtcattgtcattgtcatcatgatcttcatatagtcatcctattcagggtcagtttatttagcaggtacagtggaaagagccctgaatgggatggtaggactgctgagatattcagtgtcactttggtttctaaatatctgtaactgccagattgcctcctgtgccatcaaggaggcagataatgctgggattctcctatgggagatgagaagtttcaccaaagctcaaaatccatgaactcagtagaaggaatggaaacttccttttattgtttgttgcctttgtttgtttttagaatcgattatgcttcaagctctgtattaggtatttgcagcaatattacttccttccttgtctttacagataggttagttgcactccccagtcaagaaaaaggatgctgatggaagctaaataactttttagagttaccttgaatctgcttgttttcacttattttcatttgagagttaatgttacataaaataaacagctcacgggtatttctctaagagaaggcctaaagagctgaatttgctttttgttcacaattttaattcactttttcaatttgtgacaatagtatattattacccaaaggaatggaagttgagtaaatcacagaaagttttttctctgagatgacaagaggcttgatgtctaggaagtttgaatgcttagtaattctcaaaggcaaaacataatcacgggacaccatgtaattaaacataacaaaatgtagaggcttttaatgtcattcagttcagtttaaccagcattcactgaagctttataaagtcagcccaggaagagaaaagtggctaagattttatttctgctggtaaagaggtgatccttttggaaaggtatggcagaaccagaactggactttacagtgaaatttgttgatgtagatgaggggcttgtcttgctgaatagagaaaggctgtggctgcctgcctgagtcctgtgcaactttgagcagaaatacagcctcttaggaagaaaagaaggctaagggcgtcagattttctccatctcttctcccacattcaccagttctctaagcatcctaaggcatattcatttgtgaacatcctgtctccatcactggcataggaatcttctgagggcaagaacctgtctgatgttctctgcttcctggaacctcaggatgtgtctgacacctgcagcttctctataccccttgagccaatacaaaaggaatgaatcagtcagtgtaaggcagcccttctcaccatatgagatccttggtcccacgtctgtatggtgagaagacatggatgctggctccatttaaatgatgttacaatgctccctaaagggcctgctagctgtagagctagtttgaaataggggtgcatatttccaaatagcagaataatcttctattcctggtgcagggaacaaagcctttgacttttcgtttttgtaagtggagcagtgaccacaccagctcttagaaatatattaggaagacattttacatttagaaatatattaagcatgaagattatttaggaaatcactctctagtttttacatagggatatccaaatgagatctttctactgtctgttctttctagtttttcatttgaggatatttcaaaggagaggttagaaaatagaagttcaagaataagaattaatcaaagtcaattcattaacatgcaagtatgtcacgtatttcatgagctttgcttacataaaagtccatgtgcatttttaactccctcattcaagaatttcctttcacatagcacaatttcacatccaggttaaactcaagggctacctcctctttgaagttctccttgatttgtccagcccatatactttctttcttgtccgaacatccattgcacttaaggtaaacgatgatttaaattcagaatatgacttcactgtagaacctgtgatatcatggtctttcaattctccacaacaaaataggacatttattataaattgaatctgtaaaagatgctgagagttggattcctttccctttctcttcataataaaaaataactaacatttattgatcttttaaaatgtatccacaatgtgctaaacaattttcatgcataatcttgtttaatcctgatgacagtcctcagaggcacatactaaattgtctgtgcctcaccgctgaaaagccatgctgctacttggccaaggccagtctgcacatagtaagtcccggatttgatctcagcactttctagcttcggagtccttgctttcagaaccactggagtatgctcaagagatctggaccactttcattttatctggtatctggcgttattaaaaaacaaataagaaggccacacttgttggaagcctatttggggattttaaattatgtcataaatacctttgtgaatttcatcatagaatctctataactgtattcagcctcatttggaagtaatgtctagaattctaatttgagacattttgcatatgtgaggtttgaacgaaatgatattccctgctcacccttgacagccacagttcctccacgaccctgagtcacttctgtttgaccgccaggcctgcctgacaatttagtttccccatgcccctacttcggttctctcctggcagagggcactgcggcacttatccaatctctatgttttgaaaaataaaagcattgagacttccaatatttgagtccagctaagacggcaaggccaccaaattttcagtgattttcaaaaactcatttcagtgctgtcttcctgttaaattggacctttcattccatactgagcagtggcaagtagagagcgagccaagaactaggacaagcttggcacaacattatacctgctatgggccaaggtttaggtaggttttgattttgtttctggtggcctcgaatacacttgcttcctttttcaaagtgtccaaatgagagagtgaatagtaaatagccagagggaaatgaaccagtgtgtgggaataagaaggtgtccccctgtgtgtacctttgattaccagtgcaaagggctttctgagacactggctggtaagaaggaagcaggttgccatatcaacacctgtggtttctttacatgtttttactgcaggttttcattgttttagtgctttattctaggagtaaattactaagactgtatggttccaagaatattcctggtgggctagcagcaatgtgctccaaagcacagcctgggctccctgccttcccctctcctctcagccagaagtggaaatccaggccactcttggctttctctgtgaaccaagacaaaaaggaaggggcatacaggctgtccttaaagcatgttggacaagctgttgctacagggtcagggaatgagggtaagaaagcctgtctctttccttataaggaaggtcatgaccaaattgcagagcagaaaggaatataaatcattgaacatgcacacatgtgttcattacagcactattcacaatagcaaaaacatgccatcaacctaaatgcccatctacagtggactggataaataaaatgtagtacatatacaccatggaatatcatgcaaccataaaaaagaatgagatcatgtcctttgcagcaacatggatggagctggaggccattatcctaagcaaactaacactggaacagaaaaacaaataccacatgttctcatttataagtgggagctaaacattgagtacatacagacacaaaaaagggagcaacagacaccagggcttacttttgagggaagaggttgggaggaggatgaaaatagaaaaactatcgtgtgctatgcttattacctgggtgatgaaataatctgtacaccaaatccccacaacatgcaatttgcctatgcacatgtgcatcctggatctaaaatagaagttggaaaggaaaagaaaaaaaacagtggctcctgggtttcatttggagtgttggcctcaaggtgtttggcctgtaccatcttttatatttaaattacctctcaaccttttttttttttttttttttttttttgtgagatggagttttgctctgtcaccaggctggagtaccgtggcgcgatctcggctcagtgcaacctctgactccctggttcaagcaattctcctgcctcagcctcccgagtagctgggattacaggcacatgctaccacacccagctagtattttgcatttgtggtagagatgggatttcaccatgttagccagggtggtctgatctcctgacctcgtgatccacccacctcggcctcccaatagctctcaattataaaaataaggaaatttaacatttaaaaaatagaggcatttagcttttcttagagactcagaatgtcttctttttgcatatgaattctgtgtggaggagcagttcccccttaaaataggcgaatgtttgcatttgagtgtagtctccgctgctcctcagagatccctgacactgagaccttgtgccagccaccatttatcatctacccccgctagttttactctcatacataatttgcatggccccttaagcgtttgagtttattaggatagttataaaggcctgccatgtcatacaaagttattcaggccatatcctaaggcactcagcaatagtggttgttttgaggctgggaggtattagcccaggcttaggctttagagatgcctttggctacttgtttcaagtccatccagtttccaattcatcatccacatggaccctagatgtgaaatgagtgcagaaggaacacagatgacaagaaagtgtcccaggcaaagagcacaggtaatggagggaagagaagaaactctggaaacacttcagaggcagaattgtcaaggattgggaaccaaatgggatgcagaagaaagaaaagtttagaggctggagctactgtgcagatgatgactgttgatggggcgaatggaatcaatactagacctagtcagattatagttaccaaaggaaacagacattgctcaaatttgaacattcaagaaatagttatatacagcatgtaatgaatacatttcccattaaaatatttctttcttaaagtagcatcatgtttctaaattaatatgtgtagtaactagctacatatatgagtaaaccccttcctagacagaggttcttttagaaaggaaaatctctaattcactgcttattcctagtacccaaacaatacccaatatgtagtgtgtgcatgagaaatatttgctgaatccatccataattacttaaacagagatcatttaaagtacccatagtttaatctcaattgttatacatttttttctgtaagtcttttgcttttatttatctgctgcctaccacttccttctctgtagcccctgacacctctgcacacatatgtgcacatacaaggaaacaattgcattagataggcatatgtaataatgcatgtggttttagataataagatttctctacttttaatcttaaagtgatttctactttccattttgatcatttatttttaaatttcattaaatgaataaccttttttaaagcaaatttttttggtggattcttcacagagactcacctgtagtttttccttaattaaagagcaaaaaaaccgaatggattccctttccttggataaccttctagtcataatcagaaagccttttggagccaaagatttcccattcagctacagctggtaccatgcattttttgggttgcttgaggcgagggaggagggttcagctgttgagatctctagaagatttttacaagtaattatgtaagttttgtacatgttatgtaagaagtgaatgcattcttgttgtaaaaataataaaaatgtatctaatgtaaaaagcagaggtctcacttgaattctgtctacttccttgagtccatttctttgcctaaaagtaatcatagctaattttcatatgtatcctttaaacattgttctgtgcagtatggcacaagcctaattggatcatactacacatgatgctaactaatttttgaaagattgcagaacagtgcgttttggagaaattaccatgttgaagcatacgtatccaccgaattcttctaattgcagcatagtactctgtcatatgcatatatcatagtttatttaggtgatcattaattcatgggcattgagcctatttctaattttttactactatgaacaatgccactgtgaatatcgttgcccttgcctctgtggaaatatgagtctttctctagaaaacatctagagaattagaattctctaattagaaaattagagagaacagattctccttgaattagaattgctgatgtaagatatgtacctttaaaattctgatacatatttcaaatttgttcttccaaaaagctataccaaattactctttcagcagtctgatatgagatgaacaatttttccacttctctgcccaaattagatattacgattttttgggaattattataaattctgtggacaaaagcatgaaatctcactgttattttaaattaccttgttgattcccccatgaagtagagttttgtatgctacctggggctccctcatgattttcacttgtatctaagcatcactctaccctcctgtttcagatgctcactacctcacctgcaggatccaggaatgtgccgagacaactagaagtgggccttttgcccgctccattgacatcagttccctggttgtccaggatgaatatatcttcattcaggtgagtacagaaagtgcagttggtggtaggaggatgcatcgttgaagttggctgcctgctaggaaaaggagggtggctttcccaaggttgtgaagatgtggagttgagacactgtccctcctttgcttcagggacccagtcctctggggagagcccagacttctactggttttagtgatgcactgaatccttccattggattgccattttatagcacaggagctgtctgaattggctagtcttgggctgggtttgaagtaacttagtcaaatttctaatgggatttgactttaagtaatttatcaaagccacattctatttctacccaaagtgacttgtataacttggcaatgaaaatcccctgtaaattaagcatctttaggattctttttctggaaatacctactactcactaaactttccccttctttccagtgctgactaccttctcaatgtccatgtcccaaagcgtttactcccagaactgagtcttaggaaaaattagatgggactcatatttaggcagagcagggaagccttcttttacattttcggtcttcttatctctattgtgtactataaggaggtacaaaacaggacaaaaataaggggaacaaaaggtagtgctccaccagatgactgacagaggatgcatgtgataaatcaaacatggtatttgattgcaaccttgatttcccacactctgcctttccatccttctattctcagttgttttgcaaactattcccacaggaaagttgaactttgaaaactccctgagttggctcagacctaagcacctgaatgaccttctctacctgacccctggtagttcagtccagatcaatcccatctcttctaggagactttctatgaacttccaagctcagtgtgactctccatcctctgaacccttgcaactttatggtctataccattcctctagcacacaggctatcaatggatttgtcttctctccaaattgcattttacactctctgagaatggtgatgatattttatacacacagttgacccctctcccttggccctaacaagatgtctttgcatatcaggggtgctcagtcaatatttgttgtattgaactgattgtaggcatcgcagttacttctatctataacttagttacatagatttttgaggtctagtaaaatacaggaaaagtagctagccactcaaaaaccatcttcgatgagggagtgaaacaggaaggttctgtggcttcaaaaatccctgttttttagcttgactgaaatgcagaatctcagaattgtatttctaagtcttggcaggccaacggcactctcattctcttattcgtaagtgtttgtttattgaacacatacattgcaaaatacatagcaccagtcactactctagagttcctcaagtttctgcccttgacctgcttctctacccagtactcgctgcctgagcaatcccctggttttaaggactatttccaaggtttgatgactttcaagtcagtgagctgtgacctcatgtactgcagccttccatatcaaataaccaactcaggatcccaacatagacattccacaagtaaaacagaaccaacaggtcacccttgaccttgacccttacacagtttgtggcacaaccccctaccaggtcagtcaaagtcagtctgtgttgccaaattaaatgaacccacagcctctgttaatatctctctttgtgatttctgtagtgtttccttttattccattctcattgttatggtccccatttaaggcctttatctctttctatttagatttttttttttttttttacagtggaagcacaggagtgagttatgaatttaccagtcggatttcccttcccttaatgctaaatatgctagaattgtttctcggaaacatgacttagaatgtaaaatgttcagacttttttcatttttccttgtgttccataaagtttgctgtaactccgcagacagatacacagatttttttaaaaattattctgaaacattccttttttattatactggaagcagacggaagttttgtctttaattagcatcaatttttattttccttgaaaagatatgcggtttcattattcaataaagttttactcattgccaagtatatgtgaggtcccctgttctaggtgctaggtgctggggttaggatagtgaacacaacaaagtttctgccttagtggcatttaattctagtggaagataggaaaaaatatgtgtatgatgtaaacatccatatatacatagatgaaaagttataaagagtaatggttaagaacatataatttagagtccaaaacctggcatttgttgaaactgtggcattccacacttagctgtgtgaccttgagctgtgcatcatttgacttatctataaaaagaagataattgtagtacctacttcatgggttgctgggtggattatatttattaacgctatctgtaaagcagcaaaacgatgccctagaaacagtgttatatgaatatttgctttctatcttttatctatctacaaaatgtatcagataatgacaagtcctatgaataaaaataaatcagggactgtgaatattgaagctataaaggtattgctgttttatttagggagacttaggaaggcctcattgagtggtgaactaggaacacggtggcagaagatagtgcagtcagagaggagcgtggagccaggttgtcaggccttggcttccttgagcccacatgaagatggggagtgggcagttagagatttgagtctgggttcaggagcgggggttcgtcatggagcagttgcagctgagtgtatccattgtaaagtttatagtatattggtggcatttttagaccacacagaattgccagtcgcagctgagttgatctattgtaaagttgccagtatattggtggcatttcttagaccactaagaaataagtattgatagaaaagagaaaccatccaaagactgagcctcaggctactccaatattcagagttcaatgagatgagcagaaacctgcaatgagacctagatagacaatttagagataaggccggaaaggtggaggtgctagatcccactgggccttgaaggctttatttttactatcaatgatgtgggaaccaatggattaacaatgccccaaataatgtgaaaggccaataaacttgagaaaaacattggatttcattaatcatcaactaaacacagattacatggtatcatttgcaactatcaattagctaagattgaaatatggtaaaagaatgccaatgagttgcaggtagacaactacatacagtgtaggtacaaatataaatcagtggatcatcagcatttaatccacctttttcttctcacaggtgagtttggccatttgcattgacagatatgacatatatgtcttagttttgacagtatattctttgtgtttaattatgattactttaaaactcccattatatggtctgtttgctttcctgtgtgtctgataattttgagtatttgtatttttgttctaagtgcttagctttatgaatagaaatttatataacatactgaatcttctatttctggacaatatctattgatttcctgttggcagcaattacaaaatcagtgtatttccttgaatttctaattttctccctctctttaattcttccactacctaattttgaataattattttctaatgtttgtcttactgccttaaaatataattctgttagacttaaatattttatgaagcactacagaagaaaggtgaaaaaaatagtatgtgtttatgacctcttgtcagattcctttttccaaccccagtttgttgacgtcatcattttagagcatgaacattctactctgcactgtaattcctgcatttattttgattttagtcttataggtaaatgtattcagttgtccccagaagtctttttcctatagtttttcccatttatctcttggttatctgaaatttgtcttccaagaaaggctaattcttgaatgctgaaaatatgtttgtctgtatctttttatattttaatatcatttctcagggtataaaatgtatgtgtcatcctctttccatgagaatttttactccaataatttgttactattcagaccagtctcatatttttcattaaggcatcttgttgttgttttattttgttttttaacttcaatacttaaagcctttaaaaaatattttggccaatatattgttatcaaatatattgatacaatatattatatcaaaataaaaaatattttgataccaattactcattagttagcatatgccttgtggttggccataatgtactgattcttctggaatattaatttttttgttaaatagattgaattttttctttattttttaatttctcgggagtttctgtggcatatcttgaaatatgttttctatttcagttttgtagttttggttcctttcttccaggacatctaggatgtgtacactagacaggaaagacaaaagagagccataatttctcccatcccaacccttttttactccctgagcaaactgaggaaaatgagattaaaaacaatcttacattattttctaggctctttttgctttattgctttttttttctttttcctgtttttgtttaacttcttttctgagctttgccagtttatattgtgtctctttctctcgtatcaacataccttccctgagctcttgtatttctgcttcaaacccttctcttatagaggtgagctcttcatcatacaggttattttaaattatagcagtgtgtttgcaatttttatttgctctatggaagcatattttattccatatctgttatttgtttttcctgtccctttctgtcttttattttcctatattattttatcattattatgctattttcttttatctttatatgtttaactattgcttattttttaatgctgtgagttcttcccagaaaaagtatttgaggaggttcattttagcaacagattagggctctgtttcagcttaacaagaatccttcttggttctcactgaggttctgtatgactcaagattgttttctctgtgagtgggtccttctgataagacagaaccacctggaacacaatatatatgactcctttcccacgtatattgtgtttcagagttagattttcattacggatagagtttgcatttccctttcttatttttcttattgctttagggtgatttataataggaaaagggagaagcatcattatgatttggctatttaaaaccatttataaatccttattatatattttctgaaatgttacaagagcttactaattgattttcttctcccagatcaacaccaaccttccccaccagccagtcacagggctaaatcaatatttctacattcagtggcagctcatcacctatagggtgaaatccaatttccttaccattgtctacaaagacctctgtgacctggatcctacctactccatcagtcacatatgaattccttacccaccactgctcttcacattccttccttgtttcattgtaaccttcaataaacataaacctctttagtctccatgcacaaactgtgccatttcttactgtatatgcctttcttatatatttttttcctgcctgggatgtccctttaccagacaaatttattatttaaatttaggacagacagcacctcctgtaggaagtcttccctgacatcctcagtcgggattggactaagctccaatgcagttcttacccatttgcattatgtttccccagccaggtctctaaaaggaataggactgtgtgttattcgtcattgcttctcttgcttctcctgctcttagcataattactggtactcaataaatgtttgctgaactgaactgaactgagaagataagacaccatcctattctcaggaagtgtagttagttatctttttcaagcaagggaatcttgcttctgcagctaacaatacaggacaacttagcctaattgacaattgctcaatgcgtaagaaatgaccatgcaatgtacaatgtctctgcgtttttataaaactgctgtccaggaattgcccaatatattattcattgtcctttttatattcattcatttaaatgtattaaaatacattcagcccagtgggaaatgcacataactaaacaaatataatgtaatatgatgagagctgtattagtgcaaagcacatgttgctcttggagaaagagcctttcacctgaccctagaagagggtcagtacaggctttctcaaaagaaggctatgagtacgaattaagtaggtgaaggagaaagagcattctgcccagaggagaaggcctgggtaaagttaaggaaataagtgaacacaatgtaccaggacctcttatataaggggcagttgtaattgtgggagggagtggagtggtagaaaaagaagttggaaaattgaactgaacattttctgttttctttaattaaatctagataatgttgtgttcccctctttatagttgctagaaagcacagaactaatttttgtgtgaattttagcagcttccccacataaagcttatggtattgttatttttcatatccctttatgctttgccataggccattttttattccttggctgctttcttatattctttttgtttgtttgtttgttttattttgtgtgtgtattgcttttaaaaaattattagaaaccatctcaaatgattttctgaaaccagtgtcatttaaaaatcttttttggggtggggggtataagttttgaaaattgaaatgatgattaggacgggctttatggagaaggtaagatttgtatcgatagtaatcaatatctgcctgtggcctagaaaagggcgagctttttcattctgttcattgaaataaagttgcctctgcaggttttgtcaaagcagaaaacccacagaccaacagagtagcttttcctactctattggagaagctacacagatgctatatgagcacagtatcagggcatcagaggaggtggttttctacctgttcctgcctaccagtctatcaaagaatggccttggtacaagaagtcatagagcagtgaggcttgagtcccttcaaggtggcattcccagggagtagcgccaaggcagaactggacattgaggattgtgcattccactgacagatgcttactggtttggcttttaaaggggatccgtgtagaggcagattattttttattcctactatttaagcagttaaataacagcaagatgaggacgagagactttggtgggtttggtttttcatgactatagagatttgtctacttaaatttcgaacttttaaaagtattgatgtcttatatttggttttagtgctaacagagacatataactgagaaagaagaaacaacctcacaaacaaaggagaccagcctttcccttcgtcctttcccacccttatgtgccaaatggaggaggacgcctggaaaggctgggctttgggcttcccagcacctcctcaaacggagcaactctgcttttgtttgctctgtatattaggtttcctaatactccttcgtttgacaaaaggatcctgctgctaaaaaatgtttgaaaatcactgactttttgcagccctgttggctgcattggtcaaaggtgaggcttttccatgtgtggacagctgaaccgtgtggaatgcaggtgagatccaggctcaaatcttttctctgcatattaataaatgtgatgcacatatttaatgtgcaattttttacacatgagtgagagattatatacaaatgtacagtatatgcatttgagagtacagtttaaataatgaaaaaccttggtaacctctttataatgatattcattcattaaattaaacctcttcccatgacattaaaaattttaccctctcctggttgcccctataaaggaatgtgcctcatacccaatcataattttatttctcttgacatattatttttaattctgtgtcttatgtgcagtagaagggtccataaaccacccacacagctcctactatttagagagacctggaagttctctacttcaccttttattttcctattgactaggaggtaaaggtagccatcctgatggttttgcttgggggaacccagtgtttgatctcctgctgttggacaagctgagctggagatatacagaaagctgtgaaatttgttaatctgtcagttccttttctgtgtaggggacctggggttttgtagcaaaatcaaaagaagctaatccttcccagaagagcccttgttttaatagggaagagtctgcctgaaatgcctccgttccacttggataaaagagaaatcggctttcctctgtaggggcaggggaaagcagtaagttgatttctgtgttctgagccaagctggttgaaaatcctgtcttttctccttatggagtagcgtttctagtgattatcctggagaatctgtattttagcagcagttgcaataaaattcctttagtaataagattcataccctggctacccttgctactagggaatgtgatgaagaaacaagaacagtcccttagtaacctgtcaccagcaatgtgtatattatgtctgcagtggattgtgtgaaaccctgccctatactctcttcatggcacagagggtggccttcaatgtggtaagagttcatttcataaaagaggtataatactgacaagtcttcaaaaatttaaaacacaagaggaaaaaaaagtccataattaagatacaaataaagtactctagaggtaggaagaaagcagaaaatttggaagagggacggtcatcttgcctctgccaggtctttctccacatccctaatgtctttgttgccttagcacagaatgaaacttttccctcgctgttttaagtgagcctgtagtaccctgtgagatgaggtgctgcaacttgaacattctggaaaagggcatggtttttaggaactgagcacagggaaagggtaggaaccctaaagatacagttggccacttgagcctgggagggtttgtgctgattcaggccaggagaagagagtggcttcctgaacctgtggcacccacaaccactcatgcaaacccagaacagctagctactccctgaacctttgtaaagatgccaagcggacaggtaacactgtgtagatccatctactacccagtggtattttcaactctcagtaatattctatagacctggcgaagaaaaaagaaaccttatgtaacaaggaattctgaggtggagcaataacatgtatcagactgtttctaggatgataccagtactacattgaagtcaattggtagcttggatacatgttgctgttagttttaagagttctatgtataaacatagaaaaatagtactgttataaagtgttgggagatgttccagaagtactagcaattaacaagtattggtagccaattaacagatacttgttgagccctagaagtatgccaggtgcaatggagcattgccctggtctccatcagtttatgattcaaatagctagtggtctgatgtggagaaaacagccctgactttaaagacctgggttgtaatcaggaatctgccacctaccagccaggaaatacgacacaagtcacttaaactctcagagtactaattttctcatctctgtagaatggaatcatgctacttgccctttctaaattggaaggttgttgtgaggatcaagggagataataatggctttgaaatgctttgaacgctacaaagccctacaaaatgcaagaattgagagactaatccacatgcaaaaatcagcctcactgtttagtgtatgcacatcctcttttaaggatttttataagccgatcacataaaagattactagatcttttctccaaattcgtttttaaattattcatagattcaattcatgtatcaacatatgtgcatgataaaagcttcccacatagcttccatggtgttggtttctttgataaccaacttttaatgatatatatgagatgtaactattctgggatttaattaactttcaagactgtttttgcatcttggtctcagctcacctggattttggtacttcatctaagatcctgatttatatacccatcatggaaggtagacaagcctctatgatgtggctactgtatccccagtaaattactatctttctgaaaaaaaccctgaggcagaaattaatagagtgtaattattcaaagaaaagctatttggagatgttttaaatgatgttaatttggtcttaatgggagagattttgaatgttaaataaatagcaattacatcattagggacacatttacaacacgggagtttaaagcaaaatgaaagagttacagagacagtcttcaaaagaaatccaatgaagacatcttcaggtgaatattcttgaagtgctttcagaatcttaagtaaaagtgttttcaacagccagcccaaatggaggttctttaaatagcttggatgcatctcctatatgtgtaatgattatagtggtttgctgttagtatttgaaatacttctatgaataaacacaaattagtgatctgattgcaaagtaatgatatttagttgacctttgtatggagcatactccatctcacatccttccagctatgtttgcctcagctactagctttgcgcagaggtgacctgctatcaccttgcctcacctgcactgtggatcccctgttccagggctgatttattcccaagtaggatgcttgcaagagactcgttacctattctggtgcagatacaagtcttgaaggtgccaaaaatctgggacaacttcagcaacaggaatccaaagctggtggatcagtgctggtgggaatgtaaattagttcagtcattgtgaaaagcagtttggcaatttctcaaagaacttaaaacaggattaccattcgacccagcaatgccattattgggtatatgcccaaaggaaaataaattgttctgttgtaaagacacatgcacacatgtgttcatcacagctttgttcacagtagtaaagacatggaatcaacctaaatgcccatcaatggtagactagattaaaaaaaaatggcacatatacacagtggaatactatgcagccataaaaaagaacaagattatgtcctttgcagcaacatggatggagctggaggccattatcctaagcaaactaacacggaaatagaaaaccatatacctcacgttctcacttgtaagtgggagttaaactttgagtacatatggacacaaagaagggaatggtagaccccgaggcctacttaaaagtggagggtgggaggaggaagaggagcagaaaactatctattaggtactatacttattacctgggtgacaaaataatctgtacaccaaatacccatgacatacaatatgcctatataacaaacctgtgcatgtaccctgaacctaaaataaaagttaaaaaaaaaaacaaaactaatggatcagtactcttctcttatgtcaggtaggcaagtctgagcctcattctacatgaattttcataggctgtctagtgggattgagccctaattgctgacaataataaccagtttagtaatgcaccctggaatggccttctctccctccctgtttcctgcttcctagtttcaccactcctgtccccagatcattcctcaacaaacaaaaacgataaactacataaaagtccttgactcaggctttacttttgggggtaacttaatgcaaggcaatcttgaatgactctcaaatatttcttggatccctgctatgtatccagttattgtaggtagagtgaactatttaagtgaagtagaaggcattgttctcatccccatataaatgagattcctcaatctaaacatccatttccatccctcttctcaaggacctggcactactgatcactctcctttcccctgtctttagcttactcatccctatgttagactttccatcaatatttaaatatttttaaaatatccaccatcctgacataacaaaacaaagtagggtaaaactttctttgaacctacacccctctgtaagtctcccatgtttcattcacaatcaaattttttgagcactagctgtattcataatcccatcttctcatttccctgtctctgtaactcacttgagactgacttctgcctctgccactgcattgaaattgcttttgccaagttcatcaaaggtatctttgaagtatatctagactatgcctctcaataattaacatagttgaattgtctagagaatttgaacctcttgactgctccttctttcttgaagcattctcgttgcttcctcaataaggtacagttcagggtcccctctcatctctccatctttccaatatcatcttactttccaacacagatgcctcttcctctgcccactctttaaatatgggtttttcctcagtgttctttctaggttccttttctctgtttacttcctaccctctctgatatggtttggctgtgtccccagccaaatctcatcttgaattatagttctcataatccccagtgtgtcgtgggagggacccagtgggaggtaattgaattatgggggcggttatccccatgctgttctcgtaaaagtgagtgagctctcatgagatctgatggttttttaaggggctttttccccctttgctcagcacttcttcctgcccccgctgtgaagaaggtgcctttcttccccttctccttctgtcatgattgtaagtttcctgaggccttcccagcccttccaaagtggaattgtgagtcaattaaacctcttttctttataaattatccagtcatgggcagttctttatagcagtgtgagaacagactaatatagtaaattggtactacagagagtggggtgctgctataaagataccccaaaatttggaagttattttggaactgggtaacaggcagaggttggaacagtttggcaggctcagaagaagaaagaagacgtggaaaagttttgagcttcctagagacttgtggaatggctttgaccaaattgctgatagtgatatggacaaggaagtccaggctgaggtggtgtccgatggagatgagaagcttcttgggaactggagtaaaggtcactcttgttatgctttagcaaagagacttgtgggtttttgcccttgccctggagatctgtggaactttgaatttgagagagatgatttagggtatctggtggaaggaacttctaagaggcaaaacgttcaagagaaagcagatcataaaagtctggaaaatatgcagtctgatgatgtgagagaagagaaaagttcattttctgggaagaaattcaagccagctgcataaatttgcataagtaatgagccaaatgttaatcatcaagacaatggggaaaatgtctccagggcacatcagaggtcatcacagaagcccctctcatcacagtcccgaggtctaggaggaaaaattgttttcatgggctgggcctagggtccccctgctgtgtgcagcctggaaacttggtaccccgcatcccagcctctccagccatggctgaaagggaccaatgtacagctcaggctgttgcttcagagggtgcaagtctcaagccttggtggctaacgtgagatgctggctctataggtgcacagaagtcaagaattgaggtttggggatgttcacttagatttcagaggatgttgggaaatgcctggatgtccaggcagagttgtgctgcaggagtgaagccctcatagagaacctctgctaggatagtgaggaagggaaatgtggggtgcgagcctccacatagagtccctactggggcactgcctagtggagcactgagaagagggccaccatcctccagacctcagaatgatagatctaccaacaacttgcactgtgtgcctggaaaagtcacagacactcaatgcctgcctgtgaaaacagttggaacggggccataccctgcaaagccacaggggcagagctacccaaggccatgggagcccacctcctgcatcaacatgatctgcatgtgagacatggagtcaaaggagatcattttggaactttaaggtttaatggctgccctattggatttcggacttgcatggggcctgtggtgcctttgttctggccaatttctcccatttggaatgggtgtatttacccaatgcctatacccccattgtatctaggaagtaactaacttgttttagatgattttacaggcttataggtagaagggacttgccttgtctcagatgagactttggacttggacttctgggttaattctggaatgagctaaaactttggggaacttttggaaaggcattattgtgttttgaaatgtgaggacatgagatttgggaggggccaggggcagaatgatgtggtttgactgtgtcttcatccaaatttcatcttgaattatagtttccataatccgcatgtgttatggtggagacctggtgggaggtaattgaatcatgggggcggttgccctcatactgttcttgtgagagtgagttctcacaagatctgatggttttatagaggcttttcctcctttacttagcacttctccttccagccgccctgtgaagaaggtgctgttcctccccttcaccttctgctgtgattgtaagtttcctgaggcctttccagccatgtagaactgtgagtcaattaaaccccttttctcctttcttaagaagtttaattacccagtcttgggtatttcctcatagcagtgtgagaacagactaatacactttctctttgagtaagtccatcccatccccttttacagtgtcagttactatgcaaatgccaatgaccccaatgttccctgctcctctcagcataatgcagagactgggaggctctagcaaggggtcgttctttacaggatgcccatcaatcccttaagcatggcaatctccttgctccattcagaactctactgtgcatgccccttataaattactaagacttgtttcttcccaagagatctaatgaggctccatggaagttacaatacctgttgcttgctaggtcaatttggcaaagaatattttcctttaatctcagagaacggttctgtaatttgctacatattataaagtaactatttgcctttataataaaatatgaatgggtcatgtctagcacaggagtattaaattgttttcattttatgtatcacccctgagttattggtagtagctccatagaaggctgtgttattgtggtttggtagaaaagcttctattactattagcgtctccatgggcatgagaagtaagggtggtggtaagcgtgctgtgcagttcattttgcaagaagggtggcactcatggtgtttaattattcaggatgcttatatggagggagccagcctgtgagttctggtcaggaaggcagatgtgttatccaggagactacaagagtttctatcatcagctcaaaggagtgagatcagctatacactctcaatctctttcactatttggaaatcaatttcctacctccaaagcaatggttatttggagtgttctttctacctagcttcaccaccaattttactcaccaatcaacaaacagaaagaattgttgttatagtggaaaacggaccttgcaattatttcacatcaaatttatgtccagcatgtgtgcattttattttatttaataaaactttaatcttcacaggatctcaatatgacagatattatctttatttttctatggaggaaaccaagtttcagtgaaatataggtaatcacccatggttgtatagctcaggaaatggcaaggtcaaggatatgacctcagggctgtctgggtttataaaggatgacacaagaggacaatgattgatttctcatttcgtttttctctgcattagcacctaataattggtattcccagatacttttctagatgactgtgaaagtgaaataagcagatgttgcccccatcttggtagatgttagtggctgcaaagacttgctccattccctattcagtggactctttctcaggatctgtttcaattttgtttcatatcagaaactttctgcatcattaaccaaagaaaggcttaatgggattcaatacaatgtattcatgcctgagcctctgagagctgtccctcagatatacttgggggatttactcaaacacccatccctgggacttcccgtggggactgggtggcagcgtggagaatcatcatgacatccacagctctgctcttctccagccctttcctcctccctgtgtacgtcttgccatgcattatgcatttggagtgggaggaggggctgcctttgggttccattccaggactcagaggagctgttgagtcatgacctcactgagtctccccattttccttcccttccacatgccagcaagtcttccacaccccctctgctaagcccagctccctggagaattccttttctgggtccttctcctattaaagataattacactgctgtaaaaacagcagtgctgataatgagggaagttgggctgttgactgaaaagtagatgatttagtccagttctcttcccattaccgctctaattagagtatatctctatgatttcagagtttcagctttaaaaaattttaatcactctgcctataactctatgaccagctaatggagtaaataatcattttgaatttctgcaagcagcctttaataatctgaatcagaatcctttaagaattctgaaaccccctcatggtcagacagaataaggacttcttggagtttcagagcagcagagacagatgttaaccaatcagcttgatgtgattgaggatctactatgtacccagtactgtgactggttctctctgtgacagaggtattgattgactgactgattcattcattcatccattcatttaataatcttgtattgagcacttaatatgctcctgatactgttctaaatgaagggcatgtgatagtcacaagacggagaacgtgtcagtcctcattttgccttgtcttggtgaggagataaagctgtttgaccagacactgttcataaacaatgctcaaaagcatttaagaaattgctagactctccaggacagtgcttcccagcgtgagggagatctacaattaaagaagatatcctggaggaggcaaggatcatggtagttttcatagcagctaatttacttgaggggctcagcttgaggaccattcagtgccccaaggggaagtgactcttggaaggagacagtgcagttggatggatgtgcaggtgaagggagttggcgttcctgggtttaagtctggcctcatcattaactcattgggtgatcttgggccatcacctttcctccctgaagctcagtttccttgtggcaaaatgaaaagattacattaaagaagggcttccaaatcttctgttgttgttcttggagaactgccttccaggcaaaactgttgaagacattccaatatataaaatagatacagttagaagagatctatattaaagagggtgaggggccgtatgagcttcaccacccacccagactcttcatccctttggggacaccccaagtcatctttgcagaacttagaacagcatagaaagtttcaaagcagcggactgtatgacaccagaagttctcttctaaccctaaaactccacaagttgtcttgctctacagatcgctccatttagtcagacataggaaagggattgctgttcagaggtattgcctcagttcatttttccaatgtcagtatcaaacaaaaaagatacttgggatgtacttaattcctcaagcaagttgctgaatctttccttcctttcttcattccatttacatctacttggggtataatatggagataatgcagtaaaaaagaaataaaaatccaaaaagtaaataagaaagttatgttccctggagattatgctatatataagaaataaatatgtaaataagaaaaccacagttcctgccataacagggtttatagtcgagagagggagagatactacataagcaaaccaataaataagaatggtaattacccactatgataaatctatgaagaaataaacataattgtgagagacaataataggagggagggcacttcatttattcacttattctgtcagtctcccaacaaatatttcttgagctactgctatccagaaagcaaggggcctcattttggagattttggagatcaaggcaaacactagtatttttctcctgggagcttgcaatttagatggattttcatcttttatagttattaggaaacaaaaataaaagaatataaaaacataaaagacaattatgtgtgtgagtatataaaatatccctagattttgcttttgagactaggtcctattaagcgatctcatgactggcggatccatgcatactcttccttccccctttctaaactgggagtcagaaggtctggatagaaatcaatccctgcaatttatttttaacttctttctccttagccaggattgatttttgtctttgtgatcaatggcacagagaatagctccacagcccaagctgctgtacaagcacttggtctggtcagctccatgtctattgaaaagaacattataagctgattatgaaagtgatataatgaagatgtttaaaggatgggcccgattacccctactttcctggggtggaatgcttacagacagggggctgctgtgagcaagaacctagaactgtcaggaaggcaatgtggcagggcatacggcctgcacccaacagacagagcctggtgaagcagggaagaaggaagggcattggaattagcttcttgtttgccagcctgactccctttctctctttttagcttttctttttcttccttctactatttcatctttactataccaactgctattagatttggaactgcaagcaaacatctgttacaaaaaaatacattaaaaagatcagcttttccctctctgcatttcttgggctttaaaattgtctgattctttaatctccatgctttcctccttctcttctcttgttttcttataatccagcttgtgtttgatgggaacatgaaattagccacttcccacctctccctctagccttgtaacctctcgaggccaggcaagattgcttcctgtttcttctgagaaaaatgttctcggaagagacgtacaccttgtaataatgtgcaggggtaattccacggaatgcaattagaacagaaagtcggctgtacccaaggccttctgtctgattctctggaataaacgctttcagttttactgcctgcccaggtagcgactgtttctagattgcatcaggaagaaatgatcaaagtgctcttaatatgattgtattcattatttcattgtgctacatagtttcttcttaggtgttctttgtctacggacggggtcaggaaggggtggaagagatggcttccttacttcctctgacatatctgccacaagtacttgtgaagttgattgaatgtagctatcctgtacaagaaacactctcattctcactatagttatttttaaagatttgtcctaaaccttcttccctggtttttacctcctggctaattttctttattattgaataacctgtaattcttagagattcaattacattagtagtaacaactgacacgaattaagtggtcagcatgagctaggcttatgaattagtgaatttaattgttattacagcttatgtggtaagtacaactcttctgtttcacagaagaggcactgaaaggttaagccattttcccaagacgacacagccagtaaacaatggagtggagattttgatgtaaccattttggcaccagagccttctttctctgtcactgcatgattctcctccttaaacaagaaatattcagaacaacctacactttcttatttgctggaggcaagttgggtcaggaactgtgtaagggacaatgagtaagtacatagagctttaacacaaagtagctgcttaaaacatgcatgttgcatcactgaatatccacacacacacacacacacacacacacacaaaacaggcagcttagaatctgaagatactgcttgaagaagaccttcggcttaggaaaccaggaccaaggaagtgagtggttgtggacctcaagcgatgtgacgtttctgagtccctactttgtgtcagcagatgttggacctcacatcgtgagtgtggctgtatgtttcaaggtccagaagcacttaaatgattgtcccaaagacatatcataaccaataggtgagggtgggggttggaatccaagtctaggcttggttgctgtgttccttgttagttttcacaacgaaggacaaaataaataacttaaaagatgcataaaaataaaatttctggtagctcagctataactcttgggcattttcttcaagcaaaacttcattcctgctatgaactgcctctgcaaagataaaccaataaataaaattatactaataagagtattgagcagtgtcatatactttttgttaaatatgtcaaatagaaatgaagtagagtgtttgtgtcatgtaacacacagcaaacaaacaaaagtctacacacactcactatttctttccattcccccaaaactacctctcctggtaccaacaactcaccttggcacttctgccctgcaacctctccggcttgactggtaatcttttcttccttcaagttccctccctaccttttctctctgactctccatttgttatgtagaacaattcagccaggtcctggtttctcaaatcttccaaactcaaatccatcatcacatccagcagataaaatgtccttcagtgtttagaacctactctactcttaaggcagtgggagtataagtcacacttatttatagattacatacaacactgtgggtatgtgcacacatatgtgcatgtgtgtatgaatgtcacattgtggagggtggtctaagagaatcgttatgcctgcagtatctggaatctggcaaacatgagtttaaatttcagttcagccctctgctagctgtgtgactttgctgtcttagttgtcccttacttagttgtccccttgtgtcttagttgtccatctacaaaatggagataggatgagggtggattttattgtaattgtagaaggagcatgagaacacactgagtaaattgttgtgcttctgaggaaaggatttttgtagcatcttatcttcactgtgctgagtaccatggcattattactggccttatattgtcatttgtacatcttgtatgttgtttgctttcccaaagagatggtgaactccatgaggtgacagctccatgacccatggtacttaatacagtctggtcacaaaggtactgaaccagtactcgctgattgacaaatgtaagacatagtggaatggtggccggtatccataatgagatttttaaacatgattaacgttcaaggaatgatctaaatttggccagacccttaattattacgtggattcagcagtgggtggggaagaacatcttgtactctgcttccctgtttcctgcaggaaagcaagctcttttatagcccctgattttcgaaggcatggtgttgtcaaccacgcaaaggagtatttgatgtaaaattactacccatttgtaaaagttcatgcaattgtcttttctttgtattttacttattctgactctggaaacacagattttagaagcctagcaaagtgaaaagagcctggagttgcaagtcagaagctttgagcttggctttaagtcttaccttttagtaccaagatgacctcaagcagccttcctaggcctcaggctccttaattttaaaatgaaggtgtaattagacctcacctgcagggttgtgctcagatcaaatgagattcagtacaataatgaaaactaatagcacagagtactcaacaaatattagttgttatgacctgagtactaggtactaagagactattatagatgagtaagaacattatctaccctcaaagatattacagtacagcaagagaccccaaaaggacctgcttccctctaatttggaacaacagctggtaagtgcaacaagcaagccacaaaaaaagagccctgggaatcagaggaagaaaagatgaactccaactgggaaattggggttaggggagcttagttaaggagaaagcttttgacacgagccactgtgaaattcactgatgctgaagtgatctgggtcaggctaagtccctcaaataacttctcctatactagccattctttggaaaggctctggcgtagacactttaggctcattcagggctgcaccatgtagtggtcattgtcagggtttagagacacaagttcaaatccaggctctgccaccatggagctgaatacccgatgcatgtcagttaaattatcagtaaagcaggtttcttggtatttccttcatggggtcattgtgtgcaagagcaggcagtgcatattacatggtaagcatagagcctggccctccaacaatgttgcttgtgctggcagaggacaggagaggcatgacccggagagcatgatggggaagctccaagaagtagcagttggcatttcacaaatattcatggctcttggggaggcagcagtgttttctgagaaacagcttgacagatggcttaaatccgtctactgttgtcccaaaattcactcatgagacatgcaaatcccatgttggtgaaactttgctgttgtatctagcagctcacgtgtatctccaagccttccagaaatcccatgccccaaagaagcgtccctaattctctagaaaatgaatgattttgtttgccttgccctttcaggatatttaatgtattttgaacatgtcaataaaattaattattctctaagcagctatattcacctgtcattcatcccctgtggctgaagatgtttctgttctatagctgtggccatcattttctgcttctccttctcatattatgtattgcctctagcccttccttctgtgcatagttgaagctacatcggcaaatttcagtgccccacgcaatcattaggatgggaatttatggatcaacagcataatttgtcagtgaatacacttctaaaagcttgtgttcctgggaacataccataggtctattataacaatctaatcattgtgtttgtagagcattttctggttacatgaaagcattttattatgttgtttattcacaagaatcttgtgagagaaagataactacaactagttccttttttatctgaaaataacccccaaactgcaagagatgggttacaatgcctaaaattgcacatctaataaatgatggagctgaaaataaaatcacagatgttacaatgtgaaggaacaggaccttccaccttttcccttctcctctctcaccattttgattttattttctgaagtactgggatactatagaaaagaaagaggctagtacctagtttgagtatatttcatttaaataattgacctcatagtgtccacccataaaaaggaattaggccatttgatgtatcaagttgaatgaaaaacttatacaagtattggacaaccatataagctagatctcttgcaatatcttctttaacctcctctcagctccattttctttctcttttctttctttctttctcttttttttttttttttttttttttttacaaaaccctaccaatccacagtccacaaggaacagaaccatttttgagcacagagagggggcaatgttttgatagcaagtttgaacatttctctttagaggtttcatgggcagtgccttccttttctttcacctgaagctctggcgtccttatctataacactgaaagtattagctcttattacattatttgggagtcttcaaatgctcctgaattttggacactaggatgataatgataattcaagttcgtatctgtccttttgtatttctgcccttatctttgcttttttacccactcaaatacacacacacacacacacacacacacaaataggaaagagaaagtgcaaaggacttccattttgaaagctcaggtgagcatcctaagaacttcttcccctccatctaaatcatgaaagccagaacacaaagataagtctcgaagccattaatggtcaagtctcttggagatctctatctgtggtttcctctaggaattcatcttggctgagggcaaggagaatttctatcctttatccctgatcaactgggatcaggtggcacacatggctaccccagcacctcttgaagcctccaggttgcatacataaactgccaccatagtcagtctccagaagacctctaagatgttagactggtgcaggcatttttgcctccagttctgctggctcagataatatgcattgagtacgtgctatgtgccagatgcaaggctaaagctctttctatattgaattatatttgatcctcatgataacttctcagttgatagtactaatatctgttttccatgagagaaaattaggcaggttaaattacttgtacaaggtcaccaaaccagaaagtggtatgagcgggatttaaacacaggtctgagatcccaaataatgtgctctgttacttactatgcaattggaaactgattgagtccagaccctttattgtatttgaaggaacagtgtcagagggtcaggcatgctaattcttcttctagtcttgtgtgtggtctagacccaaactctttgtcccatgcttcctaacccaccccctttctctgccatactagcattaacaaaaggcagtgaagggtacaagaagttgctcggcagggctgctgaaagtggcagttgtgctgtcagtatttattgaccagtgagtgtgctgacaacctcagcatgcatcttcctttcagcatctcccctacacacacacacccagagcaatattggcttcagtgtcaactatcttattatctcatgtctattcttggtgaaactatttgggggctattatgttagggcaccaataaaagattttatgtgcaaatctgtttcaaaggaggctcagccatagtatgatgttgggtaatagacccagtctttctaggcagataaaactgcatcaatattgcagagcctcaaggacataaaatgagcaaacaccagttagacaaacactaaattcaaagtcaaacagtctaacagaggagatgacatgctgataggatgccatgttgttccaaatgctgtaccacactttttattctgactcatagtgtggtccctaggaaagcagtgttggaaaatcagctcaagatggcagaagcaactaattcatccacgcataagactctagggccagactgacatgtatagcaacttcctgatgaaacttgtagctgtttatagactcctatggtccaatatttggaagcctgttttgttttattttgttcttaagataaatatgatctttgaaggaattatggaagtagagagagaaaagccccaaaaagtcaagatttattataaataatatgaactgaattaatgagcaaaggaattagaaaagtcaattgtgcatcgtaacatcttggctgatccttttgtttctttaaagaggaggaaacactgcagaggcagtgtgagaagtaactaagatgtacccttagaggtggtcatttctcttggcttagacagattattcacataatattcgatacagcacaatcctctaactggaaaagcttccacatgtcatttcttattaatacgacagctctcgtgtaagcccaattatggttcgtattcacaaattcccatagcaacaccaagcacttctgtgcgacaatgtagcattgatttctcagaacttggaaattgataggaaccctcacatagaaacatctgccttggccgtgggtgcattagtctgttcttgcattgttataaatacctgagactggggaatttataaagaaaagaggtttgattcgttcatggttttgcaggctgtatgggaagcatgatgcttggcttctagggagacctcaggaaacttacaattacggcggaaggtaaaggaggagcagacacataatatggccagaggagaagcaagagaagagaggggaggtgctacacacttttaaacaaccagatatcacgagaactcactatcgcacggacagtaccaagggaaatggtactaaaccattcatgagacatctgcccccatgatccaatcacctcccaccaggccccacctccaacattggggattatacttcaatctgatatttgggtgtggacacacatccaaactatatcagtgaacatattttctgggaattggaaatgaagtgacatgggacccattcccctccacatagaggtttggaaatttcacatagcctgagggaccagcaaaacctttaaaagtcagataaacttgggttcaaattccagctccaccatttatttgttgtgtatctttgagtatgttatatgattttcctacacctgtttccccacctgtacataaaatagaaggctaacgtgtacacaggaatggttggcatataataaatgctcaaaaatattattaatatctttaccatgtatggtactggtaatgctattaacaataatgatagtaataataattattgttgtggatattaaataatatcatgaaagtaaagcacccaatatagaatataaactcaaaaatatttgcttctgactctcttctaagattacctatgtctacttataaattctagaaacagtttaagttttctcctgtgacagaaataggctcaacttctaaatccccaacgggagctaggaaatgactcaaggccctttggttctaatttttgggggcagatttctgtctttcctccagggcaagccatcatccagaaacaaggataaatgaaaaaataaaggatctgtcaggttaggcttggtcacagcaagagcgggaacaagtcagaagagatagatgtgtttaatggccaatgcatttgtccaaaggaatcattttcactggccaggagcccaattaaacctgtaaaatggaaatccagaaaatcagattaacgaaccagtcattagtaaggaaaagacccagctaattctgtgtttagcatgacggatgggcccagagcaaataattggatgacattcatcaaatataaaataaaaggtgtcaccgaaaggaaaagtggtaataatctttgggatttacaatgccagcaagtttgctagtaaagaagagaaaagttcatcaaaacagattaatagtcactaaactttatttctttcttgtgtgccagagagccacaggatcacagagaagcagaaaatgcatgcatcagcctgcttttaccctaacattgtgaagcagcaaatgcatcagcctgcttttgtgaggactctgcccctgaagggctgtgcgatctttggaaaataaattcctgcttttgtgaggactctgcccctgaaggggtgtgtgatgtatttgaaaataaattcctttgaccatccaggaaccaggcaggagttgagagttcttcactacatctgtgttttagtcagtatccaatggaggaatccaaactcaaagtctttctgcttaagcagattaattccaacaatctgttattcagtaagtgaataaatattgaccccctgctgtgtacctgcctctatgaggtgtgctcactcctggttaaggtttcaggtacagactagagttggagagcccaggtttataagggttcagatgtaggcgagggttagaaagcccaggtttatattctggctgtaacaatgaaaggctatatgatgttgggcaaattagttgctctctctcagcttcagttttctgacctgtatgaaatattctttacatgatagttattattactcttagttttattaccttacttctgctctcctaagaagatattattttcaaaatatagcaccagactagatgcagtggctcatatctacaattccagcactttgggaggctgaggcagaaggctgcttgagcccaggagtggctttggtcactttgagaccagcctgggcaacagagggagacccagtctctacaaaacataaaaaaataaaattagtcaggtatggtggttttgcctgtagtcccagctacttgggaggctgaggtaggaggattgcttgagctgggcaggtcaaggcttcagtgaaccatgattgtaccactgcactctagcctgggtgacagagtgagaccctgtctcacaaaagaaaatttaaaaatacagcccgagtgtcaaaacagattttccgggaatgcaaggaaacaaaaccatagacatgcatgtcaattacagagatttttaaaaagtttttcacaaaagatgttggaatcaagataatctattgtgttattgcagtgaaataagaaagatggacagaggattcttcttagtcacagaaggaggagcacaggcttagagccaaactttctgaggttcagatctgtcttatcttggacaagtcactcaaaacctctgtagagttgttatgaggattaaattaggtaattttcataaaggctatgtgcagttctggagtgtggtagatgtactcaattaatgactgtcttattatttttattattatgtatccgctggtcatctgccagaagatcagctctctcagtccctttctgcttataaaccatggaaatttatttttcacagttctaaaggctggaaagcccaagattaaggcaccagcatgttagatatctagtgaaggcccggtgtctgcttccaagataatgccttgaatactgagtctttacatggcagaaggatagaagggacaaaaaggaaaaaaaaaaaaaaaagaagcctagctagttttctccagcccttttatgaagcacttttcctttcctgaggaagaagccctcatggcctaatcacctcttgaacggccccaactcttaatactgttgcaatggggattaagtttcaacaggaatttaggagaggacagaaacaatcggcccatagcattccatccatggccccacaaatttatgtccttctcacatgcaaaatatgttcgtttcatcccaatagcttcaaatgtgttaatttgttccagcatcaactttaaaatctaggtccaaagtctcatctgcgtatcatcttaataagatgcgggtgagactcaaggagattcatcctgaggcagattcccctccagctgcaagcctgtgaaatcaaacaagttatgtgcctctgaaatacaatggtgggagaggtatgggacagtcattccaatttcaaaagcaagcaaaaggaaggaaggaatgagtaacaagtctcggtgaagtccaaaacccaacagggtaaacaaccttaaatcttgaggcttaagaataattttcttcactccatgtcccaccttccaggccatggggtgaggattgggtctccaaggctctaggggaccctgcacccatggttttgggtaggtatagcacatgtagtagctgtgacagattagagtccatgcagctgcaccagaatgtggcgatcagagacttgaggtagtactggacagacagccccaacattccatgggagcctggctcctcccttcaaattgttttcccctcaaggccctggcactctgggcctgtgatgagcatggcagcctggaagatctctggtatgccttctgggccattgtttcattgatctggtgagtagcatctggctgccttctagctgtactaattttatcaatggtcccttggccacacccttggtgttctctctcaaacttgcctttttaaactttacatggccaggctgagaattttccaaatctttaagttctgtttccctttcaattgtaagctgcctttaattcatgtctctcttcttgcgttttactataaatggtcaaaaaaagccatgcagcactctccacatttgcattgatagttcttccagatatccttgtacaccgcttacaatttctgccttctacaaatctttagacacaggcacgattaagccaagttttttgccgctttatagcaaggatgacctttcctctaatttccaataccttactcctcatttccatctaagacttcaacagcattacctttaccgtctatatttctacaagtattctgttcatgaccaggtaagtaatttctaaggatacttaagttctttctacagctccccacttcttctgaagaagggtcctcaccagaattgcccttaatgcgctgtttaatgcaatatagggttttttttctagtattcacttcaaaactgttcatacacctattcattacctggttccaaaaccactgtcatatttttaggtatttgttatagcaataccaataccaattcagtaccaatttctgtctcagaccatttctgctactatagcaaaattatttagacgacatagtttatttcttacatctgtagaggctgggaagtccatgacaaagacccctgcaggtttgatgtctgatgagggcttggtctttgtttctaagatggtgccttgaacactgtgtcctcacatggcagaagtgatgaaagggaaaaaagagggttagctaattttctctagccctcttataaagcactgatcccttcatgatggcatagtcctcatgtcccagtcatgtcctcaaggccccacctcttaatactgttgcattgaggagtaattttcaacgttcattttggaagggacacaaacattcaaaccacagaaccagcattgtctaggaatgaagtaggtcacaaccttgtaataaactatagaagaataattataggaatgtgtgtgccatgagagtgaatgttgaaagtgctatagaaatgaaaagaacaaagttcagtaattgagagataggagaaattagaatgaattggtagcattcaaaaacccttccatgaactcataggatttacactgaggtttaatgcatcagttggattttggcaagtacggagaaggacacactcaggacaaagggagattggcaggatgaagcttggtatctctgggagatactacagtatcagaggtacttggagaccccagggctctgtggccttcatatagcccctttatgttttggaccattcgacaatgcatttaaacatttaaagtataatttctatcttcattatttactcaagcacaaactttcctgggttgtgtgtgagcttttaagagagtctgtgattgtgcagggctctaatagacatgggaggatgagttctcaaggctgcggggctgatcacgctgtcaaagggaccactctattctcttttggccgttggtgacttggaaaccccaatgctcccagccttgccctggacttctgataggaggtggagtgtgctatcattttgttccctgttgaggcagctggatcttccaaggagaagccccttttaattgatgatctctggccagcattcaggaatgggacttgccttctcggatgctggtctgctttcccatgaatgtgtttggttcagggtaaggttcagggtgacctatagagaggtggttattaagcatatgataggtgaccagatgatatattttgggagtataaaagctttgtcatcaggtataaggactcctttgggggtgatgaaaatgttttagaactaaatagagggtctggctggatcacacactgtgaatgtactaaaagacaccgaattgtacagtttaaaattattagagtatgtgaatttcacctcaaattaaaaaaaaaaccccacctttctcatcattgtaaacacagaattcaggaacatatctacatctgagaggcagggggtcagggcaggtgaggagcacagaggtctatgcaaattgttgttaaaagtctagttatgaggtgttcaaagtgtggttcccagaccagcagcattggcatcacctggaaatttattagaaaattcttgatccccaactcagatctattgaatcagagactctgcagatgggccttagtaatctgtgttttcacaagctttccaggtgattctgatgcatgctgaagtttaaaaactattgatctagtttctgggttagcaagtatgtttacatgtgttggttttctaattaaatgtaaaaccaaattaaacaaatacatacaatcatgtgagaactaatggtgactatgtgttcagatctaaggatgatattttatgcacttgagacttatttggaaaaggaaaaagacttcagagcaacctattgatcttaatatagcaacacccacctctaagccaacacacaacaatatagattcagaacagatgttgtatcaaaataaaaaagttttaaagtcctgaaatacaaggcaagaatgatggtaattagatgtggatgtttctccctgaagatcagggtgaaaaccagtctctcttcttggttcacagcataagcctttgcaccaagtttttccaagtctctgccttcatgctgactctgacatctgctctacctggcagcgtgtggtgcctgctttgtgggcttccgatctgtgcagagcaaggggtagccgtgggagatgtcatctccctccccgagtgaggagagatgggtggcttcagtagagaagttacagctcttctgctcccagtagggcctgtggatggctgtcagatttggatcagactgggaggactggcctgtctccagcctgtgcttggaccttagtgagaatgaagcatgtgccttgggtaattgcctcctcagcgcagcagcctggttgctattgttgtcctgctattttctctgaacaagccatgttatcttctcctgtgaatattaatttcccctgagttaggataattgggcagagagcagccatctgcagagccgtgccatgttggcagggcttttcagcaggccctggccagaggaccatttcttggcgtggtttccactttcctcccattaagaatctatcctttcacaagtgaggttacagggcttgtccctgagccttctagccagagataacagagttcagactcaaacccaggacttctgaatttcaaatttggagttcttcctctaacttttgatgtttttaagtatcttgtacgtggaaagagtcaataaatatctgctcaatacatggatttgtaaatatgaaggaaagaaatctgtgcttagatcagaagtgagattacatttcaaaataatgagagctttgaacaatagtaattattcagatccaggaaaaatacatttgacaattatgttatggttggaatgaattaataaacaattcaaaaagaataaatagatcatgggtgtagcccacattggtagcttctctgtttttagttgaaaatacttactaggtatgtgccatgtgcagagcacagtgaccaaatagagtcagtctctgttctgagggagaatctgccagtgggaaagattgttgtaattgcccacctgtgatctaagcactgtgcagtgggagcaactcagagtgccatgggattagagacccaaagccagcaaggaatattctctaaaaggtaattacaaacccattgtggttgttgatagaagagctaatactttccaacttgtgcatgatctgtggcctcatctgatctctttgtgtttcccccacaatctaggtaacaactagtggaagagccagctactacgtgtcttatcgaagagaggcctttgctcagataaagctgcctaagtactcgttgccaaaggtactgcatgcaccactagcggtcctgggtccctctaggcaaagggagggttggagaggctgctttgttgggctactgggaggttttatctgtttggaaggactgctggcatttagactcactcaccaccaagtcgtttggcctcccttagtggtgcacaacctggattctgtatttctgtctcagctgggtaccagccaagagctttgatttcctgtaactcaaaggtctggtataaccttgggtcatttcccaggggcagtaatgaaaggaacactagctttggaatctcctctgaggggctctcccttttgcaaagggctttatcaccaaatagaaggccaaactcagcaggaggacagacgcataaaagtgcacagataagtctggtggttttattgcttctttctacattttaaggctaaataaaaatgtattgcctatgtttctactccccctgccaccatgagtaattaaaaaggggtaaattaatagaatgttaatatcaaatgttggcattttaactcttctattgaaaaatcataaaacttactttggggaccccattccttgtgaacattggcttctggagggagatggaccttagaacctcagtgtgaaaatggacaggttataattgcatcacttaatgaggctacaaaggagtaaaatctcaggttggacacatatcaggtgtaatgttgcaaagacttgggtctctaagctggtactaaggaacatattatgaaagactaaatgagtacagaggtggaggaattatggcatgagaaagtggataatttcctacccccagttgttattattcattcattaatttatgcatgcgtgtattcattcactcttttatgcatccgttcaactattctttctccatttaacttttcctctgtgaactaaactctatgagtagagtagtgaataaggcacaaatggtccctgtcttcatggatgttatgttctggaaaaaaaagatactgaataagcaacgataggtatgagagtgttacagaagttcaagggccatcttgacataaaaggtggttttagtcaactatgggtagtgagggcagtttcctagaaaaagtgatgtttaagttgatacaagaaaaataaaggagttaattctgcaaacaaagatggggagaagctgatagaaaatatatgcataggctcgattttaagagacagcaccgttcattcaacaaactaggaagccatcttgagagactgggttgcagagaggctgataaggtcagcagagaccattttaagtagcttcaggggcaatgggaaccaatttctcattttatctaccctctctctgatcagagataagctttatgggaccattgtatagtatggtgtttgcaggatgtacccatcagatattctaaacccaaacaggaaagagatattccagcttggagaaggttagaaaggggaaattcacagttatgctctttctaaaggagaatgccccgttacagtaaccagaaggtctcccatgtttctaagcctaggaaatgagtttagggaactttccaagccatctccctgaggtagggattattttgtttctgtatttgtgcatcttttatgtatttttaaccttctcaggaaaaccaaccattcactcccctggacagtgtggctgcaggtggggacaaatgaggccctgaattgatcacaaccctagaacactctgttaatgattagcaaccccgaggcaatttattgtggtggaatgccatccgcttagtcccttttatagagcctcatccagagcagcttctcattaatatgagggctgctgtgaaaatagctggatggttatcgatcccctttattagccagtgctggcccaagttttcatagtcaaagctgaagaggtggggacagagagggtggagggagattggttctttccattgtttaaaaatgaaaatggcttttaagcaagttttgctgttccatgcagtgccgtggatgcttttaggtggcttgcttagaaacaaaggcatgaaaagctccctatcatcattgccctcgcacctctgctcccagcttacatgctcagaatatgctctcctggggtactccatagctttgtagtgtttggcagagaatgaaatgagtgccattaacaatgaggagcattattagaagccatagccttgtgctgagccctccataactcagtccctgggcatcaggttggtgctcttagtccaacaggcatgaaaagcacacagcagcagagggcatggggcaggtgatagggagcaggtaacctagggaaaagacaggtgagcttatgagcagagaccctgagctttcattccagctctaccacttacttatccatgagcccaggtcttcacatctgtgaaatggggttaatattgtttgacagagttgtgaggatttaatgaatggctcattgttagtcaagtgtaaagtgttcgacaaatctaaggaatggttttggtctgggggtaataatactgaggctcttaacctgtcctacatggagatcagtgttcataatgggatcacattccagactggccttggactcaatattgccttaaaccctcactttaccacgctgagcctgatataccctcttttgtctcttagattctggatttattcttaacttactactctaataaattgtttctacaagagaaaatatttttgtttctttctgtatgggattcaggttgaaagtaaaaatgttgatctttgcctgagccttgtgctcctggaaaagagccaaggttaagaaattctgcacccttttgtgtttgggaaatggcttattgcagaccccctctctccatatgacttgacaagattcagacgtctgtcttgtttacctataagaccagattcccattctttttctcatacgtgatttgctaaaatgttgtcctgctggccaatctggacaaaatgcctgctaatttgacttgctcaaacttaaaaccagcttttctctttcctcaagcccctgaactttgacccactcttgagcttgtgtaaccaatgggagctgaagcaagcatggcaatgaggaacagccccccttaacagcccttctgagaatcagctgaccccaaagaaaatttcctgttcaattgctcgatcatgccacctgcacaccctacttttcacacccagttatttctagtttttttttactttttcccataaaagtcattcttttctgccttcacttcaaggtgcttgcaggtattgcaagtcgtttcaaataaaatctcctcttacctaagtctgggttcattttttatttgacagtagaatatggttaattctgttttgaataataaaagagaggaaagggaaatatgtcttagaaaattcattataatgataataacaatgatattaaccttttgtttccttagtttttacatttccccaaatactgatttatccttcactgctgtgtcacggccacacttctcaaaagagttatctgtaattctaatctcttttcttactccctattctctcttcaacctgctgctgtatattctttgcctgtacatccatctatccactatttcactaaaaatcctagccattgctacagtggccacctgcatgccaaatcaaatagatgcctctacatctttattgcttttcaccattctggaacatttgatactgatgaaaataatccatacttgatactcttccctttggtagtttttttttatgatttgtttttgtggatccccttcttaccactctctaaatgttggtgttcctaagttgttcttgtattctgcatggctcctaggtgacttcatccttcactttttttcaatagtggtgactcctatatctacaaccccagcccatatctctccattgaactctagaccacatatccaactgcctatttgatgtagatcctcttaaagatatcccatttaaccaaggttgtaaactaagcttctagtctgcactttatagttcttatatcccatctttcaactatgtttacttatatactccatttgtttcttcaatagtcttttgttggatgtctaccatgtgccagatactctggtgagtattagagataaagtgatacatcagagaacatagtttatgctctttgggatcttctaatgaaagagacagacatcaaacaaataattacataagagactatttaattataattgtaatgagtgctataaaggaaaagaggagtttcataaatcacgttatctgaggcattatatatttgtcctactcccttctcccgctgtagattttacctccttactatctcaccagtctgtctcctgggaacctcatggagaaccggcttccttggttcaggccctcctgagttattatctgaactgttgctgggaccttttaagcctttctccctgcctctagcattgcccctcttaagtcttctcttcacaatgcttccgcaattaatttgatcatgcaaggatccctatcctctctaactaaatctctgtatatatcaattctaatcatgcctttctcttgcttaaaatcttgtgataattttgtgctattctttgggcaaaacttaggtgtgccatagcaccccttatgatgttacccactgtctgcctcacctccttcagagggaaactgcttttatgcgatacagattcccacacatttccttgactgttccatcctcattgtcacctctaagcatttgtactccagtcaccatttttagcacctctatcatagcacttagtcaaatttgagaaaggccactagagtatgtgatgtctccaccatcagaagacaacttcttgagggcaggttttgctttttctctatttccgttgtctgacacatggcagatgcttaataacatgggtatttatataatgaataaagttacattaggcctagattataagaaaatgtttcaacatcagtgaagtattttcaccattgttcacctaggaagtcacaggttttagttttcaaaagcaatcataactctcccaaattattgtcttggcagggcagacatggaatgttatttataattgctttccaaatataaatatgtatgtgattatgtctgatgcttttcaagttccaagtttagtaaagtcccagtctaaatttactcttattgcattttccctccttggatttctctctttaacaccaaagatttccctgcatgttctcaggaccaacaagtaaggcaatgacatatgctatggagctaaactgaggtaactcagtttaagaaataagcttcattattgttcaggtctctattggaccaattttagctaattatgcttttctttttcttgaagactgaatgttctagttattattggttgaccccattcaaccataaagacctatttagacaaaggttatatatttcagagtgtttcaaaaagtgattccctggacttagatgcaccagaatcatctggagggcttgttcagatggaagaatctaagggtctactccagacatactgaattataatttcaggcggtggtcaggattagaggcagccaggtttgctgtatgtgcattttaggttaatgttcttagcacaagtctgcatgctattaagattgataggtcattttgatgcacaccaaagttatatccccactgatacagtgtttagaagttagcttcttggttaagattaggtttaaattaagataaaattgtaggtttatatcttagtaatgttatttattagctttggcaaattaaggaattatcaaacagatatctcagaatcctggataccagagagcaatcttactccagagcctggagcacttgttcaccaggtgacacagccccgggaaagcattaacctaatatgcactcacagcaaacctggctgcctctaatcctgaccatgccctggtgttttaagttgttcttttcccatttcttttacattagtttagtctaaaataacttagctcattcatttttatgaccaaaacatctgggaaaaaccaggcatttctgttgcattttaacagggtaagtgaatttaattcgtatttcctgcagctgtgatttcccctcctactgggttcttcggcattcattccacaccaacacaacacgacttcatcacacggtttttaagagtaagctttttttcccattttcaagcagctcagcaggaacctgtaattctacaaggtgtgtaagcacaaatgagcaagtgaggtcttagtcaaggtgacccagacagttcaaggccagaggctgagatttgacaaagaatcttcaataaaaagatccagaacttgcttttctacttctctcatctccaggttgtccaaatcaaatgggtttactcctttataaatcatcttggaggagctctctgtggtgctgacattacagacattgctgtttctttttacttgaaacggtttctaggaaaggttggtcaaacacagtaaaggctagaccctgcctgattattaagttacagtcaactccactcccccatcatccttttaccagtgctttccatcacagcaacacggttgcctttccttctgctatctattactctttggcatatacaccagtatgtttatgcagtttttaactccttccattttttggcaaatgattatccatgtcctcctgactgtgtaagttctctaggtaagggcttaaatttgtgataatctttgtacagtgcctacctacacaggcaaatgggcttctataaattacttggcattgtaaactactaggtgtgattttagaaatgatccagacagagcaagaccctgtctttaaatttttttttaattaaaaaaataaaaatgatccagtccgggattaaaactaaagtgatgtcaggacccaggaagttaacatcagtatgtaagtggcggaccgtaagaacatatggatatagagggctgagaccctaacttggggtcctgactccatctgaaagaccagagactctggtttttggtacagaatatggccaagctaaacatttgtgattcatatttacttcatgagtcatcagtttgaaatctctaatctagaggtgatatatccagtgactggaaaccatccattatgttggagtcagaccacagaggtttaaaagctggttctgccatttgatagccatataatctgaaacagattgataaacttctgtgtgcctgagtttgctcttcagtaaaatgggaataatcataccacctccctcacaaaattattttcatttttaattgaaaaaatacatttagatggcttagaatagtccccaaagaaatccaacctcttcactaggtgagaaaattgaagttcagagaaactgacacattcagcatcatgcagcttactcacagcagtgcttgtattttgacccagaacattaaattccaggttgagtatccttttctctatatcagtgatcttcaacataatttcattggcagcagaacctcccttaccttttgctcctaaaatattacacagaattccactgtatacaacagatgcaaatattttctgctctgattgaaacaggattgcaggtctagagccccactcattggttatacctccatgccacatttctggcaatcctcatgactctgaagattttaaagaaaactgtgtaaaccaccatactacagaatttaaaaacataaatgaatatctaatgacaagataggctctgtcttcattgcatgtgtgagcttcctttagcaagggtgtctgtctctgttggcactaactcttaaattttaggtataacaataaaaaatgaaagtagatgaatccttgaaagccatgggaaatgatatcaaccaaagcccctaacacccattttgctgtcacttagcaaggaacagaaatcatgaagcttataatttatagccttggttcaacatggaattgtttaacattgcctataactcaagctttttctcagcaatttcataagtcatagtaattacttggcatcccaatgggcagagagatatggagatctgctgccttacaagccttccatcttctttcaggacatgcacatcatcagtacagacgagaaccaagtatttgctgcggtccaagaatggaaccagaacgacacgtacaacctctacatctcagacacgcgtgggatttacttcactctggccatggagaacatcaagagcagcagaggtctaatggggaacatcattattgaattgtatgaggtatgtagccaaaattctccttcccttgggtctgtctctctttttcctgagttttaatggtataaacacaagcactggagttctgggttcagattccagctgtaccacttagcaattgtatgactttgggcaagggacttctatatgcctcaattctagtaaaatagagataaaatatttaccaaggagattattgtgagatgagagatgatggatatactgcatctagtgtagtggctgactcaacaaagttagtattcttgtatgtataaacaattgattactagacagaaattaaggtatttggcctaggtgattttttaagtagctttgtaaactctgtgttgcttttgtggaccctgaatggagggagtggtgctacttatgtgccttaaattatttggaaagtcctgttttatgaacaaattttatgggaaaataaaagcgaatatcagtggtgggaatgagagtttttctaagattccaccagatgccgacatctatgcagggtaaaaaactggccttgacataagtgtgtcacttatattaagcttgttaaaaagtgtgataactaattaaagaataatttactaagaaaccaagtgactccatgtagtaactgtagagagaaagagagaaaaaaagaaactattttcagtgacctaaaagatgtggtaccttttatagtgacagtatgtgacctttgacagtcctggacccagtgaaggaacttgactgaccacctggatatggaggattgagttgagcaatgaaggtgtgtctcattatccaatattcaccagtaaccagtggccacacccatacagactgtgatggttgagatcattcacagaaagagatacgttgtctattctgggtggtggcctcagagctgggtgagctgttcccttgtgggttttcctattgaggagtgggagtggctacatgcatgggtttctactttatagtggtctcctctaagcagtgcctgtcaaaatcccagcagccctaaattggtatctaagttggctactcagttactgagtgataaggtttggttctgtgtccctacccaaatcccatctggaattgtagtccccacgtgttgagggagggacctagtgggaggtgattggatcataggggtagttttcacatactgttctcatgatagtgagtgagttctcacaagagctgatggttttaaagtgtggaacttcctcacttcctctctctctcctgccactatgtaagacataccttgcttcccatttgctttccactgtgattgtaagtttcctgagactttcccagccatgcggaactgtgagtcaatcaaacctcttttcttcatgaatcacccagtctcatagtatctttgtagcagtgtgagaatggactaatacactgagagtggcagaaatatttaagattgcacctgttctgttaggcagagagatgataacataaaggcatggggcaaatgaatgtacattttaaaagaaggagtgaatgtcattcggtagaaaacaaaatcgtagaaataccctgatttcctagagagtaactgacaagtgctgaaataattcccttaaacaacaaggtcccagttttggaaatgttccagattgttttacagaggtgtggagactagtagagatgactaaggggagtaaatacctttgggaagcttacatttctatgcctctaatcataccaggaggcagaaatataactttgttattggacaataagtcacatcttgtttgagggtttggattaatgttcccaggactgaggccattccaagttcctgtttgtacaagtaaagccatagagataagactgtgattcatgtccctgtgatcagacccaaataggggtgggtgggcattgctgcagatgaccttgcagtcaagaaattcttgtgtctctgatcctcttggtacagtgggtgagtttgccactatgcttctcttattctaagaaggggtgcctgaaactccttggtcatttacaacagtgtgacacagtgatatggaatgaggcatgaatcaaaatgaagaatgtgcccagatccatgcaatttttttctttccacttaagttggtcttgtgttttcagtcttattgaagaaaaaaatgcatggtgtcactgcatctatagagaagacataacagacagggcaactttaaaaataaaacagctttcttgatcttgttttccattcaattttagcaggattgatcgcacccctgctttgtgttcaagcccatgaggaaggcaggagagttatgacttagtttttaccttcagagagtttgcaatctagtttgttgggttttgagggggtcaataaacaaagttccttatttacctggtcaatgctggaaccgattaggacagcaacaaagggcaagacaaatggatatcaaacacagctttattgcttttaaaaattatgcacaaggaagtgggattgataatgctgtaccccagaattgaattcatccattcagtcccagacagaaatgataaatcaaagactgtcttatggaagcctgttcctatgacaccgcagcactgatgtaaaaaggatgtgatctgtgcaggcagatccttaaaagaggggcaggggtatggggatgagctgtacatgcgcagttcttcttttcaacgttaccactctgactgtcagtccttttgccctggggaggaaatagtgaagaagaaggaggcattccaaacgtaggaatggaatgagccaaggactgaatggatggtgctgatttgtgagaaagtaagctagccaggctaattgtgtggaataaatgcttgtcagggacaagaatgagggctggataaatagctgaatttcagattctagaaaacatgtaataccaagtgaataaattggaacctgatgttatctagaccatgaccatactgaagatttttagagggtaatgctgttttgcacctggagatacattctgtggtttggagataaagctcaatttaattggtctctaggggtcattagaatttaaccttctttactggaaattctcacagaaactgtgattatgtaccatacggccagttagcaaagagactacaacttttctggactccaagtgcccttgagtaatgcaactgagaaaaacagtaagttttcacattcaattcagctaaattagcacacttttatggagtgtattttgtttgatgatgttaggactggtgcatgagattcataattactggaatgatacaagtgactctattagggtaattatcacagtctaacttgtattagaggtgtgattccaccaggttgtggagttacaaaagaataattctaacttgagtaatttggagagacttatagatgagtttggcttaattatagacaaattgttggaaataagaagagaaccagagtcgaatgagtagggatcctattttatgaaatgttgagtggccttgtggagcagtggggatgaagattgtaaatatactggtaaaaagctgactgaagattcaggcatttatgctatgggctagtatttctttatcttttttcccctcatatttacatacccagaaaatattcgcacgtgtgatgtagtcccttgtgccaggttaatttgtaactttatattagaataggacattacacctgtttccccttgactcaaaggttcagagatgtctttaggtaattttcagatatcaggtagcttgggctgaccttgcccacttaagccacaggtatatcactccatcttctgcatggacctctgaagcttcttcttggtaatggagaggagacaaagaaagcaagaacttatttggaaattccccttgcaagccttggcactgaaaaatccttggaccaatggagatcaaccccactgaactccccaaaatctaacaaggctgagataatttccatttcaaatctgttggagttgtctcctgctgtagagagattctcctgcttgttctttctcaaattcctgcttcaaagtacaatgttgtcatgactataattacataattaggggagaaaataacacttgaaggccaagtaataatctatctcttctttgagatgtcaagccgactccttcaaaacaaggctggtattgacagcgaatgtagcctattgtgtgtacttaccattattctcgtaacactcttttcatatagagctctattgcagtgtcttcacatccccagctataaactacatttctttttaattactctccctaataaatcaagaaacaaatattctttccaacacccgcagttatactatggcagcattctctgagctgccggtgtgatacattttcttcaatgctctcctggatattttgcatctaacttataactccttacaataataaccacagcatacctggcaatgctttagaccagcactgtcaaatacatacataaggtgagctacatacacacttccacatttctgcttcccacattttataaagtaaaaaacaaacagacaaaattaattttaataatattttttatttaaacaaagtatctaaaatgtcatttcagtatacgttcaatgtaaacaattatttagttattttatatttttccatactaattttcataataagtctgcaaaatcctggatgtattttacatgtcccatgaatctcaatttatatgctaaattttcaccagaaatacttgatcggtatttaacatttcataaatttacagtaaaaaaagaagattcacatacccaagttattctcaacaaacttaaaagtttgccaataactgaaatgggtatcagttcttcaattcaaatttctatgggttaaaatgaaataaaattaaaaattagtttcttcgttcccgtagccacatttcaagccatatgtggccagtggctactgttttggattgcacagtcgtaaacaacttatatatttttttcttatttatctctcacaatatcacattcttcattgtgcctgtgagattacagagatgcagagaatttagtggcttggctctgatcacacagctagtggtgctacattttcaagaaatccacgtctgcttgacaaaccacttaggcttttctcactattaatttttttttgcatttttatggaggtataatttatgtatagtaaaatttacccttttagtataagttctgtgagttttgatttgtgcattctggtgtgtaaattgtgcacaaatcacaatcaagacatagaacagttccattaccccaaatattcccttattgcccttttgtagtccacccttctctaccccaaagtcaccgacaaacacatacctgccctctctttgtctttagttttgcctttcctagagggtgagtaaatggaattatacagtaggtaaccttttcagtctgacttttttttgcttagaataatgcatttgagattcacccacattgttgaatatattggttccttctgtttctgagcagcattctgttgtgtgatgtgacagaggttgtttttcaatcaccagctgaagaccatttaggttactttttaaaattttgtgtgattatgaataaaatatctataaacattctcttgaccataaatttttatttctcatgggtaaatacttaggagtaggattgctgagttgaatgtaagtatatgtttataagaagccaccaaattattccaaaagtggctgtgggattttgcatttccaccagcaaggtatgagagtagcagttgcttcatatcttcagcaacacttgcttggtttgacagagagagaggagagagagagagagtgtgtgtgtatgtgtgtgtgtgtgtgtgtgtgtgtgtgtttgtagctgttccgatggggatttagtggtaactcatcgcaggtgtgatttgcttttcttcagtgactaaataactggacccagtatacctggatggataaaatgaaacttcgaggctgggcgcggtggctcacacctgtaatcccagcactttgggagacccaggcgggcgaatcatgaggtcaggattttgagaccagcctggccaacatggtgaaaccccatctctactaaaaatacaaaaaaataactgggcatagtgacagtcacctataatcccagccactcaggaggctgaggcaggagaattgcctgaacccaggaggcagaggttgcaatgagctgagatggtgccactgcactctagcccaggtgactgagtgagactccatctgaaaaaaaaaaaaaaaaaaagaaacttcccatccagcctcagtattctggtctctttgcccatcttattgatgtttccttgcctttcctctccctagagcctgtcatcttccctctgctttatcaggaccttcagtgacctttatcgggccagaaggacagctgcttagagactccacagggtcttttttccctgaaccaaccttcctcagcccctcaccacaggtgggactctagggacagcccaaggcagatcatggtaattgcttttctcagcagagccctggcttctttgtcctgaggtctctgggaggtgaccaacagatgaccatgccacctggactcagcattccgccaaggggcctgctgtcagtttccctctgcactcaaattgattcccagagggaaagtgggccacacaggctagacaccttgtattgttctcttccgtgggcaccatcacaagctgttacccttctccctggactgctgaaataatcagcagcagccaaacatctgatttcaaacaacagtgggtggaagtatgtttaaagttaattcaatgctttgtagctccttggatgaggatgagtaaaaacgcatgtctcattctccaattcctttacattgcatttagtgagggtgcgtagtcttcataatacttttgtcttagaaatatatgtgtacatacatgtgtacacatacatgcatatatgggtatgagtctactgggttgcaacataaatgtatttcttacttgggttgcagtcaaaaagtgtgaaagctgttggcttaggacacacaaaagccaagtgccttccaaactcgcagtccatttatacaagacatgaagccaaaaaagtgattcagtaataatgtaagggctttgaactatccaaacacaagtgggaaatgttccgtttgtttcagacgggaaggagattgctgcggcattatgtacaactgcaggagaagcatcctcacagctgcaagtgggttccctgggagtctgtcctttctacatctttttagtccccattcccctggttttgttctcagaatatgtgggacacacagaaaatgcccgtccaaatggtgaagtgctcagtcggaaaacatggtaatggtaatggtaatgattctttaatttgttaacctgctcacctggaagatcacaagaggttgctgagtggctggaattctttctgtgatgcattgagctgggggcatcagagggggccacagccgctccccaggaaaaactgaaccggggtcaaggtgtctgagtctgatccaaatattttcatccaagaagtggatagcaaggccctgggtacttgtgggagagggtaactggtttaggggagtgagtcctctggaatcattaggtggtggtctagcagaaaaggcaccagctctgtggctaaacagaacactgaaaggcctccatcaggtagaaggttctagagaatcccagattccattctctgtgaggaatgattagtagtcaggtttaggagatgcacctttgcagttggttttaaagactgaggtgatctgaggggctcatagtccctagatgagcatttgagatgctgtccttcctgaaatggccctgactttaagccattagggcaaagaggaggtctctagggagggcatggctcagacatcatgcccctgccctaccttggtttctctgcttacctacccactgttccaggtagcaatctaatcaattccattgttggccctttgtcaaattcccctggtggtgtccttccagttaattctattctcctcctgagattctctgtccatttgtttgtttgtttattcttatttgggctggcattctctttcaagaccaatcaggttacttaaaaaaagaagagaagactttttatttcgtcaattaaattatgtcatttgaaaacaaaaaaataagctcacttctgtgaaactcttaccattttctcccactggggcattctctccgaagtgagtaaacctcagttaaccatgatactggaagaatgggggataaatacaattaaaactttaagatatctgagtatcacccacaaaacctgccattgaacctattgtttatatatatttaaactaatttaattgcctttggcaatatgctatttgctatttgcctttgaaacatgctataacttctatggaaaaagagttaagggaatctttctttgatgcaggatgttgtcattataagtatctgctttccttgcccagcatatagaatataaggaataaaagtttgagtagaatttgtgcttaccctagaacccttctgggtgataaatctcctttaatcctctagcggcttgttttgtggtgatgctcttttcccgtcaaaatatcaaaggcgtgcaaatctcaaaacatgggaacactggtgagtgctttgcatagtctcatggatcctttgccagccaactgggaaaaagaagaggaatagggcttattccaccaatttcaaagcgaccattggctgagtcccacagatgatatgggagttatccaaagtcacatagtgagctagtggcatggaaagagacagatgccaggcctccaagctggatcatctgccccaggatatcttcattactactaatcacaatgcctcaacttccattgttatgaaatacccatctacaggcctcttctgagcagaaaaacatgtttgctggaaggggtaactccttcagttcttgtcagccactcccatctcagagggaatgttaatagttaattaaaggtaaagtcctatggaacaaagtacagagacgagcaaactgggaaaaaaacagatgggtaagcatagaaagggacatctagggggtgacataaggttcagagatgaactttttaaacatttttcagagaccacatggcattcaacgtttcctatcatgttccttcttttcttgcttggaaccccaacatgccgtgggaaattctgcggcttctctaagggcttctccaagaccaaaggcatgttggcccagcatggttctccatctctcaccttttttcctaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctggtcagtcactcagcctcatgggaagttcacagggcaggctggccacctgcagaagctgtgtcgagggctttgtttcgtcaaagggtcttaggaactcaggtggtgcagagcagtaattttctaaaacttgcagggcattggtgtgtggactcagagtgcagcaccaattgggtgaaaggcccagttgaattatgcaggcatttaatgaggatctactatgtgctccatctcatagtaaggcaaataaacatataagagaaggagcctgtactcaagggtcccaggcacagctcagtagtagtaatacatctattaactgatactaacatgatgcattgtgttttggtaaatgcttgctagatgttgaggcaagcaaaagttgctttgagaatccagggggagcttaggctggaatgtccatatgggacagttaatctatcagcatttccaggattcctgttgtatgggatattggggtaggcaccatggaagacatgatgtgtgagatggtatctctggctccaggtgcttctgctctgtgtgaggaggcaagaggcttcattaacaataaaatccacaatcttcagtgccctctgaataaggactgctgtaagaaacaattctaaggtcccagaaatggttatgtttcttctgagcaaaaagtttcctcttgccacttattcagaaagatttattaaccacttatcttattctagaccctatgttaaaaattgggactacaatggtaaatacagcaaatagcgctctttccctttgtaattttcagccttattccatataatttttgcttcaggtactaggagggtcagagagaaatgcctgcttacctctaggaattggtcacagcatgcattttttttttcctcaaaccttgcccatggcttcatcttattttaatctgattttctctttctttctatttcttcatcttcttatttgtatttgttgtacagaatatgtctctgtaaatccccaagcccttttaagaacactccaatggggatagatgaataaataaatgaataaatagagaacacagacttatataggttttagatgatggcttcaaatattttaagtaaaattataagtaagaacaaaatatataaaacagagacagagacaatctggctgaagaaggtggagggcctggcctagttcacatagcttccactcttcactcctcccagagggcccttacaactccaagaagcagaattgatggtcaagatcagaaatgcgagaatgttagtgtcatcctggtagaaggaatggtcaaggaggcttcataaagccagccatgaactggaacttggataggttgggtgaggaagagagggaaaggcacgagattgtggttggggggcagaggcaggagggggtttatggaaggtactcagtggagcttctaatgtgagcataccagctatctcaggtgcggatatctcctgcccaaaactgtgtgactcaccatccaatgccttgctatttctgggagctgaacatcgggaagcccatctctagtggggcaggggtacaggtgtctggaatttcctagaatgaaactatttctttctccattttagcccttctgttccttacatctgcacctgcaactctctgaaaatccatattcctcaggaagaatctctagcaaggagacagccccaggacttgtggtggctacaggtaagaaaaacattccctgtgcttcttccttactgagagtgtctagaataaatttgtcacctctttttggatcatggactcacttgagcatcagatgaaagctgtgagcactcgccccagaaaatatgcagggttcctcaatacccatctaagaacctaacatgcaaagagctccagacatttgtaattcctaggctcatgcatcttccccccagacacagagcagtcccctgtgcttaggaagaggccagagtttctctcaaagtaaactgaccaatcagaatggttgtttgtaatagggaatccacactttaagaaaacatgatatatgaacttcctagctcaccagatgtaagttggggtagttttctctttgaacagatgattctttacaaagggttccatcccagagctgtttttaatcaggtgcatgtaaaggcttgtttacacatggttaaccccttggctgagagcctgagggcaaagggcagaaaaacttaaggttgcattgttggaatcactgtccactgagcatcagtcagagatgaagataaagcaactctgagatgaaagctaaagtctccggggagtatgctctgattagcatgcactgcatttccatacaccttttcaagaatacattgatggcataaaggaaggcagcctgctaatcttagaagttagagctccggtgttggtcagcttatttttctaatgaaagcagataaattcacagtgactttcggagctggtacattctgttttctctcatcaacccaaagctctggtccctggagttcctactctctaggcatggcttccttctccaagcctccaactgtgtgagcttttagataccaccagtgatgaaccactctcatcagattgacagctggcatagccttctggcatgttagtcaactcctgtcaaccccagatggttgacaccacagtggtattaagcaagcccactatgcttaataccactggcttcagggagcccaggctgaggagagatgaaggcaggctcagttgctgttcccctagctggagaagtgatcctcacactctgcaatccatgtggattggtttttccaactcaagggctgcgggaccctatgcctctcctcaagacctacaggaggtctgaactggaagctacatcaaaaagtagggatgaatgataaaagttaatattatctgaatatttagtgtgtagccaggcattgttctttgtgggttgaccactctgaacttcagtgttttcattggcaaagtgggcataatagtaccaaaataatagaattgcaggatataatgaaacaatgaatttaaaatgcttagaacaatggccaggcgcagtggttcatgcctgtaattccagcatgttgggaggccgaggcaggtggatcacctgaggtcaggagtttgagaccagcctggacaacatggtgaaaccccgtctctaccaaaaatacaaaaattaaccaggtgtggtggtgcatgcctgtagtcccacctactagggaggctgaggcagtagtattgcttgaacccaggaggcagaggttgcagtgagccaaggtggtgccactgcactccagcctgggtgacacagtgagactctggctcaataaataataaataaatgaataaaatgcttagaacagtgcctggggcatattgaatactcactatgtgttacttatcatcattaatgttatagaagttaaaactcttcttacatcagaagaatataatgtgctcatctccttcaataaatccataaatccgatgcatgcactatgcacacagagaaactcaggaaacttgtcctcctgctttccaggctgagccctgacacttattaggtttgtgcatttggcttagtttttaaactctgagcttcatttttctcatctgtaaaactgtgggggtgttgtaaaaattagagatggaagtatgtgtctataagacccagcagagtgcacagagcatcataaggtagtattaatggtagttgttattacctgtgaccagcatattgcttctaaattagtactttgtaaattagcaaacacacagacattaaagatttatttttgaatttttttgtcccatatgtatcagaattgctaatttctttttatctccccttgtaattcttgaggctttttgccatgccctggatctttgggagggatataactcagctgatgagatcctgatgaaaagccagggctaagtcactggcgcgtgcctcttcatacccagcttctccttaccctgcttgccctggacaccttgggaggttatttgccatcaggaagataactatgacgtcagccaattatgccttcagtggcctgcatggagcctgcccctgcagggtcctttcccatatccatgccttccacctgcccttcaggtgtcagtcaccctgggctctctccactcccactgctgactcccttttcccactttgcactgagatgtggtctcagggaagctgcgtggataaaagtataccctgggattcatctcttaactcctggttgaggacatctccgaaggcagatggaaatctagtatagagagtttggcaattgccttttgcaagcagaaacactagggttcctaatatccttaacactgtggtttcaagctagtaataaagacctcacatccttgcagtgccttacagcatccaaagcttgcttttcttgccttgattgcataactgcacgatgatgtagaaatggcaattactatactcctcaatttagagatgaagagactgtgggcaggtggaaacaggtgtcatgtcccagcccacaatctctctgattccacctctagtactctgttctgtagcccttcagccagacccgtctctgagcccctttccgtgccagctccacagctaaccagaccccctgccaaacttcctgtaaactctgaatgttcacaccctcctattgttctttctgtggaggccctcctcccgcccctgcccctgcaggggcaagttgcttgtatactgtcagcttcctccccaactgagcctgtagccaccctgtatgggcagcaactccctctggcatgagtggtggtgagagaagcgtagctagccctcagaggacttcaatattctctcccttttattttatttttttaatatttaaggagcagagaaggatagcactgggaggaaatgagggtgaaagcaagttgtttaaaacttccaaaaagggcaatgggccctccatcatttaccagcaaagctgttggtgagaaaagatcccagttcttcttctccatctcactctccctcctctctcatcataccactcaagtgggcaacagctgcatccccttcttccaacatggttggcagccactctagctgagctccaattccacttcagccagcaaggctcatttttcaaatcctccttctctgacaccataactccggctcttcctatcagaaatcacccacagagccacctaaggactgtacatgttcaaagatcaactcctcctgggtacatcttttctgtcccttcatctgggaaccaactttctggtctctgtgatccgtaacattttctttcagaggtctcttcaattgacagaagatatttccacaaatagagttcactgtgagccttgggttcttaccaccataaggcccccaaaatccatctagtcgagctttgaaagagaggctaaagatgttgacagaaccagcttctaaggaaggtgagggatgataagctagatccttagaagccatgccagggatggaagatacacagctctggagcaacagtgctcctgcctccctctttctctgtcacccttggtagacatctgttgatcaccaccacattctattctgtcaaaaccaaagaatccttcttaacacaatgctccaggttagcacaaccactaagcgactcgagttgatattctcctccccatttccctttactttccttacctgtgtcttctaaaacctgtatctggggagttgaattccaaattccagacagaactccatggatctactcaccaagcctctccctactcctcccacacctactgcctgaaccctgagccctgagcccaggggttatttttgaaatcttgagtctcaaaacaagttggctatctgtgtgcttcctgatgctgatggaagcttgacaagctgtagcctggctttaatttctcatcttgaagcattaaatgtcaggagctcaattaacattttcattattgcatttttgttgtgctcctatttaggctacagatgtgtgggagctaacattctcttcctgctatttttaaagaaaaaatatcagccagtaagataaactcttacatgtttagggttccttcctggttgtcagaacttcctcaagtgcacatcaacattggaacatgatccaatcatttgttttcccattcattcattccacaattatttattgagcactattaggttgggggcctcttttaggctgtgagaagagggctgctcattgggaaaacgaaatcaatatagatggactagaaaagcttgaccactttctttttaataagcatagccacaaggtgatggagtgccaggggaagaaaaagaagggcagagaggagagtgtgaagggatggaagcagcaagtatggttggtctaggcataagccaggtgacttgttttgctgccatgcttgatggccatggtatgctgagtgtggtcatcttcttctgggcaccgtataatttaggttacataatctgtaccattgggtcactcaactgcctggcactcaaaggacattctgacaagtttcaaacatacacacagacacacagttacgcacatacacacacacacacacacacacacacacacacacacaccagtttttctcaggctcctatgccagatttctccatatgtgtctactcttccactctttgcttccttcaggggacacctgtcaggagcaatgtgagagattattggtatacagactgaataattcaagagacctggactaatcgatattgtctttgactcatgacattgaatgatgcatttctgtcatactatttagattttttcccatattgggtttttcatcctgctgggcttttgatatgacaccagaaaagaaactgcacaaattagctgtaaatatcacttagaaaacctttactctctgctcccccatccctcagccctaagcacacttaattggtaaactcctgacaatctcaaatgatctgcttatgtttcaggcaacattggcccggagctctcatatactgatattggtgtgttcatctcctccgatgggggcaacacatggagacaggtaactgggtgaattgacaaaaagggaggaggcatttagagtaagttctaccaatctctctctccatcctatagattctcagcctcattatgactttgtaatttcaaaacatttgaagcagctgttcagtttggtcaatttggctggcaggttagaggggtaatggggtataatgagaagggcattgggcagggaataggaggaactggaattttcccagttcacttattctttccttcagccatatgtatgtaacaggtccagatgctaagtactgtgctggttgctggggatacaactgatgaaactgtttttatcattagtgtgccaagagttcttggcaagctggtctcttcacctttggggatgtgtttctgtatctacaaaatgcaaggattggaacattaaaactgacaaagccatggaagtcagtggttgtttaagtattgtatagactgtcttgagtaagtatgaaacagcttatatgcttatatatgagtaagtatgaaacagatatatgactgcatgaaatgttaattcagttttacaaacacttacagcaatgctgtccaatagaatgttcagcgatgatggaaaagttctgtatctgtgcttgtccatgcagctatggagcacttgaaatatgactactgtgtcagaggaacttaacttttaattttatttattttaattaatttaaatttaaatactctcttatggctactatattggacaaatagacttatacagtgtcaactaggtgtcaggctccaggaggtaattgaatactttggagtccctttccttaaaaagctcaaaattaaataggagaaatgggttcgtagctagataactataattcagggtgataataatattttagtggcattattagcatacaaagaaaagagacgaattgatcctgctggagaaaccaggaaagacatcacaaggaggggaggcattttactaagtcttaaaagtgagacagtttctccgtggagaagacaagagaaagacaatgaatatcttgttagacaagttcctgtttggatcccttagtgaagattgtcatcaccaccatcatcatcatccccattgcctccagtgtcagcactaccagcgttgtaaaaattaacaagtacttacgagacaaaagcaactatgtcaagtactgcaaggcacacagtcaataataagttaaggttcctacccacaaggccataatcaggtggctggggagcagatacataaataagatcatacccttcaaaatgtaaaataacctattacgagagccaaaggagggtggaagctggaatacaaactcatctggtaaaaaaaatctcctcataggcaaaccatttctggagatctctctacctcaagaagtagctcacttgaccaacgttgtcactactttttctttcctcctttcataaacagctaaggaatccactttttcactccagtactagacagggcaaaaatgagcagtggccagatggtaaaattaagaggaaaggataaggataacttctccctcctccccagtgcctcttcctatgttcctcattcttagggttcaacccagcatctccattatgtggcttatcacagaaccatcctttaagctctggagagaaaagcctaacattgcagactcagagtctatgtttatatctggaatataagtgaatcacccttaggtcctttgtgcattggggctcatcattaatagggacatttttcttttctttgaagataaatatgtaaaaaaagaggtttaggactgagaaactacttttctctctaaggttccctggggcatatatataggaggccccattcctcttacacattcaccccttaaatctgactgtatcgtctccttatcctcttctagccctcttcacttaacccaccatcccaacttctccatctaggctgcatgaaccaccatcagtggttaagtgctgtaggaattctccaagcatactttcccctagaagatctacagtcgagattagttctctgctggagaaatagttttcctgtttaaggttggagatataaaagtcatatctggtataagcattgatatatgtgggcttaggtctgaaattctcttaactcggaaccttgtattgaagtcagtgcttagaaaatgcctatgggtagatggagggatggatggttggatggaatactgaataagggaatgaatgagtgaatggatggataagtaacagacaaatagatgaaataaagaatgaataacgttaggtccctggaagtactgtgtttcaatgaccacttagagtagggattcatagacacccaacatgggtcttcatccaacttgcagggaggtggtggctatttcaattattagttttaccatagtgggtaggaaattgtcttttaagttcctagataatgtataaacaacactataaaacacagactattgacaaattagcaaacatctgaatagatgaggaagaagagaaggctgagtagtaacttaattagctggaaagatagggaagtttcttcaaagtcatacttccgttgggttacctagttgagcatgcaccttgttgcttcaccttcatgtagcatgctggttcacagtactagtagtggaaagagccctggaaatgcaatttgagtggcctagggacagttatttgttttctgtgagcccatttcctcatcaatcaaatggagataatacttgcaaaaactatctgatagtgctgttggaaggctcagaacctagatgaaacaatatatgtgaaagactgtaaactgttaagcactatgcaaatgtaaggtgttgctatgattgttgttgttgttgttgttgttccagatctttgatgaagagtacaatgtctggttcctagactggggtggtgccctcgtggccatgaaacacacacctctgccagtcaggcatttgtggtaaggagagctccctaccctattaatgagctaatgagcagctttttagtggagaggattgtgatgagttattctgcatggttttgtacccatttgtacatttcctcatccatttatttatccatccatccatttaatagcctttacatcatctaactcataagcagcaatagtaggccagataattcagatggggaggtgtaatgaatggggtgggtggtaatgagtggtcagataaggcagaagacagcaggaaggacctgcagttcaagtagccaagatcagtaatccaaaataggagagatggaaattggaagaggagggttaggtacatgtaacagatactgagttcagttctagagaagttgagttagtggtttctatgaatatttcagcagaaatggccatgagttgtcagatatattcatctgaagttcgggaatggtctaggctgacactttagctttgaagtcattaaccactaggtggtagttaaagctatggtagtgggctcaatgcctcaagagagtgggtacaaggagaaaccagggactcctatggactctgctgaaaaccaatattcagatggcaggaagaaattatgggacggactaaagagaaatggccaaaatatagaaactaaggggaaatattttcatgaatgctgaagaaaggggtgattaatagcatcaaattctacaatcagatcaagtcagttatggaataaaaaacaacctaggattaagcaataaaggaggtttttcatgatttttgtcagagtagaattgaaacagaggtggggatgaaagttagactataatagatttataaacgaatgagctactgaatggatgataagcaatgaaatgaaatagagacagtatagattattcctttcaaagagtaagattatgaaatggagctgacagtgtatatgcaagaccttccacaaggacagagttgaatgagaatagatgatgatgatgatgacgacgatgacaacgatgacgacaacttgttgctgttgttgttttgtgtttttggaagggaatggatgagtctcatttgtatttatgccctgaagggaaagaatttcacgcttcagattcagcaaagtgaatatttggaagagtgaatatttgtgggtggagaatatcctatctagagtacagttggtcggattcacatgggcagcaaggtggaccctagcctaactaccaggtcttagatattgggagataaacaagtttagagtaagaattttactggaaagcatcggactgtaatcaggaaaggcttagaattccctaatgccaaatccaagcttcagtccttttggcaaggacttaagaaggattctctcaatttgaccattttaagtgaaaccgtatgaaatcgccatttttaggtcaaaaatgatcaaatattaccagtttcttaaagcttaacctagcttatagtgaaatagttctaccactatgatatggagagattgtgcatataaatgttgaaaagatgcatggagccatttgtaagaggagcgctctcccacctcaaggatgagcttgtaaaagttcccagtgtaattgtttcttatccttttactactgatttatatagttttttggtagtatccaaagactagaattgcttgatattaatgatagtcagtatttattaagggactttccaggcactgttctaaaccatttacatgaattatctcatttaatgcttgcccaacctatgtatgtaggtacctttttatcacccacttataatggcatcaaaaagcaaacatgttaaatacctttctcaaggctagacatgtatacctggcagcaccaagttcgatttctgtcatggatgctcttctgttctggctgctaattttctatatactataacaagtacacctaggcttatgacatagtccctgccctccaggagactatactcaagataaggtgtttaggcagtacatgtgtgactagaagtgaaagcaatgtctgctaaaggatgccagctgtgtgtattgctggaatactgaagcctggtgtgtaaggagcctggcatccttctctcaaagttcagccctcatgtcatctcctgcagcaggtgatgtgagggctgacctttgagagagggatactaggatttacaggagaggtgagaggcaagccagggaaagaagaaactttgaccgaagtccagaattcaagtaatgtagggagtgttcagggtactatttgattgagaccaaaaatgtaaatagaggtgggtaggactcagacgaacttacatgccagtttaagggattaaagttggtctggtaggtaattttttctgctaacaaaacccatctgcctctgtagaggaaagagctatctctattgtggactgagtaggacttgcactctcagagaagacagcttgagtcttaaaacaagcttgtttttaaaccaagcaaggcaatgtttcttagctcccatcatgttaaaaacttccatctaaatcttcataagagagttgataaatgtcctacagacagacttagctggcctggtttcttccctataagtcctggagaagaggctagcaaccgacccttaaacttggccatcactctccttgattgtggtagggacctagcatgcacttaatcattgattcttaaaagcattctgcagaagtttccttgtgctgaggaaagaaagagtttatttttgtcatttccttttggtggtagaagagaagagcatatttgacatggcaagagtacatggaagagagtgttggttttgtcaaatattggcatccttacatctaaccgtccagtctgatccacaaaagtttatctccaaagactgcctcacttccaaacggagtacttgtctgattatgcctggaaggaaaccatccaagttgggaaaattactcaatattcatttagggatatttatgtaggaccaaatcatgactctcaaagtcatcactactaagtttgagttttcccttgttcaatgtaatatatctcttttcttggtaaaaatgtttatagagttcagaaaaaaaaaagaactgcactgccactgaatttcctcttataataacaatgataatatcaccctccatttgtttggctgttctaacttacaaagtattaagaatgatttttcaaactaagcttttgaaatggcattatcccatttataggatgttgatactgccatttgtcataaatgctacaaatgttttcttgaacatgacagagaccatgatttttgcttacttgcctttctatgaatgccattctctaaagcaatccctcgaaggggttaaatgccagctgttgagtatatgtgttagaaaacaacagcaacaacaaccaactcatttgggaattatcctttgcactcctctttcaaaggctaagtgagtgttttgtaagggcttgacaatgttattatcatcaatgttttcttatgaaattgttgactgatcttgtctcctgcttgtgagatacaagcttctgaaacttaagccagctttttcttcactaggagcttctaattaagtgacaaccctcaaggtaaacaaagctcattttaagaggaagataggttaggtaatcagttcattgccattttctgtcatagatctcagactgacattgttttatatacagatgtatgtatattaatatttgaataggaaaaagacaccagattacccactgggatgtagtggctctcagatttaaataatagctacatcacctttaagagaaaataagagtaataattgaaaagctggggaaactttagctaggctaactaggcatgttgtttcctacaaattgaaatgataggtagccagataggcgtgaacgcaaaacagcatacaaatgaatccatctgtttgtgaccatgtacttttggatgcattgagattagaactaagtgctatttcagggaaaccctccatctcctttgtacctgagaagcattagagtgagataaacaatgggcccccactgaatagagagatctgatgaaaactcacaatcggcagagcacctaatgggcaggtagacgagggtgtgactgtttgcttagccctgacaagctgtcagtgtctctcaatgggatgttcttggaaacagaaaggaaaacatcacctggccttttgtgtttctttggttgtttgtgctagcattttgttcagagaaactttcaaatgaaaacaatagttccaaacaatacatgtctctgaaaagcaaaagtgcatgtactgttctgaagaacttccaggtggctaaaatgctaccacctcatgtactggggataaaatgaaatggagcaatacaccttaccagagggaggaacattgattctcaatgaccactgtagctctctatttctgtgctagagacttctgaggaggattctgattgttattggcagattctattccttttagtttatgtcatgttagtatcatagtcatagacacctgaagtaggaaaaggtcttatagaagtcctttaaactagtattatacctggtgtagctgatagttttgtgacacccccaaaaagttacctcactttaccagaatatcacagtgctaattgacctgcaaatgcccaccttacgtagttcccatcttgtataatggctttagttgttagaaagattgtttttcatgctgagcaatagtaaatctacttgtaatctctgtgcattgacctgtaatctgccactcagatctatgcagaataagcctgctacagagttacgtatgatttttagaaaagtacagctgggaaggacctcaatgtatttcttagaaataccttaggctagaaaagcctttttaagttctgggaaatgacatgatatgcaactcaagacagattttattcatttgttcatttattgcatacatatttgttgagcatatgttatttatctagcgttagaataggggttgggatacactgttgaatggtagtgtgtacttgggaacttatattcttatccacaaatatttgactgttctctttagaagggtcacatggaaatctttattctatctgtatgttattcccttattctatctgtatgttaaataattaatagttccacctatctaactacattctgtctaatttccttcactgacattatccctttctggtagtcgataaatagccctttaaaatatttggaaactttctcatttacaaaaattaagatgcaatggtaattaattcagtttttcttcttctttttccctaagctgcctaaaattcatataacctgtttctagaaccatttgctttttacctttaattactcttattgtcagtttttctacacttattaaaattgaacatagtatttaggattgggtagaaggatgatttcttttcttatgcttgtaatatatctgtgagcacatcctacactcacggtggcttgattacctctcatgatagtggcattgccagaaaatatttaacttgtagttgacaaatgactccagtttctttccagctttatatattttattagctaatttcatttctctagtggtaggtcttggtgtttttgttttttttgtattaagtattctgctttaagttgtttctgtcttataaatgacttccaaatttacatccctaattatgatgagaaatctagatccatccatcaaaaggtcttcttaacaatattacagtatggaagtccaaaaagcatcaatcttgacatggaccaaaacagaaacaaacagatgttaaacaaaaattagctgggtgtggtggtaagcgcctgtagtcccagcttctcaggaggctgaggcaggataatcgcttgaacccaggaggcagagattgcagtgagccgagatcgactcactgtactccagcctggcaacagagcgagactctgtctcaaaaacacaaaaaaacaacaacaaaaaaagaaagaaaccaaaaaaactgcttcttctgttcttctaatttccccctcaattgtttaacactcccccaaatcaatattttccatgacttctttcttttgctcatgcaacctctatatattttgttaccaaattcattgacttcatctctaaaaataacctaaatatttccattttttttccactattaataatcttcatccaagccccatcttggtgtggtctcttaaattaccacccctccccaactcatttccttgaatccactttgggtgttgacaatccgtttatcacagagaagtgaaacttgtcttttaaagcttaaatcaaattatattatttcaactgaaaataaggtccttcatgatttgacttctgccttattttcttctactaattctttcaactaatcccttttcacactaagctacagccactgaccatctttctgttcttctcacagggcagctttttcatattagacctttcctctgtaatggttttctcctgaatctttacatggatacttccacttatcatttagatttcagtgtaaatgtcacctacatagaaagggctttcttaaatttttagtagaaagtagctgtttggtgactatcaaatcaccttattttagttgtttccatgatatttatttctaactcatagttttgcatttatttatttccaaattgttcatctcctcacactagaaagtaagttccgtggaagctaggacctttccttttctgttcatttctgtatccctagaactgaggtcactgccagatcaggcacatagtagtaggcatcagtaacattttgataaattcattttatttgactttgattctgtagtcctatgttgccactatttggagatcaattggaattttacttctgtctccctgagtattggcaatcctactgatttcagtttccctgtggagctattaaggaattcacagttcctttgtcttggccattaatgagctactgacctgaggaggagaaggtacatcccttggggataccattcaatatagaattcaatatacaatatatcacctcaggatatttgaaaacttctagtcatcaaaataataataataataataataagtttcacaaatggcagcctatccagacccaaatattttataactaagagattaagttttctaatgttattttttttggagtttctttagggagttttattcttcataactgcctcagtgtgagaataaagtgttagaaatcgctggtctcagatcgccctagctctagagtcctgcccacttgcttgtgcttacttatgtcatctttgggcttcagttattgtctatgctaccttttctacctggacgttgttgtttatcatccttcctttaggtatctgccgatccgctctttcctctagcaggcattttgctccttccgtgtgaactcatttcatgtagcaggaccttgatcatctacaatttctctccccatctggacttagctttgccttggaggtcgtatctcaatactggaaggctgcgatggtctctccgtgtcggctctctgtgtgtcttctcttcattgtataaactaaagatggctgtcctgtgctctgctcattatggcagtgatgtgaagacgactccttccctgcaatgctcatggcactcactgcaatttgctctgctaatgctgaccttttttattcatttatttgttttgagatggagtttcactcttgttgcccaggctggagtgcaatggcacaatctcggctcgctgcaacctctgcctcccagattcaagcgattctcctgcctcagcctcccaagtagctgggattacaggcatgcgccatcatgcttggctaattttttttttttttttttttgtatttagtagagacagggcttcaccgtgttagtcaggctggtctcaaactcctgacttcggtgatctacctgcctcagcctcctaaagtgctgggattacaggccactgcacctggctcatgctaaccttttattgataaggaaatcctgagaatgagacagagagaggccttaaattcactttggctttcatctgccaagacaaaaaccaatttacccaaagtcgccaaaacaaaccaaacaaaaaacccaactaatactttcttaccttccggacttattggccagagttgacttgttagtagccacgacacactctgaaacaactatgattattttaggaactgacggactacatggtaagaaaagtaaagttcatttccaattatacatgttttcacttttgaaatgagaaacctgtttctttgacaagcaatttagatatgcccaactttcttggggctagtttaaatgattatttagccttcaatatatttttttaaaaggctgaaataatcaagtccttaaaattcaagacagatgatgataatttagaaactcatgaagatgtttatggcagactgtctgcatttcattcgtgaacatggatcaaggtataccataaatgcaaaaattgtctgagagactggttactttagctgggttaagagattgactttattattgtttttaatctgtacattaggacagagaggataaaatagaataaaatagagagagacagagagatagaaagacaaagaagtaagtgagtagagagtgaaccatgtaggctggctgctaatggggtggtaattcacacccaacttatgagtgccagtataagtcatgcttgagaaatgattggatggatttaaagagggcccgtcattattccttattatttcattcatgtattcatttaacatgtatatagtatcaactatatgccaggttttctgttaaatactaagaatagaagaattaacggtatggtgtttgacctaaaaaaaatactcccaggttaggctgggcatggtggctcacacctgtaatcccagcactttgggagtccgagtgggaggattgcttgcagccaggaggttgagaccagcctgggcaataaagcaacaccccacctctacaaaaataattaaaaaaaaaaaaattagccaggtccagtggtacacacctgtagttctagctatttgggaggctgaggcgggataatcacttgagctgaagagttcaaggctgcaatgagctatgatcacgccgatgcactccagcctgagcaacagagtgagacccttgtctctttaaaaaaacaaaaaacatggccaggcacggtggctcatgcctataatcccagcattttgggaggcctaggtgggtgggttacgaggccagaagatcgagaccatcctgtctaacacagtgaaaccctttctctacaaagaatacaaaaaaatagccatgcttggtgacacgtgcctgtagtcccagctactcaggaggctgaggcaggagaatcacttgaacctgggaggcggaggttgcagtgagccgagatcgtgtcactgcactccagcctggcaacggagtgagactccgtctcaaacaaacaaacaaacaaaaacccttcacagtgtggtgggagaatcagacatcttatttaccattatatatattatatatataaatattatgtgcatatattaggatttatgtgtgtgtgtgtgtatacacacacacatactgtgcggagcattgtaagagagatatatttgtgttatatttgttattaaggggtttttcaatgataagacatacatgatctctgaactcgcagagtttataatcttgagttgagatattcaagatcagttaaggagtcagtagtcagcactatgataggagaaggcctgggtattataggaacatacagaagggaattttaatcctaaattatggaaatagagtagaattaagaatcagccagaacaaaaatgaacctatgatagaggatcctatgatagaggatgaagaaactaaggctgtcttgggaaagaagggatgctgagaaaagcttctcagaggagatggtccttgggctatgccccctggttaaatcaaggggcagaaaggtccttgataatatcaagaaaggaaaggaaacaagcactcagaattggtcaagtctcttccactagttacatctctttaaagcattgcaggttctgtttccacaaggggccagaccttcctcttacctttggatgaaagatgaggcagtgttgctcagaacatctcagactctcagtggtcatccctaaaagccccttaaagtggcactggggagggaaaatggtcctaacatctgttttgaacaaatagaaaattgctgtttgtaaggtttgatctgaaagacaaaccccctccctttccattgggtccaccagccttactcagtttgtgtcagaacctccaagggctgaatggattgtgctgtaaattgaacctcaggttccattctgagtacttgaaacgtgacattccatccactaagccctcctgcttgggctgtttgtcgattctaatgtgttgaaatatatctgcaactctaggtgctgtctccgcccaagtccagaaatgcagttttgatcaaatctcataataatatggggagatgttgaagattaaaacctattgataatccacactgccagaaagcaagatacagaggaaaatttaataacctgaaaaacggttacagaagagtgtggctttattttcagctgtcttttttgtgtacttgtttccaacacagggtgagttttgatgagggccactcttgggacaagtatggtttcacttcggttcctctctttgttgacggggctctggtggaggcaggaatggagacccacatcatgacgtgagtacttcttttgctgtgacaggaagaagaccagagacactggttctactttcattgaggccttggatttttcccagggaaccctacaccaaagtggtccaatctctgggccaaaatttcctcatctataaaatggaaatacttatttttatacctacaaactcaaaaagctactgccaggattagggaggctagggtcctaattgaacagtcaaggtttctaatagaatttaaagaattatagcaaattcccatttatttaaaacccaagcaaacagaaaacttatgtcgttagatggtttttttctctttccaaaacagtctagtgggagataaggagcaggggcagggatggagggagtaaaacagtcaacttattgaaatcagaaatattgtaagagatgtctctttctctctctcatagacacacacacacacaaacacacacagacacacactccacagttattttgcttcagattatttcactgtaaatttttttctatactcttttataatgagatttaatcttagaagttgatcacctgtgtttatgtgtgcacatgtgtacatggtgagtgggtaaccgtaatcctccaccaaccaatactgtcccccacctcccctactcccatttggctggagaaccttacacctcagctcttcactggacagagtggagtcttgttgggcaaaattaagggatatttgctacagtgtggagttggcacagaagggctcacagcgtgcatctgtgctggttcggtggaagggtgtatgatcttcctacgcttagggacactgctcttgttttaacttttgtacacatagatttctttatagtttgaattagtctttttccaatggtgatggacttggaagaaaggccaatctaggagccaataagtgatcagttataaaaaaattctttgtaactgtatttatgcagttttgatcaaatcttatagtttggccccattctcgtctatgaggcctatttgaactcattgcatcttcttttgggcattactttgaacaacatcatgtgtatgccaatctctacatgacctggtattccctagcaagtttaaggccacagcttaagttctgtgttcatctaatcttaaatggtaataatttttttctcagcttcagatggagtttagctggtcacatggatatgagggagattgacctcagagccaaaccatttactgaaaagatgagatagcactcctgttttcctttcctcctggccaagactccctaagagcttgacagagcttctgtgcctgttttattttcttatcaagatacttagagaatagagcataatcattttcttataggggatctttttatgaaattaagatggatcttggaagtattcatcaaaatgaatataaacaattcaagttacctgttttcacattttgttaaattcagagtttcttttgtatgaaaacaacacagattttgtcaggactcttcagatagctggacaagccctggaagggttgccaagaggtgatttctatctctattctaaatttgaaaatggtattgaaaccaactggcctactagggttgcccagttgtggaatggcaatggcaaagattgaaataggagttttaaaatattatgtatttctgtaggaactgtgaagacagggagtccatttggggacaagaatgcttagctttgccgttgaattgaaaacttattaataaagtaggtcattcaaatactgtgtatccttccccttactgttaaccctgattctctctttagctctgtgtggtcagggagaaaaaacagccactctaaggttctgttgctttctcttatccattgatttggagaatttatatatttaacagttagagagcttctaatatatatcagaccttgttagaacttaggagattttataaaggcaaatgaaattatttgtctgcaaggagctctcagacttaagtggtgagagtaagtggggataaagtaatcatcatggtaccctagttatacagccaggagatagcagaggaaaacgaagaattcacacacacagtaggtgacaactgagttggtctggaagttttcatagcagttcacaagtggaaaaccatataatagagaatgaaatgtaagttccaagaaagcatagatttttaacagttttattcactaatataaactcagtgctgaaagcaaggattggcatgttgtaggaagtcagtaatcgttgaatgaatgaatgattccaaggcaaaggaaagaacacaaacaaaggtaagaaccatgaaagagggtggctgggtgttaagggagtaagactatgaaagattttaggtcacatttaggaatttgacctgtatccagagtgatatttttgaaattaaaaaatctgatcaaatcaccagttttcttaaaacccatggagccctttccattgcctttaggatagagtctaaactcatagaatggcctacaagtatctatattgaccacctgcttggggctttttctccaacctccctgacctgaccacccttttctgatgcactggtgccttcctgcccccaggttctttgtatctgccagaatgggcctgccttccctacttaaacaactaaatttctaagtatctttctgatctcagtttaaatatcagttctcatagcctgccagatcaggatgggttcccacgctctatgttatctggccttatttattttttccttcacagcactttagataataaatgttaatacaaagggtattagttgttgaatatctttcccctccatcttcatctacccttaagacagacatgtggatgcacacacatgtgcacacgtgcacagacatccctgcatgtgactttaagttcccatgagggaggatctttgtgtatcttgttctttcagtgccatatatttaccaggcttgtgctaacatggaggatttaacagtatatatgtactggataaatgaattattaaatggaagaatcaagtgacttctaaaaatcttacctttgttgtgattgttgtgatttttctggcccatggctctagcatgttaggaaattgattatagatctctagagattctgaaatgctatggtcagaatgcagtaggtgcaaatcatgggggctggggttggataggaatcagagcagactgcatatgtgtgtagaggtgtctatatggaggttatgatacattggggtggaatggcatgtgggcacaaaagggcagctagagaatgaggagcttactgggaatgattctgatttcctccacctttcacaataatctgcccaatttccacttttcctggaggccagtgctccaggaacatggacatttctaacaccgtagctttgcaggaggatttacatgggagacagtccccagagtggaggcctgggacttggctacctttattgctctttttactactgtcttttcagatgttattatttaaacatccccctggtaactgtaatgggaaccatctagtctagccaaattcaaaatgaaatgtgactgttcttattacttaaggctgaggacaggctgactgacaagctggagggcctattgcagtctcaggcagtggctctccagatgatgagatgcctgtggctgttgcagcacttgggcctctttggtccactatttcatgaaaggctgtttgccctttgattagcactttaaagagagcttttctttagcttgactgagatgtggaatcagatagaaaaacactgctttcctgcatcctcaaagctatgtttgaaattctttcctgataagaaatgtttgaaccaattggctatgatttagctatagttttacaggggccaaagagaacctagcagcttcctagaaaaaaaaaatcttagaagggagaagtacagcttctctgaaagagatcagacacttcttaccatgagtgaatgtctaaaatgcttaaggagaatttagtctgatttggaggaacccagtgaagaccttgcagccaacttgtgactattcagcatctttttttttttttttttttttttgtgccaggtatcacattgagcactttttcaaacttgattttatggaaatctcccaacaactctggaaggtagataggattggcatcattgggcagatgaggacactgaggctcagctcacatgttcataaagaggcaaaataagagcaaggaatgtgaatttcaagctccaggcttgaaggtaaaatttaaaggaaggtactataattctctaaggtttgttccatcaaggagtaccaagatgtgtggggaaacagtggcagtataccagttgtttacttagtaagatgagtgcctgctatgctgccagacaccaagtcacagcagacctagttcttgatgttaattcacaatccatttgaagaagtacgataaatacatgaaataattagataatgattaaatggtaaggtatggtataaatgtgttttgttgttgttgttgatgttgtttgtttgtttgaggtagggtctcactctgttgcccaggttggagtgcagtgatgcggtcatggttcactgcagccttgacctcccaggctcaggggtcaagtgatcctcctacctcagcctcccaagtagctgggactacaggtgcttgctaccattcccggctaatttttgtattttttatagaggtggggttttgccatgttgcccaagctgttcttgaattcctgagctcaagtgatctgcccacctcagcctcccaaattgctgcaattacagacacatgtgccagtgcgcctggccagtatgggaaacattttagttgccgttagatatcaaagatgtgattgaagacagagtggctgtaaaggggttcatggctatacagaaaagagggagcaaggacattcctggtgggtggaacagtgtgagcagacatggagtggtaggaatgtgcctggacagtagaggaaagtgagaggtgaaaagggctacagatacctttggctagggccaattgccttgttgactcctcttataaatccagttgtaattggcataaatctctgattaattgttccaccagcagaactaacagccaaagtgaagggtagaaagatcattttgcttagaaaattatgcaaaccccaaagctgcagaggtttttttttctttttttaaatgaagccttttccacttaaaaaactgtgaccacatgcctagcagggatcattcttttaaatacagccttagcacaacgcagaggctcagcactgagcttaaatgcattgtttagcctctagtaactgcatccgataaagtcgttgaaaatgaaccagagctgcttccattgatctgtttttcaattctctgttgtttgctggaagagcctgattttactttgcccaaagtaagtcattcgagtaatcggcaaatccggtggaactcccaagtcatcacctctcaggctggctgcttgattcataaccttcagattgtcgccaggcttgccagcaactcagaggcacactcttgtttgtgccaaggaacacaaaagcagaatccatgcctgcagagggggtattggatgatggtagggtatactggggactggcaacagcctggaaggaaaaagcttattttgatcaatggattgctgtgtgggctcagggggagggatggtgtggtgactgagagcatgggctttggagattcactttccagggaaaatgctcagctggctgtttaccacctatgtgactttagtgccttgcttcactccgctctgagctcccgtttcctcatgtggatgtgaggactaagtgaaataataacctctattgaagaacattggacatgttggtaatctctgtgatctaatgatcaagaaacaggccacttgcagggaagagttttggccagctagagcaggggttggcagactcctgtaaagggccacacagtaaagattttaggctttgctggccatagggcttttgttgcaactattcaatccttctagcctagtgggtgaaagcagccatagacagtatggagacaaatgggcatctgtgtgttccaataaaactttatgaacactgaatcttgaatttcatataattttcacatgcatgtcataaaatataattcttcacttgcttttcccccccaaccatttaaaatgtaaaaataactctcagcttgtgggccgtccaaaccatagagctggccagacatggcccgtgggttgtagtttgaccctgaacaagaatgcccatgggtttttatccattgtaaatatattaaaaataccatttgaatttttgacagtttttacatatttcccctagctataaattgcttctccaattgcactgcctaatgaaatattgaaaatatactttttatgaaatggcttagaagtttccttatttctttaaaaaagttttattgagatataattgatatatacaaaattgcacatatttaatgtatacattttgatgagtttggatgtatatgtacaaccatgaccatcaccacaattgcagttactaaacatatcctatcatctccaaaaattaccttttgttcttttgtgagtttttttgggtaagaacatttaacatgaattctgtcctcttgatgtattttaaagtgtacaataatgtattgctaaatacagacactatgttatacatcagatttctagaacttactcatcttgcataattggaactttatgtgcattgaagaactcttcattttcacctcctcctgcccctggcaattatcactctattctctgcttctatgagtttgactattttagataccttatgtaagtaaaatcataaagtatgtgtccttcgatgattggcttttttcacctaacataatgtcctcttggttcaccaatgttgtcataaatggtatattcagcttttgttaaaaaaataaaataaaaaacactcctcatttcttatcaaaaccccacatataagtctcacctctttcaggaagcccaagttctttctcatttccttatattgaattcctttcatggggctcacagtgactcacaggtgtatcttgcttggtgtgtactttttccaatggagcccacatttgcaaaatcagaaacatctggcagcactaagtccaacaccctgtagtccaacattctcctgaagctgcatggcaactgcccacttcggacagggtatgctgtttctgccccacccctcacctggtgtacacatgtcctctccggctgtcccgtttcactccttgttcgttgaagttgccctcctgctctggtaagattttaaatttgtgattcacaatttggattctatatctgcaatttcataactacattattgtcttacaggtttttgttgacatttaagaaatacagaataatgcaaagaataatattacaaagcttgtgtacccaccacctgaaattaataaatattaatctgttatcactttgattcagatttttaaataaaatatacaggaaatcctagatagaattgatattttcattattgtccatctcagacttattatccttactccttccacaaccccttctagaacatatgtggacactttcagcacttatgtattcatagaaatatatgtggtatcactttatatgttttctaaatgtctaatttataaaaataatattcttctacatgattttttctctcaatattatctatctggggtcatatccatctggtccaggcacttttcgtgctatatggcatgttgtcatgatataaatatgcacaatttatttatctattttcttatcaatggaaatttaggttatttctagctatgtgctcttacaaacagtattaccacatctttatgtatgcctccaggtacatacatggaagaagttctctgagttgcaagccagaagtggaattggtgggtcatggtgaattgacattatcacaaataatgcactcttattatgcaacaataatgcaataataattcttgtactattttctgattgttttacatgtggattatctttgcagatagaatgccagggctttttatttgttctgtaagattgaggaggcttgcaactgtgtcttatttattatctcccatagcactgaacataattgtcctcgtgcataggtgatgctcagcaaatatatggtgagtaagtaattctgttggactcgatggcaaactaagagcaggtactgaactttatactttttctgattctttttattttttggttcaggaattgacataaagtaggaaactgagaaatgtcatgacattttaatgacataagaaaacacagtgtccctctttcccttcctctcttatagctctttaaatttccctatcttaaccgggtgcggtggctcacacctgtaatcccagcactttgggaggctgaggtgggcagatcacctgaggtcaggagtttgagaccagcttgaccaacatagtgaaaccccgtctctactaaaaaatacaaaaattagctgggcgtagtggtgggcacttgtaatctcagctacttgggaggctgaggtgggagaatcgcttgaaaccaggaggcagaagttgcagtgagccgagatcgtgccactgcactccagcctgggcaacaagagtgagactccatctcaaaaaaaaaaaaaaaaaaaattccctctttcctcctgtctaaatcccatctcaaatatccatcttctcccttgtttccatctcttagagtctctgtcattgctcaactccagacttatcttctacaggttcacagaccacattttctcacccacagttatggaccttaaactttcaagcccattacagggatttagttagttttgagaaaagaatcaaagttgtttggactaggatgatttatttttattcattttagaaatcatctttcttccttttgcttcttctctcccaatgctttttagtctctttctcggttttccttccacccacctcttccccccatatttattttcaagcctttcaatctttgccgctttccactaccttgccaatcattgtattgtgtaactaacagtctccacttacaggattcttgctgttgatcccctgcctatttctattaaggtctagttcatgtctggccttcgctcagtgcaattcgccctgtagccactgacctcctttaccactaatcccatctacatcctaatgggaaaacaatcaggtggcatggacacacaccaatagccaagaatgtggcctgaatttctggagaccaacagctgttgtctgctgatgtctggccttgccacaactatgctctttctactttgatttgaaatctgtcctcagcagcttccttcatggagggagggaaaggaggagggcttttggaggcagaggaaaaaggaggcatggggagccaggcctttcagagagaactgaactcttataggaacacttaaaagaggattcgggagtccacatgaatcaagtgttgctattacaagaacatttattatttctttactcaacaatacgtatcgatagcttactacaaggcaggcactgttttaagagttctagaagctgggctagggcataaacaaaatagtcagggtcactgttaagaagtttatattttaaaagccacttccatcctcagtagaggaaagatcaattttgaaggaggtttatttcagctctgacattcatggaatcagttctataatccaattctgagctttttaaatggtggtggtggtgctgctgctgctggtggtggtggtgtgtgtaactgagtaaaagagagaaaaaaaattgggggagatagatagtgctaaggcttaagggcttcagggtacctctaacttccaaagattctaaccctggcttcagtttgatttttgctttttgcctagcctgagaaagaataacatgccaatgaatcaaaggaacatcacagaatattaaaagcattacctccagtgaggcttttattttcttatctacagatttttttagttttcaaatttttcatgatgagagtgcattatttttataatgagaaaaagggaaatcatttatcaaaatgataaatttaaaatgacattttaaaaaatcatctcccagataatgaaagggaggggctgcatttgagtttatcctgatgatgatgtgggtcactcttactctccctttgaggttgtgatctggaggaagaaagagcctcaactgtgtaccatcacttcccagtgctaaccaatgccctgatgaaattaatactaaatcatttcaaataaacatactactagaacccaataagaggtaagaatgggaaatagacaaattctacttgtaaaataaaatttcaggaaattgctaaatagtggcttctgctgaaacagttctctaatttcttcaaggtcatctggttaatttatgctgcatttgtaagttattgtgtattttaaaaattaatgaaagatttaattatagcagggttgcctgtgaccttttgtgaaatgacttcatcataaatctgcaggcattttagaactgttttccaggtttgtaataatttgctctcaaattaatgacatccagccagtaaaaggagttgaagctgggtgaaaggattgagtcgggatttgtggttacctagcaatggctaattctgagtcctggatggaggtggtagaggagatggtgtatgactcaccggaatccacagcacgtttaactatttgcttagaggaatgagaaataaatccagtgtgtcaatagggagaagttgtatgtagccagagtgggtcactggagagcagttgattacagttcatttatctacatatgaatgtagggtaacccctggaccaatgtgagaatttctcttcttccctcacttctagcaggggttctttatttgtaaattgagggtctttgcctgccctcagcttgctggctacccatgaaacccattttagactctagcgccctagtatttctgactttcacccacgcaagtggctcaatgagcagcatagttaagctgtctctggataggagtaggctcatttcatctttgtccctgtcattctgatgattcatttgatccaataaagtgagaggaaaggctgtgcaggggaatgccacgtcttagcacatcaaagatcctctgtcttagaagaaactggtagtgcacatctgtagttacagaatggcaggctggagtttggaaaatgcagagcaccctttaggcgcaggagcctgggagaaaaggcagtgaaatctggaaagtaagtcttggctgaagcctttcctagttaactgcagtcctggatgtgaatcacttctctactctgcattcctcaagttttcatggtgctgcggtcacatatggcacaccatgactctgcaagctgaaagtttcccatgaagagcagtcagcttggaagaaagagctggctgtcaagagacttgggttccagatctttgtgtccttgagcaggccttagtttccccagctagcatgtgaaaaggttggtcagaagctcatccataaagacccctccagcactgaaactttataattctgtttgttcttttgtatgcctcagggattcccaactggaggctaagccaatagactcatagctcagagtcaactacataattcttcatgcagtagatgctttagcctttgagacaaatagggtcataattggaactttctagataacctcttctctgcagatttctccttttttcctccaactgtactttcagttttatatatttcaaggcatttctgccttttatgcaaacaggctattaggagctggaggtgagagcatcccattgcccatacctcagtgccaaactgtgcagttaaatgattgctaatgagtcatgaaggacttaaaaaagagtaacagccttgctgaaaacacacattgctgagaattgttttagaatggttgctgcaaatgcctaaatttgacccctggcttcatcatttacttgctgtgtaaccttgtcagatgagttatttaacttttctgaacctcagtttcctcatctgttaaatgggagtaacgaataaaatgagatgatccatgcatagttgttagcataccctcagtgttcaataatttttcactaatattagtaatattaattgttattattatttttgagacggagtctcgctctgtcacctcggctggagtgcagatctcagctcactgcaacctctgcctcccgggtttaagcagttctcctgctttagcctcctgagtggctgggattacaggtgcgtgccaccacgccaagctaatttttgtatttttggtagagacgggacggggtttcaccatattggtcaggatagtcttgaactcctgacctcatgatctgcccacctcggcctcccaaagtgctgggatttcaggcgtgagccactgtgcctggcctagtaatattaattattattgttatttgactgagatctgctgatctactgtttgcaaagtcttatgggtatggatcatggggatataaaagcataaggcacactgtctgcccacaaagttcttagacatccagcaaagacaaagtaaataatcataatatataaccatactaataattgtttaaaattattaatttgttaatttatagcaatcactataaaatacaactcaaaatcgtgttagatactgctattatcctcattttgcacatgaggaaagtaagtttaaagtgtgtaaggaaccctctgtagttccaggattggggctctcatctgggccatctaatatgaacacttttgtgcttaagcactttattctacagccactcagacaataaatatgtgacaagcacctgtgatgcataaggcacaacttatgtgagttgcaaagttctaagaagttaaaatctagcaaagagaataagacacttatgtacatatgctatgatttttgatacattttggaagtgctgtgggtcatacccaaaatacagataaaatgctaagaaattcagaggagagtgattttattttcttctgaggaaggaaaagaagcaaggaggaaagatcagagaggacataatagaaaggtagtatttgaattacaagtaaaaggaataacctaccaagaaaatagaataatctcaaaacctgtacagttttgtggttatataatataaagactataaaacatgcaaggagaaatgaaaggtttgcaatcgtaggaaaacattttgataaacctcacttagaaaccaatagaccaagtagtccaaaggttagtatgattttgaatattgaataacattattagaaagcttgatttaaagcagcagtccccaaccttttgggaaccagggactggtttcgtggaagacagttttccatgggtgagagtgcaggtggggggtgttgatttcgggaagaaactgttccacctcagatcatcaggcattagttagattctcataaggaatgcacaacctagatcctttgcatgtacagttcatagtagggttcatgctcctgtgagaatccaataccacagctgacctgacaggagacagagttcaggcagtaatgctcgctccctagccactcacctcctgctgtgcggccctgttcctaaacatttaatatatttcaacatgttgaccatacactgagccaaatacaatgtctagactactttcaaagagctgattatcattgaaaccacattctctttaaatatttgcaattaaattagagattttaaataaaatgatggtgatgaaaacaaagaataaaaaacttcagttttttatattctatatgacttccatgcccatactcacattaataaatttgtatgcctttgaaaagaaaaaggaagaaacctcatacatttggaaacaaaaccgtgagttctttatgaatcattttgtttcttaaagaggaaataaggatggtctctggaaaatatttagatttgaaaagcttttctcctgccccttttatcctccaatcaaaacctactacctgtattttgacctaaggcttacagaatgagtaggagttggacaagacaaggtgtggggtaagccatcccaagcagaggaaaagcatgttgaagcctgcgtctcttgatgcagaggcttctagcctgaagactgacagtccagtcaaggcagtaacagaaagaagaaactcaggaaggggctggcagagtcggcttcaccctgctctgtttctgaagatgttattccggcagatggaaatgggacagttggtggttagaagaactcgagttgcaggcactggagtctctgaggacagaaaagaaggacgtcccagttgtgagtcaatggcaaatcaaactcaacaatattatcttagttgagtttgatcaaagatgcactcaatagtcagcctgcagtgaagtccactaatataactcccaaagcactgtttgttcttccttttcgacgttttttagtggcttcctaggaacaaattctgattctttcttgaaggattgtggtcaaccattctcttcttgaaacttctctcagctttcataactatgcataaaagttggcataattgggaggctacaaaagaatcaaatgactaggcaggcgagagtcaagtaacccagggctgctctcctataaagaggaaaacatctttacagagcctagtcctctaattacatttagtgtggcattctttccacctaaattatagcaattatatacagagatcccctttgaaatcatttaattaatgagtagctaaccctctctgtgtatagaattctaatgaggtcttttatttttgtgaaccgcctccctccctcaaattaattactccccttcctgaaaggcttactcaggcctgaatggtggattaaaggaggtgggttatttagggtcccagcaaatcatatttgtttgtggaaatcctagcacagtccagggtgacaagggacagagcatttgctgcaattacttgcctgagattgtttctgtccttctatattccaaatgatacacaactcagccacattctttgacccagaaataagggcagatgaagctattacctcaattttggaagaagtgaatgattttgttagattaattctatcattaatcaacccagaagtatttattaagcatctgttatatgaaagaagtaccagtgcagacaaagatgaatgactgtaatagataaatcctttgtgtatagggttaccaggagatggatagctttgatgtagacattgaggtgtactttgaggtagacatggggattgaaagaaaataaactcttagaaatggtctcaaaagggccacattccctgtaggctatttctgcaactcattctttgaacacatgtcactgatttcaaacaatcttttattaaaaagataagtccttgagagatgaagtgatttgctcaaggtcacctacttaattttatggcagaccatgtctaggaaaagccaagtcttctatttccctgcccagtactcttgcgaccatgcccagaccacccatatgttaacaacaattcaagagcacaggaagaccacctgtaaccagagtcatgttagcagtgtaggcatttagaatcagaggagttttagaaaaagacagagatggcctcttaagtttgtagagtccaagaagaaggtgaatcttgagtggttgtcaaatactctcatgaaaaatccaagtggcaaggtaaaaggaaagagaaaaatgggagttataaattttaattgattttttttcctgaaaatctatatagtgagaaatagcatagagaattcatttattttgttcctgtggttgggagcaacttcctcaggaaaccaaagggtaggctacctgtttccaggtggtcatctatatttatatatgaggtgttcactttctccaaggctcactaggaagatatcaaataaaaaaagaaagtcccagcatatgaagttagtacgtaccttgataaaaggattttgagccaagcctattgaaagtccttgatgagaaagtccttgggtgagtctatgaggattccaacagtaaaaatgatgatgatggtaataaacatttgttgtctattgtgattttcaaaattttcacccacattatctcacatgttgggggtttgattatgttggtgaaaatatgatttgagttcaaaagggggctagcaatgggtttctgaaaaaggctgtcaaaatagtttatcttggtaattgcaaggaagtgggatttaataacagtgagtttggccatactaagaattcgtttctctttgccaaagacctgagaataaaatttcacgctctagaattgccttgttttttttctgttggcattcaatgatcaattagccattctttttcaagcaactattgttgataggttccgtaggatacagagaagtactaaaagtatccccaggcttaagaagctttttaattagttgacaaaaatttcaccaaagatacaggaaatttctgaaattctagattgatggtctgggtaagttgttctcaaaatacggtcctggggccagcaacatcagcatcacctggaacttataagaaattcaaatacttaggtacctcaaatgtactaataagaaactctgggagtgagacattctatgtttaacaaccctgtaggtgattctgatgtagacattggagaacctctggtctagagataacaggaccatttgagcttctgaagaaagagctcagtgttgccagaggaatcacagaggactttttgaaataagtattgcccgatttgagaattatagtatccttttaatgatgctccatgcctttggttcttccatcctagctatctcttgggctttaatattctattgatacatgaaccactttgttccccctgtaaaagtactacacatatgagaagtgtgctgtacctattttgctggtaacaggctctccttaacttaagaggagtatttctggcagatgagaaacttttactggaacttgattattttcaaaattattattatcaattagaagcggtctgggctttctcttttcctaattcagaatcaagaggaccttctcagtgttcatcactccaaagtgatggacatggtttatgatgatgcccacttcaatttctctgttggtgtcttacttccacagatcttgttgtaaattttaacatctgctccttgggtattcatgaaaagagaagaaaaatatttgaatttgaattagttcttaatttcattccctgcttattttgctatgtttctgtcatttcttcagcttccataagctttaatcagaagagcaatgaattaatgtgatattgaacagaattagggaagctgggtctatacaaaagtgaccatgtgtctgagtcatgtatgccccataggaaagggaccacagtgaactttgctcttccctaagctgacaatgggtggatcgatgtggaatacattaacgtctgaaagttgctaggggattttaccccactgatcttatttggggcccattgagaaaatgagcaaagctcataatcctaccagtgtttaagtgattaaaattttgcatctgatacacgaaagtgacctcccgggagaggaaactagcacactcctgagtgaacatattagtgtatcagtttacagtatggggaaagacctgggaaacacaatataagaaaatctgggaaagaagccaaagaaatgcacatgaaaggaatgtacctgtgaggattgcaaaacagaacaatcgaacaagtctgtaagtcctgactgagcacctattcttgtgttctgtcctgaaatgagcactctgagatcagtaatggatatctcaaagagttggaaagaccaacaacatggacattctttgaggctcggagtcaattaggctgtacacatggatgatgcttgcatgctgctccatagatcaagcctgagcttgaatttctatgcttactaacttttgagcatctcttgttcctgttgttagaacctttgtctgttagaaagttccctcacaggccaggtgtggtcgctcacgcctgtaatcccagcactttgggaggctgaggcaggcagatcacctgaggtcaggagttcgagactagcctgaccaacatggagaaacactgtctctattaaaaaagtacaaaattagctgagtgtggtgatgcatgcctgtaatcccagctactgggtaggctgaggcaggagaattgctcggaccagggaggtggaggttacagtgagccaagattgcaccattgcactccagcatgggcaacaagagtgaaactctgtttcaaaaaaaacagaaaagaaagttctctcacattttataaacttccacacttttattttttcatgcaagagagctccctagaatatcaacctgctgctcttccctcactgcacttaggaatcctaagtcatgtccaggttaactagcctgagttcttacactgcagtttgggtagatgaaagtggtcttggatcatattgccacctgtattagtttcctgtggctgttgtaacaaatttagtggcttaaaagaacagacatttattctcttgtagttctggagtttagagtccacaatcaaaaggtcagcaggcctctactcccctggggctctaggggagaattcattctttgcttcttccatcttcctgaagttccaggtgttctttggcttgggctgcataactccaattttggcttctgtcttcacatggccttctcctcactgcatgctactcatctttgtgtcttttataatgatacttgtcattggatttagagcccaccctgataatccaagatgatctcaactcaagacccttgatttataagtgcaaagatacttttcccacataaggtcacattcatagctccagggaataggaagtggtcatatcttattgcaggttaccattcaatgcagtgtaccgtcttagtcactctcttcttcagtggtccttaaactttaggaactatgaacccctttgaataatctgataaaatatatgtgatttttatttatagatgagtacttatgtgccattaagcacctttttgtttgtttaaaatttaagcagattcatacttcaccaccactaccaaagcccaaacatgtgctgtagattcaaacactcagtctatatccttcttgaatggtaacagtcaaaagcaaccacaattttcctggtgatctggttaatgtagaaaaaaacaggttattgcctctttggttctagacaatacatataattctgttaatgcatttcaagatcacgttaaatattttatgtctccctgaagtgttcacattgtgtgtggaaactcttaagctgctattattattactattaaacctgaaaagtaccaagccccatttcttttatctggtacttatgtaattaccatggagaggatctagctaacatttctctaggtgacatcacaccttattaaattaagcctgtctctttagtctgtcacgaccttattgagtcttgcttctgccatcgagcatattgagggcttcctccagctttatgtcatcaaaaaattcaatttccaatgatgaccattattttcatgtcttcaagtcgttaataaaaatgatgaacaagaaagagcagacaacagaaccttgcagcggactactcacacctccctcttggttgattttaatgtcttcattaggtactgttcagccacataattttaccaagcacctggctcatattttctcaatctttttgtcaagattcctatgacagaccctgttcaaatgccatgctggtatccaggtaaatcatgtgcttcacattttcctcttctgtctgcctagtaaccttttaatagaaaggaatgtgattaatctgacatgacgttttttgtgatccaggaagtaaatttgaactatgtggagtcaacagaaatatatggtttagcatcattaacatcctgcactagtaagtcttccaatcagggaagacttactgctggaagtggtatctgaatgcgagagttttgaaggctggatagagaaaaaaaagatatccatcaaggtctcctcccactgtttttgtttgtttgtttcgttttcccttgatgaggcttatcagtttaactgtcctctcttcaaacaagcaaaaatgtttgataagagagagctgttttgttaaagatttaaaatggactgaccgctatgtaaaatgaatttagagctaagaaatggaaataccttagtggatgacctggcattgatgaattggatttggaaaccactggatttaccaagactacaagagaacagagagaacccagggagagggagttaggtttgctttgctccacagtgtcagctgcatatgttgggtattctaggctcagagtttctcctaccccatgctgagcttagatccacacaaaacccatgtagttttactaaaggagagatcctgtctctctttcaaagtctgcttaattttcttttagataagcctcttaaaggttttatttaacttttatctgaagcacattcaaaattgatcctgagatgtattgtaaattggatgatccacaaaagcaactctatattcttcctcatttcacaagttttgtcagtctctacctttcccataagcatcctcatcttttagagagcataagaaaatgacccaggaagagagttaatcttgtaggtgtcaccataacagtatctgaacttgggcagaggagaatccagggctggtagtgtgattaagtcttgctgaaatggaagccatccaattccttgaaagacctcagttgttttaagttcgcagcatgatcggtctcccctttacatcactatgatagatgtcttgcattgtaattgcaagacacgccacccgagtagagtatggatgatcagtcttttttttttttccatttttctagaaacaattgatcattcatatttatagggcaatcaactgctgggctttgaaaaggtcagtattgattatctaagtcacagatggtgtgcttctttactatacataaatatgagttccttttatgagtctgctgtgattcttttttctttttaaggaaggaggagggagggtaggtaggtattcatgtgcgttaaacaatggaatttcaactaacacttaaattcaactaggactttgcagttggcaaagttgtactttaaattagcaaattcattccttctaccccaacacatatacttacaatccactttacagatgaggaaactgagtccctgtccatggacatgggtaggcaaaatgccagtgcttgcattaaggagaaatgggaaggctgtgtatctaaatctgaacaggggttttatatgggtgttgagtttgggactaccggtcccaattttttttctttactgggctttttatattttaaatgcttcctgtaataggcatatattacttttgcaatttaaaaaatggttgatttaaaacccactgtgaatgacatgccagttgattgaattgtatggatagtggactttctccttaatggccctcaaggaactcactttggaagaataactaaagtccaggctgcagtgaatctctatctccttcctagtttctgtgcattagtgactgactatgggactttctccccttgtgtctcccactcctcccctaaacacttagagtttttggccacttcagcctccgctccgaatggcaattggtgaaagtggactacaaatctatcttcagccggcattgcaccaaggaggactatcagacctggcacctgctcaatcaggtacacaccccagggagttggagtgctggctttgaggaggaggagctagtgcaagtccgactgggtcttatctgagccttcctatttaggggaggaaggtagtgggtcatctgaggatgtgggtgtggatttggagaaaagggtgaaacacactcaggtccagtagggccagatgatatttaggaactatctcgcaccctgggatcctatctactaattgaggtcactgagctgcctgggggaaaggtgttgatgataacctggggttttagctctatccatggagaaatgagctttttacagctagaaggcctccaagagttgctcattttatctgccaatgtggagggcgagagcatttctcagactagcctgaaataagggacccagagcactgggaacaggtccactgagaaatggtgtcagggtgggtaggtctagcaatggtagatatttactgctgtgagaaataggcagacttctgctccagaaccactgggtccttgtaatttgtatcaacttctcctttctttgttcttgactgggaattaagatttgggcatggtcgtttatcatagagaaggaacattttgggtcaacttcaatttccctctgaagaccatgtgaaaaatgtgccataaatgggctcctttccactagaattgctactgaagccatttgggcaaatgtacctggtggtctgcaaagatgcctggagtccttacattctctatggaggtggagcagaaacgggatgatgtagacatcactggcttgggtgggtggagggtagaagtgggcccaccttccataatgttccttttatgtggtagtgaaagattagcacttttattcttgaaactcctggatcattactgagaatgagactgctacataaagtacctaaatgagaatgaacaggctaatgcttcttgttgacaactggtttatttcaccacctttttgtttttctgtctctcacactatggaatttctctctaagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtggtgagttgtttggcatttcattaccaattccaaccaggtcttcacctgtctgtggggtggggtggggtgaagatgaagttaggagaggaagcatgacgcagagataggaggtgtatctgctggcctgtgggcccatccatcccagttactgggccagatgggaagtctgcattcctggaaggaggacaggctgaggcattttcacagagagagtcactgatctatcagagcagcatctctcagggggcttcttctcatctacactgagcagctgtattggaaactactggagaagttgtgctgggcattgacagaggttagagagctactgccttgctgttgcctccagccacatgcactctcactgtgctcttctacgtgacctctctcttgtttcctttttctccccctaataacagcaatggagaacaaccttaaatctcacttaatgaaattcaaatctcacctatagacaattactcccaaatttccaaatatttacctctggccctggcctcccccttctcttggttggacacatatgtgtctggctgtctactcagcattcatctcctcttgattcactatcagggttatcaaacttaaggcagccaaagcaaagcttttcttgaatccccttcattggaaggagtcccttgcccagtttttctaatttcaataaaacacacagctatccactcagttgccagaagggtttggtttctccttttctttcactgtcagatccaggccatctgcaagtccttgcagtttctaccctcaaaacacattctaagtcaaatcacttctttccatctctcagctgtttgtatcactccaggaatcgaactctctccacatccacccttgtcacttaaaattcattctcctcacagcaaccgagatggtattttaaaaactcaaaccatatcttatcactactacacttagaatactccaatatcttccccctcacttaaaatctaatcttctttccttagtttcctccattgtaggtgatttagccctgcaattacctttatgtcaaaattccttactgttcttacctcattcactgtattgcaaccgcattaccacctcctgcacctttattaatcctggctcattcctagcagagggagcagaaaatgcaagaatttcttccaaatcttagtatggccggcacctttgagtcactcatgtctcagcaaaaatatcagcttctcagaaatgccttctgagaccacctaatctcacctataccctggcacagtctagtatatccctgttttattatctccttagtattaattgccgtacaaaatgaacatgtttttgattgttccactatcacctatctctccagtagaatgtaagtgctgggaatgcaggagttttagactttccttgtttctgcatccacagcgcctggcccgctgtaaacattcaataaagagttgtagcatgtttctgaacattgttccttttaggagggtcaaaaatctccccaattctgggaatgggtacatagcactccgatcccagctggatgaattcttcccctgcatcacaataaaaagctaaagttcaatttgattattttggtagcccatctcagctttgtctttgttaaaagacaaaactaagggcttgggcattggcctctaaacttgggaggggcagggcaatgatggagctgcatttgggcttctctggcatcagatagtcaaagtaagtccaagtgggcacagagcagctgcccctgaatggcagcctcacttcttccagcctcatttcatccagctggttttttagcttgatttgtactagaaactatcctttgtttcccactttctgctaggaatataactggaagccagaggagtgactctgctctccacctgttctttatccttaaactcatacctaggaaagcatggcttcagtgaaattcatgaaaatgagatatactaagtgtaatttaagtttgactagcagagtcctttctgtgaccattttgagcccttggcagcaaagtatattttcacattgtgaaaaatattttcaattattaatcacaattaagcaaaaatagtcacagcaatgagtgcagtaggccactcaaaattatggcttgtgacatattgatgtcaacctgaatattcagaatattaattttaggcttccttgtgtccttctgcagactaactccattgaggcacactgtctttgaatttgtcatgatacatattctcctgtgtctctgtgtgccataatagaccctcacccattgttgggtagcatcacaagtgagaagaaataagaactgtaaaatattttctcatcagtaattccattaacatttactggtctgggcaaaaattctagcactgatagtcacagtttttgaccttggcaagttttcttaatctttgtgacttcatctctatagctgcaaaataaaaatacatgacatctaccgcattgggtcctaaggaagaataaatgaattcatatattaatatacatcattaatatagataaggcatttatcctactgatgtataacatagaaatacaacataggctagctattgctgctgctgttgatgctgttgttattcttacaccctagggttaagtggtccctatggtatttttggaagtaaaccaaagcttatacatccaaataagcactgttttcagagtaggatcttggggtctgatccatttacttcagtactggtggcattgctcaaagtatttctgaacccttctttagggagtgctgtcagaatccatctataagtaaagcacggtgggagaggcgagggggagcctttacacggccttctgtggttctcatacttgcactggtagaggtaccatgtggatccaagacgctgtaatgtcaggatctttattattgccttttaatgagaagaaacatcttggatataggttacttgatcaaggttacatccctgggagagaatgagctggggttcaagtgcagatttagttaaattccacattctctcctctacaccctgccatttctcaagaaatcaaacaagtctttattattttagattcattttgcttcagaaaaaaataaagtttccaagtttacttactctaaaattaaaactcatccccaaggacttgggtttactgctgttgatgaaatataaggtagaatgtttcctcaacactaaaacaatttccaatgaagtagttttgaccattggtactagaatcataataggtgtatggtctccaaaaatattttatagaattttttttgatatataatgtggtgtatgtttgcatttttatagccaatcacacctcatattaaaaagaatatagagaaccacttgagtaaagtagagaagtagacaaggccagatgctcagtttgtggtcataatctcagaacacaaacaaaaaaaaaactcacacgacctataaagtttttttttactactactgagtaggggagaagttgtttttgattactgaaatttctgaattatttacagtgatttttggggggacaatgagactgaatatttgaaattgtcttcttgtttttaagttaacttcaataagcatagtgatttgttaaaagatacagtttttccaacaaatacagtttgtctgtttgctggtctttaatgctaatgctagaaatcagcatatggcgtatagccttgtccccttctcaatggtcctctctagcaggaagtattattagctaaggcatctgaaatacccagtacagttagtaccagtgattatcatgcacagtccatttagatgtttccctaggccaaatcagggcaagttcatttgattgatctaggaaaagttcaagcctcagagacagcagagagagggtatcacctagttcagtcagtttgggagggaagagtaaagactgggaaggatgaattaaagtcttcactttggtggaagaattgaggaatgcaacctggattcacagagggaagatattttctgtctctgtccctcttttgcaagaaaagaggaggttttctagattctcagaacatttatttgtagcaaaacattcacttccacaactttctccagagcgagtatcagtaataagtatgaattctgcataaagattgatgtttcagcataagagcctcataaatccaccagcctcaagcgaaccctagagagccactttgcagcaacctccatcatggcgctggagaaggaccaggaacaaatccttattgagagtaaaggttgttagagaccagcaggcagtcagaaaaggtgcaagagggggctcctctaaagtcacacgagggctcttgagagggagtagccctccaggagacctgaattcacttgttcagtgagaaacgaggttgaaccagagattattatgcccaggagttcttttctttcactcattcatctaacttctcactcgacaaaaactttactgagcccctactatgtaagcagatgttttaccacatctgtgagatgaattatcttaatcttctcaatggactcccagaaggagagtctgctattacagacattttacagataaaggaatggaacacagagatgttaagtaattcactcaggataatattattctgacttcagagtcctgagtcttagtatgtattactggctacctccatgtcccatatggcactacatccacaaagcaagtttattgagtggtgatgtagaagacaggggaggagatttgggggtgtcacagcacatacattcagatgtatccgaagtacattaatctagtggttccccagagtaagcttgagtactctgcctatggagcacaagcaaggatgtgtttccgcagtggacaagtcagaggataaacaagacaataaacaacattgttatttacaaaatatacaaactttataaaatatacaaaagagttattgcactaaaagaaggcatagcagaaaataatgagtataattaaatgctgaattttatggtccaaagctatcatagttacatgtggttatttgagttaaaatgaaataaaaaatgttattccttcattgcactagttaggggctaccatattagcttaatataaaatatttctcttatcatagaaagttctattgaacagcactggttctgactgtatgtgctatagatacacaaaagaaagagaacaaaaagatcactgaactgaagtaatcatggaaggcttcctgcaggaggtagtggtgggactatgtagacttcctgctgaggaagaaaaggaaaataggcagtacttcaaagaaataaataacagactaagaaaacataaacctaaagaaaacattagattaggagaaatatttgaggaatgattgttggattttccaagcattttctgaaatagttgggatataattgtaatttttctttgagactgtatttgggcttatgtcttagctaaatgatgatgttaatgattaatccattgtttttgttgctgttgggcctgcttgtgtttgttgagtgctcactccatgcctaccaagaacctctatttgcctaatcccaaacctaccatgctatcctgcctgctgaagtggaacagggtgcctgtagatcactagtactggaatctcaactggcagatgggaggatggagaaatgggaatcagggaggctgtgatatggctatgagtggtctgagagcccctgcagcttgtctggaagagaccatgacttcttggttagctccaagagtctcagaatgtcattcctggggactagggccctccttaatgagccagtgggtgccctatgggattggactcatgctgaacagggatcaggagtctccattatcacctctgccactgtcagctgtgtacaatctttggcaaagtcatttctcctctttttgcttttcttttccagtctaccaacttaggagactggatccaagaataaaagtatcccttcctattttggcatgcagaggtttattattattattattattattattattatttctaaactgtcctggctatccctcctttagaatctaagccttttccctggatgggatttggaaaacatgcaggttcccggaaatgaaaaagttttagaacttctaaagctgttatagttgagaaagacatagaggtgacttatttcttgaaggaaaatgtgtgtgtgtttgcagaatccgcagcagtagacttccccgaggcaaatcaaactttctggtgcattctgtccaaacctcacaattcaacagaaaaatgcctttccccaggaagctggagaaacagctggagctgcttgtttttctaaatcatgcagacttcggagctgggaaggagattgagctgtatgagatattttaatatacatttaggagaaattaatgaagaagtccacagcttggaggcagccagtttccactagtgttgttaaatattaatgaaattcttttactctttggggcaaagcaacatgcctggtgcaccttttaaaattactgcattgctgacaggtagcagagctgaacagaactgctaaacacggttatatttagcaaagaccattaagatgtttctttcattcttaaaattgcttgagagagagcacccttccttcatagattaccagtaatccctagggttaatgggacattcaatagatttacctaagaaaacaactggagaatttttgataagtagtaaggatacaccacagcccaatgtttccacagataaaaaatgcttagaaataagtaattcaggccaggaacatgggctcacgcctataatcccagtactttgggaggctgaggtgggcagatcacttgaggtcaggagtttgagaccagcctggccaaacggcaaaaccccgtctctactaaaaatacaaaaattaaccgggcatagtggtgggtgcctgtaatcccaggtactctggaggctgaggcaggagaatcacttgaacctgggaggcggaggtttcagtgatctgagatcgcgtccctgcacttcagcctgggtgacagagtgagactctgtctcagagaggaaaaaaaaaaaaaaaagagaaataagagatccagtggtgtacttgtaaatatttaactgctggctctctgggaactaacaaattaatactccctgattaatggtatctgctgatcatcatacatattcccatcatggcagatttcaaactaccaacctgacatgagtgaacgcagaactggggagagatagctagtaccacaacattatataatattcccaccatgcagatacatggatgtaaagcacctcaatagcatggacaatagaatgatagaatatttttatataatatatattatatataataataaaatatagcaatcaagaatgtatgctttaagtattatctttgtaatataatttatgtaattgaaatttcatacagtttcatttttaatagtggctttaacaaccattaattagcttgcaaaatttctgagatgttaactgtgagctctcatgggctactacaagctggcacaacactgagtccatacgaactgtcagactgagatctccagtagttaatcagaagccttgaccaaaacatttacttggcagcagtgtctgtttctccttccttccttccagcttcatttaaacatgccaatataagactgatctcaagttccacctttctatgtagaaatccatgattcttgtcacattaactccacaggaatctgttgggcacttggggctactctctgcagtccacattgtagcatcagttatgggcccacagtcttcctgcagagatagatgtaatgcaatcatgtaatgcaatgggataattttttttttcttttgagacggagtttcgctcttgttgcccaggctggagtgcagtggtgcggtcttggttcactgtaacttccacctcctgggttcaagcgattctccttccaagcctcccaagtagctgggattacaagctcctgccaccatgcctggtgaatttttgtgtatttttagtagagacggggtttcaccatgttggccaggctggtctcaaactcctgacctcagatgatccacccgtctcggcctcccaaagtactgggattacaggtgtgaaccactgtgcccagctgcaactgctttctaatgtaattggaattcatttacccaataaatatttaatgcctgaaatgtcctaggtacagttctaaattcatattggccaaaaacaaacaaacaaacaaaaactgaaaattatccctgctcttttgtagcttccacttatagttaccaacaggttatgaccccagagattttgtctggggaagcagtgatggccttctatgacctagatattaaagaaggataagtaggaaactaccaaacatagaaaaaagtggaatgcttcaagcctgagggattacatatagaaagataaagagggttgaaaaggctggctagaagtgttcagttaagagtttgatgagaagataggtaagaaggtggggtggggtcagactcggaagatattgtgtacgatctcattaatcaattggttcttcttagctctactgtttagtgctgtgttgcatatggttttattctgttctttagtcatgtttggggtatgctgtatctctctcccccaaagactgaaaaacctttgaggacacggattatcacacctttttaagttttttattattattattattttacagggcagagcacatagtgagttgtaaatagatgtggaattaaatttaaatttttagtcccctctccccttcattcctgttgtagatatacacacagaaaatttgcctctgttttcattggacttccacaaaatcttggctcaaagaatatacaggaagcagaaaaagaaaggagttgtgggttctgagaaagcaacttcttttctgctgcttcatgttttattaacacttaatggattaatatttatatgttcagtttattttgccccatcggtgggtttcagaaaaccctaagatgcttgacttagaaacatgaattcagccaagtgaagctaccctcaatgatctctggttggctacaagagcaataataccttctacctactttattgttcttctactttgacatttacacacccaggagtcttctgaaactccaagaagtagggaagcactgtttggacttcagataggggacctccttttctacactgctctgttactttcccattttgcatcagggagaagaggggaaagaaatagtagcggactttctttcttcattttattatggctaggattttaaagaaacacacaaaaagagctacagtgtagttttattttatttttagggaaataggggcctttgttttatctcatcaggaaaagtttgaatgactctatgtgtccatgtgaatggacatgtatatacttgtttcagagagggtgagtcattgtctttgttgtcatgtacttatttcaataattctactgtgacttaaaatgtatttttaacagcatcctccgcatttactcccaagccaatgtacctgccacattatttatatcaatacctttttaaacctagaatttctatttgctaagttgctattttgttctgttgactggactccaaatgatttggaattatttataaagctaaaagttcattttcaaaatatgaatatttaccctcactggggatatttaaaacaatgtgttatgactttctggatggcaatagggacatgtatatgtttgtgtgtgcctgcggttattttagcgtttgtacatatatactactatgcaatattcattttcctgacagtgactatgggtatgagagacatggggagagccagtgtgtcccagctttctggtacaatccagcatccccatcaaaggactgcagccttggtcaaagctaccttaacagcactgggtaagtaaaacacctacaggaactcagctccctgttttcctgtttctctaaactaggaccaaaggaaatgcattgctattgaatacaatggagtgaagatggagtctgtttataacaaatggcatttgaagggaagtgaggagttctttagctgagagtatctatttggggagcatcagaagagatttctgatcaaccagatttcaataactttgaatatttgcttatgatagaccatagttactgttttggttaatccttctcttctggaaggtcatgtagtcttattccttgacactcaagtgaattaaattcatacaagtgatgtgcagatattacactactctctagtgaaagatgaactgaaactctgtgacactgatgctgaaaacttaaaatgaaaattcaaaagttccattctaggaattcctggaataaaaatgtcaaggatccctttcaggaattctcaaatgacgtgtgtgtttatctctttgttcatgtattagttactctttcgcatgcttgaaaaacattttcttgaagatttgttgtcttgccctttcctttgctgcctctataaccaagaacggatttcacaagtggatgggtggtctaagacagcacctctcaaatgttaatgtgcctatcaatcatctggggatctttttaaaatgcagcttctgatttgggagatctggggtggtggggaaatttttcctttctgtgagctccgatgtgatgtcgatattgctggtctctggaccagagttgttctggatgccagtcttaactctcccaatggatcttctgtcatctcagtcaagttattcatcttcttgatgcttttgtcatagctagttgtaacataatcagttaggtagatgtagataggttgagtactatctacctaactgatgtcaacaaaggaaaaaatatgatgaaaaagaagtgctgactggtctgagatactctgaaatgcatgccaactatttagttctgggagggctattcctggagcctgagctaaggctcaaggatctttgctgttatttaattgtaggagtctagtttagggacttaaggcattcaaattgcagatccaacagcatgaagttaaagagattgtggtgtcagagaataaagtgccaggaagtttgaggaaagggagtattatgcgcacaagttattagctgggccaccaatttcccagtcagggcctaagctgaatgtgattgcaggttaaaacagaattataaaagaattgaattaaagcatttcataggatcatgtgacatgtgtaggtagaccacattttaagcaacttagttatgccaaaatcccaaatagctaacaaaataattcaggagaatgaaaaggaatggcaattaaaaaaaaagaaaacaaatatgctacagatgtctaccaatacctccagattgtgtaaatgttggcttatgtttacaaaatcatcaaccagcttgagttaatggccaattgaggctgaaaaagaagagtagatgatatcaagtttgtgttaggacatggtacccactgaaatacctatcatcagtaaaaactgagtgtcttgtaactatgcatcctgagaaagtataaattgattacaaatcttgactgtctagaccagtgatgaccaaattaactataatatgaggcatatatgtaatttcagattttctagtagccacattaaaaatgtaaaaaataaggtgatattaattttaataatgttttctttaacccaaaatttccaaaatattatcatttcaactgtcacactaatgatatttcaagtgctcagtagccacaaggtgcgctaccatattgcctaccatatggacaagtggtgctatgttaaccagaataactttagacccattataagctcagttgacaaaaaagatgtatatatgcaagaaaatatatcataatttgatctgagacagtaatgacatacaacattagcttaatatcccctgggatccctgaatggaggtatagttcagcagtggggtggcagggggtacccagggaaaatgtcaggtatgatggaagactaatatctttcaaaaagagttataaatttctctgtttttgaaaccaccataggaaggcaacatagatggatttgttaattattcttgacatagtgagtgaaagaagacaaaatgtaatgggcatgtaatggtgatgatgatggtgataataatgctgctggtgatgatggtggtgatggtcatagtggtggtgtgtttctttcatgtggttttttaccagaacatttgttttttcagtgcagccttatagatggtcatgtgcctggaaatatgcccatcatgcagatcagggttgtaggaaagctcttggcttgacttcatatgctggggttggtgggcaaggaagatgacatggtgtcattgtacataatgatgtccttgtcacagaaggtcatagtgctttgtcaggtgattttcccatgccgacctcctctataagataattttacatagtgggatagtgagattgaataggagtttcaaatctgtgcttctaatctggagtttatgctgagtgggaaatgaaatattagcaaggagaaaaaaaatgtgctctgaaacagcccagtggctccacagaaagggctattaggcattaggggaaggaatgatgccctggaggaatagggaagataggaatcagcctcctgattaatcagagttagaaaaagtctgatgttctacctgctttctggtacagagaaagctggagatggcctctgggagatagaaacaggtctgtccctcacaagtagaagcacctgcttttcccatttcctgagtccaatgagtctgcctcctcttttgttgtgtgagtcagacattgattttccttgtctggtttagacactgatccaatctgtggctcaccaggtaggatcaataataacgtttaaggagctactcttaccaagatggagggatagcaggtcctcagcatttgttcagcttcgtaaatgactgtctttttgagacttggtttccaggggccgctgtgtgaagcacctgttttgctcttgctctcttacattccctttataacacacacacacacacatacaacagcaacaacaacacaatcaacacaaaccactatcaattgtcaattctacttaggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggaggtaggtgctcaactgggtctctgaggtcagaactcccaaccagaccattcccagaagggaagaagaagatcttacattcccacagacccctgcaccaaagtcaatggtgagaagctgaaatttctggaaagaagacagacaagggtgaaagagggcttagggtatttactgaccctcctccctttatcccacaataaagacccagtccgcagtgggagcccacttgcctctggagcatgcagatctggatatattcttcagggtctccattaaagtctgctttgctgaggaatatttattaccataagaccataaactgtaaacttggccagaggaaggaaatgtgaattttatctgttgcttttaggagcctcttttgctttattctgacccttaatcccactgattagaaaagcccacaaagctttcacaaggccttaaaagtaagagcatgaggatggggaagattattgaaatcctttaaagttatctttataaagaatgttgtattagttgcttttctatcagctagatgctgtattctttcacttttttagtgtcttctgaaatctgggcagtaaaatcagactacatacattgattccagtatgggaatatctctgttgtctgcttcttttataagctgttgaattgcttcctatactagggcattttaggcactctttgctgagtggtagagcaggaaggcttgcttgattgacacagccctctaaatttatatgcaaattgctctgtgctcttgagatcttggaaagaaggcaaaacaggccaggagtcattttttttcacaagtatgagcacttcagaaacctttaaaagtcaggagcacactggacagggtggtgaaggttccttatcctgggttgacagatttctcagccttcactcacagcaggtgctggaattaaaggactttaagattcagaggaggtcattatcacatttccactagggagtttccaggaccacagctataaaaaccttctcttgaatgggtgtgaagagccacgatcttatccgtttgaattgcctccagttcatttccactttaatttatattcataaactcaaggatagttgacattgtgtggggggcaagagagtacctatcaatatttcattcacatctgggctgccatgggggaagaaatggaaagtgaaactgtgatcagtgcacattcactgggcagaaggattggctcataattccaaaatgatgtatttctctctttattctatcactcatcttcatatatgaacagagcaatgctattcttcatataggatctttgttttgtggtcaagtgcattgtgttgatccaaagtgttggcccaatataatggtggggtgggggggtggggaccaagaagaatgaggttcagcatagacccttaagaagctaagtgttggcttggggtggtgagatgcattcacctgaatcattggcatcatgttaccaggtagtacacagagagctctttccaagagacagagatatctgtgaactgggacaatctgaaaaggcttcagggaagaggaggcttaagtagatttagggaagtccaaggataagagaacaagggtataatttggggtggtatgcagtattcatctgtagaatgggaatcgccatcctatccctgctgttgttttgcagatggtgttatataatatgtattaagtgagtagcataattctggtaacatagcaaatactcaaaataggagcaattacaactatagcatggcaactgagggcattattattgaaaccagactgggtctggaacctggtcttcctgtactcactatgaaactttggtctaactacttatttttgtccccagacaaatggggacaaaaatactttctataatatggaattatgaggagactgcttgcttggcactaataaaaaaaacctcggtaactattagctgctactatgattgcaattattattatgacacaaaaggagaattaaactatgtatgtgagggagtcagtgaaacccttggcttcccttcagaactttacagagggtctaccttgcccactattgtcagtgtcataccaactcagcttgccccgagcttgggcgatgaggacaataggtccatagtgcctgcccgtagtaccctgcggatcagataggagtgtgatcattgtgttgcaggtgtttcagccctttgggaaagactatgggtcatcagaggttgatgctgaagcaacaggaggaagcatcagataggagtctggctggaccaagtaaattgacccgtctgctatgccatcttgcagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtaagtaggaggcaccatccccgttttccctttgttcccagttggcaacttgctctgttcagacttcctaaaattcagagctgagcccaggttcagtgtgactactacaattacccaaaccaaatggtggagatatgtactcatctgtgtttctgagtattatggtactgaaatagattgattattttgaagttcggataacatattaccacctgggccgtccttttcagcaccactctgctctgatataaatgtgtgcgtgcacacacattcaggtaaaagtctcctctcttccttttggagaatcctcaaaatgaaaaagatagaaacaagccttctggttgatagtctcaggctcattctcaatctattatgaatgaagactgcacaaatcaaagtcaactgttatttgtgttgtaagagccagagaaggattaaagaaacatgtttagatatttttaatttagaactaaacacacacacaaaattaatttttacatacaaggttactgcaagttcattctgttttgacaattctaagaactctccaaaaatattttgttgtgctagaatctatttcattgctattggctgttgcttggcacaaaccaaaagaacagttggtgttccaaaatatttcatttgtgctggatgcattttgtgtattttctattctagaatttgatgcatgtaaactgaaactttaatattgtgattttaggatgtcgggtcgaggaaatgttgtcttggggctgggattggtttcccacatgtgtatcagtgatattcgtgggtctaaggacttccatggttcttacttacataccccacaagagtttccaggtaatatgctacatatagtgaaaatcataagttctgaaagagtctaagtgaaaacaaggagcaccctcctattaacaactcagtgatggcatcaactctattgtataaacaacctacaccttaagaggtccctggcaaacagtaagctagctagtctcctggctctccagtcacaatgccggtaaagggaccaaaagtggtaagggatgtgtgtgagaggagacctggattatgtagctcagtcatgtccctaaaaatgccaggctacatggccatgagataaatgatttcatttctcaatctcctgaactccaattttaaaatggcttaattctgactgctaccttgcctcgtggggcttttgtaatagtaaacacacaaaaaacacccaatcattcactaattaatttaacaaaaatttgttgaagtcttaaaatgtgcaaggcactctgctaggcactgggaggtaacaatgcagatatggccctcctcttacagagtttccattctggtggggaagtggggtgctgctacaaatgagccataaataggcaaagtggtgagaaccacaccacatcaactacaaccattctgtgtcagaagcaccaggtcagaaacccaggtgggtgatgtgcacggtgttcatgagcccaggcttcagaacaagggagatctgtgcttgaattctgatcacattcctttgttaaatgtctactattggtcaatgttcttagcctttataaacctccaatttcttatcttcattgctggctgggcgcggtggctcacgcctgtaatcccagcactttgggaggccaaggcaggcagatcacaggctcaggagatcgagaccatcctggctaacatggtgaaacccgtctctactagaaatacacaaaattagccgggcgttttggcacaagcctgtagtcccagctactagggaggctgaggcaggagaatcgcttgaacctgggaggcggaggttgcagtgagccaaaatcacgccactgtactccagcctgggagacagagcgagaccccgtctcaaaaaaaaatatatatatatcttatcttcaatgcttagctaaaagggaggctgtgagaatcaaactggatgaggtgtgcatgtgttgggtatccccaagaccaccaccaggtttggtgattcactaggcatacccacagggctcagctaaagtttcactcatgactatgattcattacagcgaaagggtacaaaacaaaatcagcaaagggaaaaggctcagggggcaaagtctagaggaaacgaggcagaagcttccatgagttttctccccacaaagtcacacaggacactcctttatccagcaatgagttgtaacatgtataaaaaggctgcctaaaacagaaactcattagagactcagtgcccatagtttttaatgggggccagtcatgtaggtaccttctgcctggcatataccaaaactccagattcccaatggaaagcattgggaataaaccatactgttttcaagaacagtttaggcagagtgaaccactcttatcagttaacggttgactggatgttcccagataccagcctggggccaacttacatgcagaccttcctcaggacagcaatttcaggtccatgttatcttttggcacagtgtgcagaatgctgcctatcacccagcttggtgcatgatgaattagagtatttactaagtacttcctattaactttgtacctgacatttttgctgcatttaaaaatgaagacaaagaaggaaaatgaacttcacattcctctattccaaggacttgcctcacccacatttctgattctgccaagagtgggccttgccttcagggtatgacaaccaatgtatcttactggcaaaaaacacaacagcaaggaagaggtttacactgtggcttatgtgcatgagggaggaaatgttccttgaaacttttatcgtgcttataattccctccaaatcaatcatggctgcattttccagatagtttttattgtggagactgctcttggccttaccctgggccattagctaacaaaagtagttgttagctgcccaaaataaccaatctcgcacagattattagatttttatcaaaaggggcactatttgacagtgaggaatttaggacttttctctgttccttcctgaatctgctcagctctcatctcttctcattgatccttggtttgtctccacatcaaagcccaggggttcctggctcagaatctttgccctaaaaaaactgctatatggtagtgttccttaggattatttttaaccaaacatgcttgtcctgaagctgaataaatgcaaccatgagtgatggtctttcaagttgtgaacgccacatcctttttgtgtttggtgtgagtttatggagaagggggtctccttttatcttcttgggtatcagaggatctgacactgtcagctttcactgagccaaggcccccaagtgatagaaagccaagaagaaactcaaggccatgaaccatagctgcatcattgcttaactgtggaagatcccagggttcccatgaggtgtgttggggaatgggcttcatgctttctggaggatagcagtgagaagagaagcagtgactttgaaggtaaaagggtcccctaaaggggccccttttctatcaggagaaaaatgagagatttgaatctgggcatggagaaagaagtttttcatctccccccttggatgtggactagccaggagccccgccccacagcctctttctcttccccattgatgaataaaacacaaactataaagggacatagattaggtaaactcctaaaaatgagtaaataaagcaatgaaagtatccattattttcccacatctagtgcctttttacctcatgaacaaacaaatcatacaaaaataataaccaaaatttccttatttaaaataagtcaaccttcaaccagacgtgtatctgaattgacaaagttgaaagtgtttgctaagagaaatcttgagatgccatatgtttggggtcaaggcagagcgctttaggcagaaagcattctcacactgtagatactcttccttttaagtattcggttttattttatttttaatttttgtgggtacatagtcggtatatatatttatggggtacatgagatgttttgatacaggtatgcaatgtgaaataagtacataatagaaactagggcatccatccccctcaagcatttatcctttacacatacactggcctggcttgtctccccacccaaatagcagtcactgtccaaacactttccccttcaacataaaattacctatgacacagaatatgtccagttagactcaggagaatgctcactgaagtccttagagggactactacccaatgacagaaacagtgatggcagtggtggtggtcggcagtagtggtagaaatcatgacattctttcattaattgtatggtactttaaacaaccacataacacattcatatgttcttattaatataaggaaggcagagcaaatgttgtcccttatttttagaacaaggtaatagtctgtgtaggattaagactcataagataaaggaaaaaatcatatgggtacatttgtgccagagttgaaatgagaaacactcatctgttttcttccctttgaactgacttgtctccagaattaccagggaagcaaataaggacggctagatggcctgaaaaatcctccaccaataagaattcaaggcccccaggctgaagagatgtctttgctacagttgtggcttaagaacttcgtatagaaatctcttcaattacttgttcttatcaaattgatgatggtggaaaccaagaaaatgtgctctgacataataggagagatttacatattttagttggatttgtttatgtaggaaggattaaagaagagaaagaaggagggaggaagacagaaatatagaaaggaaagtaagggaaggagttaggaaaggagggaaaaagggagaaaaaatcttgcagtgttaaaaaactatttacctctcagatgcaacaccgataccttaacactttttttttttttttttttttttttttagttaacatgaagttttgctcttgtcgcccaggctggagtgcaatggtgcgattttggctcactgcatcctctgactcctgggttcaagtgattctcctgcctcagcctcccaagtagctgggattaaaagcggctgccaccatgcccagctaatttttgtatttttagtgaagacagggtttcaccatgttggccaggctggtcttgaactcctacctcaggtgatccacccacctcagcctcccaaagtgctgggattacaggtgtgagccaccgcgcccggccgcattaacactgtttcatcagctttgtcctcttctcattttagtttggaaagtaaaatcctcacttattgcctagggtgtgttcatgtatattcttctacttgctagtttagaatatcatgctgcttatatcagttttctgagggaaaaaataagaagcttggttacctttctgcaagcagatttcttattatttgggaacctggcatttgtttctagtttgatttagggagatatacttttccctgtttggaaaacagccttgccagtttctgaatgacacccactgtatactgcagatgatgaggcacaatggccaattgttgaaggagatggaaacccattaacaatcaagaataatggaagagccttccatacaatacactgaccccaaatcacaatacaggctaatcatcaataacaaaatagactgctgtttatcttcccatttattggctaagtgtctagtaaatcagctttgtccttgtattagaggttcataagcatctgtggttagacttatcagatgtaaatttagttcagatgccactcaaaaaatctgaaacttgatttgagttccctgttatattcagtacttcatttcaagcgtgtatacacacctcccaatgtatatggttttgtgacccttccttttttacaggagatgcgaatagaatttaaggttaagaatctaggggtgtgatacagtttgaccacatccagaatataaacactgactttttttttctgtttccttaggtcctgtggagcatgttcatctccgagttccatttgttgccataagaaataaggaggtcaacatcagtgcagtcgtgtggcccagtcaactggggacccttacctatttctggtggttcggcaatagcacaaaggtttggccctttctgattgatgtcaaattagatctgtactgaatgctcctatgttccagcttttatgtgtctattagggggcactgagaatgcaggcaataagaggtacttaataaacctatgagcccacaaaattgaataaaacatacctctttacaccaagttcattactttattagggaaagttcaaataatcctaaggaagaaagagtactttgagaaactctgcaaacctgcatgttcttgcttctctaatcaatatttctaaaatttcattcgttccattttgctttaatcttggccttggcctggttatataatgtcaaagaagttacttagcatctctgagattaagtagccctatctgtctagatatctaaatgtagggttgccaaaattaaacaagataacccaggtaaagaatccttatcaatacttactagttgttctagaaatgctagcattcttttcaggcaaggtgctgaggttgccacgtctcaaagaaaggaacaaaagaggccaaactctggacttgccatatactccctacttccagccatggtgatggcaacacctgtgtcaagcatgaccacaattgtatgatagaagctgggagcaatttggctgagaattcctcagaggtaatgttcttctctattcctgttttataaagaacacttcatttttgaggagttgtaagttcacagcaaaatcaacaggtggtacagagattttccatatatcccctgcttccacacatgtatagcctcctccattatcaacatcctccaccagagtgttacatttgttgtaatagatgaacttacattaatacatcattatcactcaaagtccatagtttactttagattcatttctggttttgtagattccataggtttggataaatgtataatgacatgaatctaccactatagtatcaaaaagaagggtttcactaccctgaaaatgctctgtgctccacctattcttacctgcctcctccttaatccttggcaaccactgatatttttactgtctctgtagttttgccttttccagaatgtcatatagttggaatcatatagtatgcactgttttcatattggcttccttcactaagcaatatgcatttaagtttcctccatgtcttttcgtgtcttgatagctcatttcttttcagtgctgaataatatcccattgtctgaatgtatcacagtttatttatccattcactcattgaagagcatactggttgcttctaagttttggcaataatgaataaagctgctataaacgttcatgggcaagttttctgtggacataagttttcgactactttggataaatactaagagcatgatttctggatcttatggtagcaatatgtttggttttgaaataaaccactaaactgtcttccaaactggttggaccattttggatttccaccaccaatgaatgagagttcttgttgctccacatactcactagcatttggtggtgtcatgttctggattttggtcattctaatagccatgtaatgatatcacatttttgtttaaatttggatttcccagatgacatattatttagagaaatttttcatatgcttatttcccaactatataacatctttggtgagttgtctattaaggtctgtggcctatttttaaatcagattgttccattacttattgagttttaataattctttgtatattattggataatcttttatcagatatgtcttctgcaaatattttcttccactctgtggcttatcttttcaacttcttgatagtgtcttttgtagacaaaagtttttaattttaaggaagtccagcttatcagttctttttttcatgaatcatgccattggtgttgtatctcaaatgacttctccatacccaacatcatcaatgttttctcctatgttgtcttctaggagttttatagttttgagttttacatttagatctatgatccattttgagatcattttttaaaggcataaggtttatacctagattcattttttttggcatgtggatatccagttgttcaagcaccattttttgaaaataccatttttgctccattgtattaactttgctcctttgccaaaaataagttgattacacttatgtgagtctatttctgggctatttatttggttccattggtctgttttcctgttttttttcaccaatacaacctgttttgatcactgtagatttataatagatcttgaagttgagtagagtcagttcttcaactttgttctccttcaattttatgttgactattttgagtcatttgccttgccatatatactttcaaatcactttatcaatgtctacaaactaacttgctaggattttgatgggcattggattgcatctatagatcaaattggtaagaagtgacatcttcacaatattaagtattcctatccatgaacatggcatatctgtttatttagttgttatttgatgtctttcaacagagttttgtagtttttcctacatggatcttgtacacattttgttaaatttatacagaagaatttcatttttgatggtgctaaagtacatggtattgggtattttatgtttttgttttaattggtatgtaacactactgttttttatatgttgattttgtattccgcaactttactgaatttgttgatcagatttaagagttttttcatggagtctctaggttttctaaatatacatcagcaacagggaaaatttgactctttctttttaaatgtagattggcttttatttttttttctcttgcctgattactctggttaggacttccggtcctatattgaataggagtggtgaaaatgggcatccttatcttcttgttctaggctttaaaggaaaggctttcaacttttcctgattcagtatgatattaactatggatttgtcatatagcctttactacattaaggtacattccttctatgctggttttttgagactttttatcattaacgatgttaatttcatcaaatgctttttctgaatctattaacatgatcatatgttttttgtcattcactctattgatgcaatgtaccacatttattggcttgtgtatgttaaattatacttgcatccctgggataaattcaagttgatcttgatgtatatttttttctgacgtgctgttggattcagtttgttagtatttcattgagaattttcaatcctatattcatcgagcctattggcccatagttttctttttttgttgagttcttgcctggtttgagtatcagggtaatgctggtcttgtagaatgagttagggagcattccctcctcttaaattttttggaatactttgtgaagagttgatattagttcatctttgaaagtttgatagaattcagcagtgaagccatctgatcatagacttttcttttttgggagactttttgttactaattaaatctcattatcagttattggcctgtaatcaggctttctatttcttcctgattcagtcttggtgggttgtatgtgtctaggaatttatccattttctctgggtttttcagtttcttagtgtatatagttgttcataaatgtctctaatgatcttttgtgtttctgtggtatcagttgcaatgcctccttttccatttctgattttatttgagtctttactctttcttggttagtccagcaagtggtttgttgattttgtttatcttttcaaaaaaaccactttttggtttattgatcttttgtattatttttttagtctctattttgtttagttctcctctgatctttattatttcttatcttctactaatttggggttttatttgttcttgcttttctagtttcttgagttgcaggttgtattatttgaaatccttctgcttttctgatgtaggtaattattgctataagcgtacctctcagcattgcttttgctgtatctcataggttgtggtatgttgtgtttctgggtttttttgtttcaaaatttttaaaatttactgtgtaatttctttcttgacccaacattcagaagcatatcatttaatttctatgtatttgtacagtttctaaagttcctcttgttattgatttctagatttattccattgtggtctgagaagatacttgatatgatttcaactttacaaaatttgtttagacttgttttgtgtcctaacatatggtcgatcttggagaatgttccaggtgctgatgagaagaatgtatattctctagctcttggataaaatgttctgtaaatatctgttaggtccatttggtctaatgtgcagtttaagtgaaatgtttctttgttttccgtctagatgatctgtctaatactgaaagtggagtgttgaagttcccaactataattgtgttggattccatctctccctttagatcaactaatatttgctttgtatatctgggtgctggggtattgggtgcatatatgtttagaattatgatatcttcttgctgaattgatccctttatcattatataatgatcttctttgtattttttgttttttatttttttttacttaaagtttgtttctttgatataaatatagctactcctgctaattttcagttttcatttgcatggaatgtattttcccatccatttactttcagtctgtatatgtcatgacaggtgggatgagttccttgtaggcagcatattgtggtcattttgtgtgtgtgtgtgtgtgtgtgtgtgtgtgtgtgtgtgtgtgtgtgtgtatgtgtgttttaaatccatttcattagctttaactttactgaggaaagttaatttgcttactttcaaagttattgatatgtgagggcctatttctatcatttcattaattaatttctggttgttttgtatacctttgtcccttttctttctctcttattgtttatcatagtggttttgttttgttcttcatagtgataacatttgaatcttttatcttccttttttgtttgtttgttctaccagtggcttttatattttcatgtgtctgcctgcctgccctgccctccatcactccctccatccctcctttctttctttccctttctttctttctctcttttctttctttctctctttccttctgtttcttctttctttctctgtttcttgctttctttcttgctctttctctctctttctctctttccctcttgctttcttgatttctttctttatttctctttcacaggattttcttaagaatttctaatatggcaaatctagtggtgatgaattccctcagctttgcttgtctgggaaatatttcatttcttcttcatttatgaagaatatctttgctaggtataatattcttggttgacagtattttcctttcagctgtttgaatatgtcatcctattctctcctggtttgtaagatttctgatggtaaatccactcttggttgaatgggggctcatttataagtcactagatgttttcctttgcctattttttgaattctgtatttgtctttgacttttaagagtttgactataatgtggcataaagaagatctttttactttgcatctttttggaactatcggagccttctgaatctggatatctaaatctcttgctagacttgggaaaagtttcagcaattattttgttaaattgattttgtaattatttcattttctttttatcttctggcataccggcaatttgaatatttgctcattttatcatgttccatatagcacataagctttgctcatttttaaaaattgtttccttaacatttttgtttgagtgggttatttccaaaaacctgttttcgggatctgaggttctttcttctgcttgatttagtctattaaagctttcaaatgtattttgtcattcatttggtgggttcttctgttcagaatttgtcttcattttttttaatagtgtctctttggtaaatttctcattcatatcctgaattgttttcctgatttcttttccttgcatttttgaatctctttttatctcacagagcttctttcaaatcaatattttgaattccttttcttggattttataattgttttgtttgattgggatctgttactggagaattattgtgttccttcagagttgtcactttttcttgctttttaaaatgttttctgtgtccttacattgatatctgtgcagctggtataatggttacttcttccagttttttgaatttgcttttgtagggagggactttttcctgaagatgtttttatggtgttggttgaatagggcactttggctttgattctgggtgcatgcattagtatagtgtctgtgtgatttattttgccttaaatagaatcagtggcagctgtgattcccttgctggattggaggcagttattagtggaggccatggaaattttttgctggggactgggatgtcaggtgggccagggtctggggtcctagggtagcagcagtgggctgattatgcctatttaggggcctcagagcagtgtacgttggccttggtgttagaaggcccaactgcactgattcctgggccttcaggtgtcttgctggtagtcatagtggtgcaccaggtgggtgagtgggttctgtgccccttgggcaggaggtgtggtgtaggtgatagtagtagcaatggcaggataaccctctgtgtcttgagcagtttccactgatgttagtggtggctgcaatgggttagtggtttagtcttcatatctacaattagtgaatacagatgggtgccagctctggtggtagtggtaggatggtggacccaacctggtggtagtggcagggtggtgtgcccaacctcaggtgtctgggaggagtgctgaggtactggttgtggtagactaggcagtgtgatcccgagacccttgtactctcagattgagtcttctggcttcaggggaggcagagccaggctaagaagtcctaccctcaggctccctggtgttgtgtgcaggtactggctgtggtagacagtggtagggtgatctccaaaccccaggtgggatgcttaggttggggagtgggagtggttatgctgctgccctgctactggagagggcaggggtgcttttagtggtgggcagggttgcttttagtggcagccatagtcaggtgggtgggaaatacatattttgcttgtatcttagcctaggtggcagaagcttatatttcacttgcacttcagccacctcattggcaactggttcttcactcatatcttagccttgactgtagcagcccaaacttcactaacctcccagcccacggcagcagcccacagtaatggcagctatgggtggggagaggggttctgtctgggtgcaataaatgcacagtggctctgatgctggtggcaagtgtgatcattgccagtggcctgtgccttagtccacatagcagcagctaggtgcagtggtgactgtctgtgggggatgtcaacagggctccaggaataaggagatgtagtcgctgttgggccccagagcaaggcaaagtctgttgggagctaggttctcaaaatggcaccttgctgcagctgctttggacttgggatgtgtggaactcagtgtgagctccctctctggagcacggatattgcagtctccagggagctgcttatgtcagtttcagggcccacaatggtcaagaggctctccagtggctagggttgtaggagtccatggtgaggatgtggacttctggaggtctctcacttgcccttttctcatattggggagtccctttccacattggggaatctctccaaactcctagccgatcctggccaagcaggctgccttgcttccatgtccttcactgctttatgtgcttcctgttacttctctgttgaactccaggattctttcttagatgacctattcaaagtgtgattgtctagtcactatttttgtttcttctttgtggagaagaccagtatgagctgcctttggtcagccatctttaaactccttggtatcgtgtttttaattcaaatcacacttgttcattgctggtatacaggaaagtgatcaacttttatatatgaaccttgtatcctgtaaccttgctataattatgtattagtcccaggagatttttgctggttgttattgattctcttagatgcctacataagcaatcatatcatctatgaacaaatagttttctttcttctttcccaatataacttttgtttattttcttgtcttattatgttagccaggacttccagtacaatgttgaaaagaagtggtgagagggaacgtccttgctttgtttctgatcttagtgggaaagcttctaatttcacaccattaattatgatgtttgctataggttttttgtagatattctttatcatctcagggaatttcccctctattctaagtttactgagagttgttataaatgggtgttggattgtgttaaatgctttttctgcataggttaatatgatcatgttcttttttctttagtctgctgatgagatggattacattaattgatttttaaatgttgaaccagccttgggataaattctcatagtggttatgtagtataattttttatacatgattggattcaatttgctaatgctttattgaggatttttgcatctttgttcctgagaattattgatctttagttttcctttcttgtaatatatttacctgattttgatatttggttacatttggtatttggtatttggttgatggttgattttggtatttggttcattaaatgagttagaaaatattttatcctcttctattttctgaaaaatgatgtggaaaattggcataatttctcccttaaatgtttagtagaattcaccagtaaaaccatctgagcctagtgttttctctttagcaaagttattaattactgattcaatttatttaatagatatagttctattcaaataacctttttcatcctgtgtgagttttaacagattgtgtctttcaagaaattgatctatttcatctgggttatcaaagttgtggccatagaagtgtttatcatactcttttgtcaccattttaatatctataagatttgtagtgatgtcccctctttcatttcggatattagtaatttgtgtcccctctcttttttcttaattagcctggccagaggcttattaactttattgatattttcaaagaaccagattttaaaaattgattttctctattgatttcctattttcagtttcattgatttctgttctagtttttattatttctttttttctgcttaccttggagttttttttttcttgtttcctgagatgggaggttagatgactgattctagatacttctttttaatatatacactcaatgctataaatttccttctaagtactgcttttgctgcatcccacaaatgttagatttgttaaattttcatttagttgaacatactttttagtttctcttgacatttattttttgactaatatgttatttagatgtgtcttgtttaatctccgtgtattttgggactttctagttatctttctgttaattatttattgctcaatttaattgtgttctgagagccgacattgtatgatttctattctttcatatttgttaaagtgtgttttatggcccaggatgtggtctagttcagtggatgttctatttgggctttagaagaatgtgtattctgctgttgtctgataaagtaatctatagatgttagttatatccagttgattggtggcattattaaaatcaactatgtccttattgattttatttctttttttgtatatcactcatactttaaaaaaaaaaaactttttaaagtgattgccctagaatttgctatatacacttacaatgaatccaagcccattttaaataacactataccacttcaatagtagtgagagtggcttttagtaaaaataattctaaattcttgtctcttgcctcttctctcactgttgtcactcatttcacttgtatgtaaacatacataagatatatacataagtatacataatcaaataccttgttggtatgtttatgttgaacaaattttttttctgttaagtcaattgagaataatacttttctttctttttttaattatactttaagttctggggtacatgtgaagaacatccaggtttgttacataggtatacacatgctatggtggtttgctgcacccatcaacctgtcatctacattaggtacttctcctaatgctattgctcccttagccccccacccctccttgacaggccttggtgtgtgatgttcccctccctatgtccatgtgttctcattgttcaactcccacttatgagtgagaatatgcagtgtttggttttctgttcttgtgttagtttgctgagaatgatggtttctagcttcatccatgttcctgcaaaggacatgaactcatccttttatatggctgcatagtattccatggtgtatatgtgccacatcttctttatccagtctaccattgatgggcatttgggttggttccaactctttgctattgtgaacagtgccacaataaacatacatgtgcaagtgtgtttatagtagaatgatttataatcctttgggtatatacccagtaatgggattgctgggtcaaaaaattttgccttcatttattcttcttcattgttctttctttcttcatgtggttcaagtttctgacctatatttccttctgtctgaagaaactttaatgatttttgcaaaacagatctactgacaagtttcttaagtttttctttgtttgagaaaacattcttttcttcttcacttttgatggataattttgcagggtacggaattctagattggtggtgtttttttccctcaaccctttaaatatgtctctctactttcttcttgcttacatggtttctggggagaagttggatataattcttatctcttctcctttataggtaaggtatttatttcttctagcttctctcatgactttttttcttaatctttgattttttttgtagtttgaaaatgatacatctaggtgtagatttttcagcatttatctgtctcagtgttctctgagttttgagtgtctgtggtttggtgtctgacattactttgctatgattctcagttataattatttcagatttttttctgtttctttttctgttattcacattacatgcatttataccatttttagttgttcctcattcttggatattcttttcctttttttttttttactttttgttgtttttgcttttcagttttggcattttctgttgagatgttctcaagctcagagattcttcctcagctgtgttcagtctgctaaaaacacatcaaaggcatttttaaatttcaggtacagtgtttttgatccctagcatttctttttttttcttagaattttcaactttctgtttacattgctcatctgttttggcatgctgtctaccttatccatgaaatcttttagcacattaattaaatttgtttgaaatttctgcactggtcattgcaacatccctgttgtatcagactctgatactttctctgtgtcttctatgttttttccctttagtatgccttgtaatttttttcttcacagctggacatgatatactggtttgaaaggaatggctgtaaataagtctttagtaatgtgatggtaagctatggaaggaggggaagctttttatcaacctgtgattagttctcaggtatttacaggtgtttctgtttgttctccctctcctgatccctcaggttgattagattagctagagtgggctgtaggtaggtatctatgttctcccacatggaaggataaagtgggctggtgttgtgtattttacttcccgtagcttagttggactataaaacccctgaagtttagtctctgatttataagtttcttctgagagcagaccttgttaaaaagaatgtagtgctctgatgtgtatttcagaataattattttccccctcccctgatataaccatatgggcaattttctttaacatttgttgggagtatgtggtcacctactggtgataaaattcacaaagtgaaggggcttcctatgaatccccctggagttttgaactctcagactgtgtgtgtgtgtgtgtgtgtgtgtgtgtgtgtgttttgaaaactctggttttttttttttaaactcataatgtgattggcattgcttatcctagagaaagctttaacttaaaaaccataatttaagtaaggtacgacctcagacttggaaatgctggatatctaaagagaagggaaataaatattcagtttctggtggataacaactgaagagaaggtcaccccatccttactcctgcataagtgggagataacttatccccagtcttttttagggaggcagcacgatatagtggacagaacatggaccttggatttagggtttcatgggttaagtttctagaactgctacttcttagttgtgtgagagcttgataaagttatctgtcctaagatgtaattgactcaccataaagtggaaataataatgcctatctcaactttattgttgtgaaaactatgctattttatagcataaatatatagtaaaactatactatttacttggcacacactatgtactcaataaatgggtgcttttcatgatgttattagaacttatatttagcatgggttggtaaaatatagagcaagattcatggaccaaggaacccttttctgtttgcattatatgtgcctcatattttcaaattagtttctccgtatagatgactaatgcacttgcatttctgggattattcttcaccaggaaaacagaaggataggtcatttaataaaagccctatttggtacatttgagaagttaagctccctgtctgaggtgaacatcccaaattcaaacacttggttagttgcagagccagacctcaaaactgggtctactaattcccatttatcatgcactctccccagtcccagatgctttagctgcactactagaggtgtttatctcctggaggttacataatctaaaattgtgcctcaaagaccagcagatatacatagtgaaggaaaaagagaaaattgtttagggagaagttagaaagaggacgattttaagttcatttctcctgtgcagatgtgagggtttggctgtcaagtcagagaattctttcttgttctagctcatttacctgatgatgatcttttctaagaaacttctgtgtgcaagaagggcagttcttgactgttaccaacacagtgatttacttaggggcctgtgaggaatggaagacacaatgtttctctacagctctatttttttctttgagtgctgtttctaagacctgaaatgccatgcagtgtctgataggtatatgactaaaaacaaataaatgaacaaagcaattggggattctagtttatacttctgtaataattatctgtgttaaattgaatgagtcacttaatttgagtttgtatcgatttctctaaagcaaggatactataatatgtaatatatgaacatgacttagttattatttgaaatctactgtgtatctctctgtctctccacttctctatcaagcaatcaatctatctatctatctatctactacctacctcatatatattatgccatattatgagaaggcatttttaaattacatactggcattataattttatgttttttaattaatggtgacgagaggtatttccttggttaggaatttttaatccaaaagcttgaacatgaaatgctgcacaaatacccaggtcccaaaggtcttactaagtggttttgttcccaaagaaccaagagaatgacaatacatgagaggcagtagaatggagtggttgcagaacaagacaaacctaggttggagtccagaccgaatcttctttgctgtatgcctttagtgaagtcaaaccatttaatttctttgagtctcagttttattgttggtaatgtctgagtaataacagtagtatctatgatcaagtattgctgcaaggattaagtaaagaaaggcgtagaaagtgtttagaacacatccgagcatttggaagtattagtcactgttgtgcccatcatttgcattaatagcatttgtatttaggctaaaaacctgacttggttccacagattacagtttaatttctaaaaatgtttacttggtccatttgaaagaggtgcattttcagtgcagtgctatttgctaacaccatgccagaaacacatcaagatggccatggtccccagtagttgatccagtgagcactatatttggctggcaaatgaatgaatgtctctgcatatatggggagtgccgtgattttagagctgtttggttccctttgaccagcaaactgacctgtaaaaggaactagtactaattttgagcatatatttctggtacgcattgtgtactgagggattttattgttatcagaacatcactgatgaaatagaaattatccccttttacagagaatacaattaaggaaataaccttggaaggtgatgttttatggctgttttatgtgtttgtgttggtgtgactaggttactatgtaagtagttaaattaaatcatcctactgataagagtgaattggcatcctgctttataatcagacttttgctcgttgatattagggatagaaaaacacatatgacattctccataccttcaaggagattatgtccccaataagaaagcacaatgagcacatatgcaataattgacaagcaaatagattctataagcaaacaggaaagagcaagaatttctgaaatccaactgtaggctcatgtgcctacaaatctatcagtgggcaatgtgaaatttcatcagtacttttgtggatcttttttaagagcctgtcgtttgtgctacatgttgtgtggaatgcaaagcagtgtaaattccatttgttgctttcaagaaacatgtaatctatttgagaatataaggctaaaattcaagaatagataaaagcaggtatgcaataggaatgtaaaattactggctaagtcaggcaggctggggagtgatggatatgcagacattgttgatcatggagtgagtgagtcatatacaaagttgagcctaagctggcatggaaggagcagtagaattgaggcagagaggaaagagagggatttttgtgtggaggtcaggctttggggatgatagactaattcagccaaagttaaaggattcatttgggcagaagttggagaaaacgctgaaaggtgaggaagacagatgacagatggctttgaatgataaaaattgatgcttttgcttttgtcacaaaaattctgatttagggcagcatgatataagatagaaccagattcatggacagtaatactttagacagatactgtcaaagagtttttagatgtatttaagtgcgtatgtttgtgtatctgtatttgagggaaagtgcttttttaacctgtgaattttcacattaatcccataggcataaaagtatgggagttttggtttactaccttcaactatttatcatcttttcccacctattaccaccagtcatttttctcctttaaaaacacacaaagacaaaggaataaagccaaatagaatctataactatcactttagctttaaactactagtttactgtattatttggctttatttctttgctttattctttaatagcatccatagctactagtttagttttaaactaaactagtgaatagaaccatgaatttggttccatcttatatcactagtttagttgagttttagtttaaaactagtagctatagatagtattttgctttatttctttgtatgttaagattttttatatagttctaaacgtggtagatccacaattatatatccagcctttgtacctcatatgatgagcactttgcacacattactatataatctgctgaaggttttaaataaggcaagcatagtgactgcatagtctgtccaatttgggactggcagctgttatcaaggtatgcattttaagttgcagagattttaaagtgtacaatattaacttgacttactgtgtctgggaaactgatgtaggctgcatccaaagatttccctgcagcttgcttagttccatttgtcaagtggaaatctcataactaaatagtcacacagagctttgtcgatttcttgctgggctcagtggataatatgtgacctgtcgcacatgagggattctctgtggggagggatgtagctcacagcctaggcagggcatgaggtatttttctaaggggcctccctgtgggctggctctgtagattggatgaagcacagagacagagaagtcaatcagctgcctgttggatttgtggggctctgaaaggccaatttgctgggattaacagaggtctggcttaataaatgtgtctgcttgcctaatatatttgagtagatgaaccttaaaatacttgatttaatttagcattgggcaccagatatcagtggctgatgaagaactcaagaatcctgttgagtgttccagctttgcaaggaaggtgaaatcagccatgctgccataacagctgatgagaaacaaaagcaatttggaaaacaaaattagctcctgccattttcccagcacaagagtctgtggcttgccacctggggaccaagtgttcccattcagcacagtttgtttgctgtggctgagtgccctgactggctggcaggagggcacatactctcttacttcagatggcattccctttgccctgcatccctgcacccttgctgggccctggatctcctagggaaacagccagatggaggagacaagatcaaatctgctaggacaggaagaattccatcactctcaaaagagattccattgcccaagacagcaccgaccagctgaatcttaagagagggcagaaaaaggagagagggccatgtatgctactgagagctgaagaagatgagctggaagtagtgaagattctctaaagagaaaactattaagggagaaaaatgcctggtggtgataggtgggaaaagatgagaaatagctgaaggcagtaaaacaaaacggaaaactgaaagaactgtgcagtgaacatcaacatacacaccacctgtagtctaccattagtatttgctatgcttgttctatcacatgtctatctgtccatccttctgcatacatccattagtctatcttgatgctttattcatttcaaagtaaatttaagacacctatattctttgtcctaaatgattcagcttgcaaatcattaaccgtagttgaattttttttatacttttagccctgtgggggtataaatcctatcaacaatggaatgcaaaattcaacagtgtgtacttactgagttttggaaaagacattcacctgtgtaatccaaacttcctgaaagtcctctcatgccccttctaagtcaatctccagcccagtcccccttctcagtcaatctccagtccagtctccagaaccaaccactattctattttttcatcataaattagatttgctggtttggagatttatccatactgattatatacacacacatatacacacacaaacactgaaaaaaatatatatatatatatctatatctatatctatatatatctcagtatttatttcctactaaatctcctactaatgaattcctgggctgtttcctattttgggctgctatgaataagccactatgaacatttatttttttgtttgtatacttgtgtcttcttttctcttgactaaattcttagggttgcagttcccaaatcataaaatatacatatagtacaactgatggaggatttttcttggccccttcactgaactcgcagcagtggtgttccctctacctggcccaccatgcttgtgggagggagcatgtgagcgagttagtgtgggatctggccatacactctgggtgctgacacaggagcaagctccatggagggcccatggccagaccaggtgtatcacctcagggggagcgcagcagccccaggtgagggtgctcacaaccctgaagccccagagggggtgttagagtgcacctttagctctaccatctgcggacagtggcatgttagcagctcagttggccccttgccttgtcatgtggggcagctgccctctgccactgcgagtaaagggccagtgtgacagtctttctgggtacccacactcggtgggtcctgaactcttgtctggcatccaagaagaatgaggtcacatggatggttgaaggatggtgaaggcagagaattttactgagcaatgaaaacagctctcagcagagaggggagctggagaggggacaagaagggcaggtcatctcctccctgacttcaagtcaggctgtctcctcccagaagtcaggccgtcgtcttctctaccaactgagtctggggtctttataggcacaggatggggattgtgtgctgactggtttgtgaatatgcaaaaaaggatcaagtgaagacaccattcaaaggtgggcatgacagtgtagaaaaccaactaggaaagggtaggtatatgtaaagtaggtgaagaatagggatcaatcagagaaagcgcaccaaacagggagaaaagttttcaatccagtccaaagatttaacttgtaacttggctttcaggctttaaaccgtctttagcttggaggtggggtttcactgggtacccgcccctatctgcctaggcatttggctgcctcctgtcactgtcacaccactttggaaaaagttattgcaatttcttataaaactaaacattttcctaaatcattctaccattttacatttccaccaaaattatatgagtcctaattgtcctgcatcttcaatattacttgttatcatttatatatatatatttatacatatatttatatatatatttatacatatgtttatatatatatttatacatatatttatatatatatttatacatatatttatatatatatttatacatatatttatatatatttatacatatatttatatatatttatatatttatacatatatttatatatatttatatatttatacatatatttatatatatttatatatatttatatatttatatatttatatatttatatatttatatatatttatatatatttatatacatttatatatatttatatatatttatatatttatatacatttatatatatttatatatttatatatatttatatatgtttatatacatttatatatatttatatatatttatatacatttatatatatatttatatacatttatatatatttatatatatttatatacatttatatacatttatatatttatatatttatatacatttatatatatttatatatttatatatatttatattttatatattttatatatttatatatttatatacatttatatataatttatatatatttttatatataaattatatatatatttttatatataaattatatatatatttttatatataaattatatataatatatgatatataaattatatatataatatatatgatatataaattatatataatatatgatatatattatatattgtatgatatatattatatataatatatatttatacatgtatttttatatatatttatacatatatatttacatatatttatatatatttatatatttatatatatttatatatatatatttagccattctgttgggtgtttagagatatctcattttctttttaacgaatgtagcaaaggtaatgaaccaattgaaggttttgtgtcagataagacctgatggactgaccaatagaaactagaaattttgcctaaatccatttgtcaatgcaacattctgattgctgagtcctcacagatcacctaacccaaaccactcatttaacagataaagaagtaaaggccagaatgcagacaaactttgcctaaggatattgattcaaacagtaacagagtgagtttcaagtcactgttctaattatactagaaatggtgactctgtgccacacatgttgatattcccttattccatggccctgagctatgctcagcccagcttgacttcatctctcttctccaaacaggaccataaacagccactattgaccctttggattttatatgcatgtcagaacctgcttacacctcatttatcgattaattcagaaggtcacacccatgtgtgtgtcatcacccagtcataagtatgggaaagaatgcctgaactctgaggtttgcccttagttaagggaaggagtatatccctttccatactccctttcttctttcatttaccaaatagaaaagaaatatgccagatgcttaggacagtatctgtaatcctgcccaactccagccatcaacctcgtcataaaacagagctatagaattttaaagcagaagaaattaaattattgtttcaaggccagttgaaaagtctgagctagaaaggaatttcagtattacagtagggacaccatctgaaagctgcagctgggagcctctgcagggttttgtacacatgcatccaagccatacatgggtatgttgtgaaggactgtcctgcccctcttaaagggcagctctgtgcttctgcagctggctacattgctactctccatcctgctgtcgtcctgacacaaagagaggagagagagtctgctcatctgcccctgtgacatctctttatcagctgccttagatcagcctccaactgttacgtcttactttccaaacagtagagaatttgagagggcactgactttaagatgcccagtgaataatgactcatcagactgaagatctgtactctcttctctccaataagcatctgctttttaatcaagattcttctttccaggaaaaaaaaatatatatatatatataattagagctgacccttgaacaacaagggtttgaaatgtacaggtccacttatatgtgggttgttttttttcaagaaatacagtcagccctccatatcgtcaggatccacatctgcaaccaaacttagattgaaaatacagcatttgcagaatgcaatacctgcagatatggagggtctacagtgggattggagtatgcatggatttttgtatacacagcggtcctggaaccaatcctctgtgaattctgaggtatatctgcattctatttctgtcttcatccttgagaacttcctatatgttatgattattgggggaaaaacagaaagaaaaagattaataaatgatcacaaatatgtttttttgtgtattttccaacctattaaaaatggtaaaaatgccttgcaatgggaaacacacatataatataaaaagtcagtaatctgatggtgcatctaatttacatatattttctgctctatgaaaggcaatgtgcggccgggcgcagtggttcacgcctgtaatcctagcactttgggagactgaggtgggtggattgcctgagctcaggagttcaagatcagcctgggcaacacggtgaaaccccatctccactaaaatataaaaaattagctgagtgtggtggcatacacctgtagtcccagctactagggaggttgaggcaggagaattgttagaacccaggaggcggaggttgcagtgagccgagatcgcatcattgcactgcagcctgggcggcagagcaagactctgtcaaaaaaaaaaaaaaaaaaagacagtgtgcttagggtgggtaatacagaagtaaataactatgtgatcacttctcagaaaggtctcataatccagtgaaatataggatgaaaatataagtgacaccagatattggaggagaagggaaatgatctcctattcccaaagtcaacagggacaggttacaaaagctgtttctactttgccccaggagaaggagcagaatgacatgcaaaatccaggatgcccagtcttatccttatttctagaatttaataatttataatgtgtttcaagtatactaatactcttcctagatactggaagaataatcacagttttaagaaacggtataacgtttgtttgtttgtttgtttttcttttccaagttaggatgacagtctgagagtttcaggaaaggaaataaagttgatatcccacacaagactgaatgagtattgttacttcttcttgtagcctctcatcactttggacagcagcatttccttcacattccttgcagaaggaaccgacaccatcacagtccaggtggctgctgggaatgccctcatccaggacacaaaagagattgcagttcatggtaagccctgaaaattgttctgtgatgctccttcccgctcagttaatctcctgtgtccactctccctacaatcattgagtgtggtggaaattcctcaggccctgggaaaattacataggtcaacaggaagcttccaaacctacctccgacctagagattgaggttataagagacgtataccacaaacaggtatttgttgtcccctgtgttatgtctgcctcagaacttgtttggggttcttattagacaaagacacgtatcacaaattgaaggaaatgcaagctgggaggtatctacaacatatatgcaggacacactctttgtgagatgaggaccagcaatttccaaaagtcaggagtcatgatccctgccttgtaggactcattgctcagttaatgagatgatctctattcacaacagatggctttcttgattgttggagatttgaatatcattggctgcaaaactagataataaggctaagaatataagttaggactagggcagaagagggtgaataggactactatcctgttctcaaccctggagaaccactgttaagtttattacaaatgaaagtgcctctactgccatttcacacaacctctcccaggtccctagacacaaccagtatcactgtggttttcttttcttttctttttttttagatttttcattactagtttgatttctttaatggtaattggttttttggttttacatgtcttcatttcatttcttcatttcttcttttttttatgtattatactttaagttttagggtacatgtgcacaacatgcaggtttgttacatatgtaatgtaaatatcactgtggttttctagaaagttaagtgaaggcttgtgatcctctgatcagattatgttcctccagcctcacaccaggtaaattctttttcctacctttctgcaaacttgcttctcaggctcttcgaggggcacatggaaggtttgtgtgtttctttcaaagtaaacattttaattgtattgtaaattttatacagaagcgtgcagggcacaagtgtttagttttatgcattaccacaaagtgaatgcacttgtatactcaccaaccaggtcaagatacaaagtttaaacctattttctaatcctcagaggcagtttctagcacaatgggtgaagggattaaagaaggagaagtgaaaagactccattccaaccaagtccaaattgttaatgctttgtgttggctcttcctggtaccacctacagtagcagacgtctccttctggagtttcataattgtctttcatttcagataatatacaggaagaaaggcttaagatcttagacactaacaaaaactggtaggagcacaaatctacttttaatcaccaaattctactttatttcagaagtcaggaaacaagctgagaacaaggaattctagcagaagcctggtgaaagagtagaccttttaccaaaagcacagtgatggtggagctccacacctgtcacaccctctctcttctcactctcccagcctcacttaaacattctctctccctgcagaatatttccagtcccagcttttatcattctctcctaatctggattaccacaatcctgacattcctgagtggagaaaagatattggcaatgtcatcaagcgagctctggttaaagtaagttggctttgtctttttttaagttcttgtgaataaagaaaagaactagatggtgtggtccacaatacattggcatggattgaaactgcattccacagttaaagattatttctctgtaaaaagagagagaagaggctgggtgcagtcgctcacacctgtcatcccagcactttgggaggccaaggcaggcagatcacttgagaccaggagtttgagactagcctggccaacatagcaaaactccctctactaaaaatacaaaaattagctgcatgtggtggcgcacacctgtaatcccagctactcaggtggctgaggcatgagaattgcttgaaccggggaggtagatgttgcagtgtgctgagattgcgccattgcactccagcctgagtgacagagcaagattctgtcaaaaagaagaagaagaagaagaagaaaaagcaagaattgtaggattaaagaaggaagaagagaagtataaaagagagtctagttcaatgtttgaagaaggaaactggcccaatgtttattatgaatttgtttgagataggggcttgatccctttaatgcactaatggatggacaactcactgagttgttgctaatattatgcacttgtctggctctttgttcaccaataggatcttctcaaccaaacatttatactcacaagactaccgttggccacagattgcactcagaaggctacaggccaggaaacagagcgttccagcagggtaatagaattacagagttaatccaaggtcaaatttgccttagagaaagtaaaagggttttgttaaacattttctcagaggtaggcactagaatatattgatgaataaaacatggtcaattgaaatgtagaaataagtctaatgtataagcagctctaagctagaggcatggccagcatctctatggggcagagagaacagtatgattcacgctatccagggacatgaagacttggcacagatttgcaactcaataaatacttgttgaactcttggaacatctttggagagaatacttgaactgtgtttgcaaggataaatgtcagttaacaggggcaggatggtgtttgaatgagcagcatgttcaaagtcatggactataaagagtacagcacactttgggaggccgaggcgggtgtatcacctgaggtcaagagatcgagaccatcctggccaacatggtgaaaccctgtctctactaaaagtacaaaaactagctgggtgtggtggcgtgtgcctgtagtcccagctactcgggaggctgaggcaggagagtcacctgaacccaaaaggcggaggttgcatgagccgagatattgcgccactgcactccagcctggtgacagagtgagactccatctcaaaaaaaaaaaaaaaaaagagtacaacatatttgggaaatggcaaagagtttggtgtagccagtctgtaggttataagggcaagtgcagctaaaattgagctaggatggttatgtcatattgtgtagggtttgagagaccaaaagaagcttggcatctattctgtaggcactgggaagtatgaaaagtatgaaaagtattcttttttttatttcagtaagagaataggtttatatgtcagtaacccattctggtggcaatgcatagttggggagacatttcacaaaaggtgaccagctaaaagaccactgcagttatctaggccagaaatataaggtgctcaagaaaaagaggcaaaggctacttaaaaaattgaacaatagaattggtgactaaggaaatgtcgtgtgggtgagaaggagagagaaattctctgataacaagagccagtaggagatggccttacattaatcaagatggggactatgtaggagaaacacgcttgggaaacaatagtgatttgacttttaatgtaagtctggagcacatgagaaacaactggttgaagatgaccaggagggttgaaaatatggatctgaagatgaagcagaggttcatgctggagggagagatgtaagagaagaggctgtggaggttgttaggctctctaaagaggagttgggggacaaggcagacacactgctggtggttccccaaggcagaggagaaagatccaggaaggacatggagaaggagctgacagataggaagaagaataaatagaagagaatgacataggagcattgctgtatggagcggtctgtaagagtaactacacttcaaatctttttacaaagagactattcatagaaagagatgagaatgagggctgggagcggtggctcatgcctgtaatcctagcactttgggagccgaggcaggtggattgcctgagctcaggagtttgagaccaccctgggcaacacagtgaaactccatctctacaaaaataaataaaaaaaatttatccgggcatggtggtgcatgctggtagtcccagctactcaggaggctgaggcaggataattgcttgaacccaggaggtggcagttgcagtgaactgagattgctccagtacactccaggcgacagagtgagactccatctcaaaaaaaaaccaaaaagaaaaaacaaagaaaaaatgagatgagaatgagactgttatgtatgctgtgttagtctgtttgggctgctataacaaggttccataaactgggtggcttataaacaacagaagtgtatttctcataattctggaggcggagaagtacaagatcaagatgctggtagatttgatgtctggtgaaagccactttgcttattcataggcagaaccttcttgctgtgtcttcacatggtggaaagggcaaggtggctctctggggtctcttttataaaggcactaatcccattcatgagggctccacccttatgacctaatcacctctcaaggccccaccctgataccatcacattggatattaagttttgacagatgaatgggggtggggggtgcaaaaacattcagatcatagcatatgtctttggttgcaaggcatccagaattgggttgtgttatgtatggttacgttcattaaaaagatactagctttttaggaaataacttgtaattgcaataataataatcagtcctgtcagttgattctcagacctcaaatctcacaaggaccaatcactcgtatgtccctttggatgggttaaatgaatctgtatacactgctccaaggtctctgtaagggccttggtggactgacactccctgacattgttctttcctgagacaaagggtcacaccagtcaaggcactaataagctcaccacccaacccttcactgcattgggtggttctctgcattttgcccctagtctggcctcctgagacttgctttaaggtagttaaaggcccccagccttatggacttgggcattaggacttaatgctactaaggatcatgctttgaaagaatgttgaggcatctagctaaccatctcaggccgttaagaggatgcctccctggttggtggactctttaggcttctgactgctgcttcttacttccctgcgggctggctctttcacttttctttatcacatccctgagagttaactccaatccgtaagcctaattccaaataggaatcagagctgagcaaatggaaaacaaccaaactctctgcttctgttcaatctagcaactatttatttaatttttactctgtgtcaagcattcttgggaacagtgagaccccagacagaaatatctgggcaatcacaccataagaacctgtattagtccattctcaaacttgtatacccgaaactgggtaatttataaagaaaaaaggtttaactgactcacagttctgcatggctggggaggcctcaggaaacttaacaatcatggcggaaggcaccccttcacagggtgacaggaaagagaagagtggcagagcgaagggggaaaggccccttataaaaccattagctctcatgagaactcactatcatgagaacaggatgggggaaaccacccccaggattcgatcacctccacctgattcctccctcaacacctggggattctggggattactattcaaggtgagatttaggtggggacacaaagcgtaaccatatcaggatctatctgagaaaagactacaccagacagatgtaatcatgtgtcacggtggacatggtctatatctctgaaatgcagtggacatggtcatttggaggtgtttggggtgggaggctaaggtggagatcactgcaggtagagatagtcagggggcactttggaggatgggggtatttcacctgattcacaaattatatatttggattgacagaagaggtggtgatgttctggataaaagatcttcaggagacacacaggaaagaacaagcttacccttcacgggggagaactcagcatcctgttttctttaaaaatttgccttcagacagaagcttacttttaagtttttatcacaaagcaatatcattcttttactaaccactcaggaatagaaaaattcactcgtattctcagcctcttaaccacgtttagtattttgttatttttttcttctatatatttgtatttttatagagttgtaaccaaagaaatgtaaggaaatagattggaatgcagctatcataagtatttttctatgttgtctcatagtacttattatcatcttaatggtggcataatagtctatcaggtgattataccagtatttgcttatttttttgaatactggaggttttcccctttatttactattataagtaatgttgtgttttttcctgcatatggcttttcctatattttggatcatgtctttagaacaaactcaccaagttacagttactgactgaagggtatgaatatttttatggcctttaaattaagtctttcagaaaacaaattggcaatatgtatcaatttctagcactgccagtgccaaatgagggaacttccttcaatgcagtcttaccaatattagctattgcacttaaaaaaaatcctgctttaataagtgaaagcaagtattgctcggctttctttaaatttgcattttcccatgttggtttatgacttctttttcctcatttgcacccagcctgtgtttcagccagaagctctagctctcatagaaaaatggaaaatatgagaggaacttttgccaatgttcccagcaaataatgttttaaaaatcatttgtaataccattctagtttcagtaaaaatgtatataagagcaggggaggtagtgaaactaataatgttttacctagcaggtctaagggaaaaactgaaagaaagcctgaatgtatattggagcctgtgcctaaaaagctgcatttgaaaaactcacatgagccatctggctgtgcacactctgctcttgtcattgatttggggagggctggctcctccacagcctctctttgtctgaacatctttgcaggtaaccagtgtcccagaggaccagatcctcattgccgtgtttcctggtctccccacttcagcagagcttttcattcttccacccaagaacctgacagagaggaggaaaggcaatgaaggggacctggaacaagtaagtgaaagtaaatctggctgggacccttgcctgcaccctacaccctgagagggcacaaagctgttttcagccagaaagggagacaggctctcttccattaccccaacagccaaggttttgaagagcaatcacccttacccagagtaaatacaggtgcaaatagactggagcattcagctactcagaaaggaatgtcacccctggcattattcattccaatgtctgacatccctgtgccagctcatgtctccctcccagtgactcttcctgggattcaggggaaggggagcagcagagagagagagagagagacagacagagagagaaagaaggggggaatttgaatttccttgtttatttctgggactatgtgcctcttgtctttaaactgcactggcccttaaagatcctggccaatgttaagctctgcttctggggagaaaatgaactgccttcaaacatgattttttggagagggatgtattgcctctctttgctttaactaaggaagcaacatttccaaaagggattgtgatttactgttcttatcaaatgggcatatagaactatactgtgatctgcacgctgtcctggaagtaaaggggatggcaggactggtgtttctccttttcatcctctattcctcctgaggtcttaatgcctgcactgtttcacccttcctttctttctcatgatgctaagtcaggtgcaatagaaataagtgagcatgaggctgcagaaaatcggcatgaatcacaaacatttgctctcatatgaggtaatcattgtacagacatattttgtgtccctgtgatactcactggccatcaccccatccttacttacagccatccacagacattgagcggtagagatgtgattgcagtttctctgagaaataatttcttgcattgcagggttgcatattgaagttggccagaaataaatttagcttcttaatgcatacatcacttttacaagacctctttattctgaaatagcaagtggcatgtgtgaactatatttggaagctacaatatccatccatttagataaataggtaattacagtgatgaatagcagctgtgatattaaggcgcatacagcgagataagagttagggacaacagcctaagtcggcctcagctttcatgtgggaattacagagtgattaaatcgatgttatgtgttctgcgacttgctagggaaaagtaaagaacaaaaattatcccataaaaaggaggcagcttctgctttgatgtttgcttcccattgtctctaagatagaaaacgcagaggagagggctggtagtatatgtacctgctttaatcctggcagcggcctacatcccctgtgtctatgacttcatcagattacagagctaatgatgggttgaacttctttcattggaacccataacaggtctttttagagggttataaaggcatggataaaagagcagtgaattaggagttgaatgaaacatctatgtctattatagctctaattcaccagtgactgtaggcatgcctctttctgtctctcactctcctctccagaataagcaaatattaccatctatagttgtctctcagtatacataggagaatggttctaggacttctgatataccaaatctgtgcatcttcaagtcctgcagttggccctgcagaacctgcatgtaagaagttgggcctctgcaacatggtgaaaccccgtctctactaaaaatacaaaaattagcttggcgtggtggcacgtgcctataatcccagctactcaggaggctgaggcaggagaatcgcttgaacccaggagggagaggttgcagccagtcaagatcatgccactgcactccagcctggcaacagagtgagattccatctaaaaaaaaaaagaagtagttgggcctctgtatatgcaggtttcacatcctgtgaatactgtattttccatccacattttgttgaaaaaatccacatagaagtggatctgcggccaggcgcggtggctcacgcctgtaatcccagcactttgggaggccgaggtgggcggatcacgaggtcaggagatcgagaccatcctggctaacacggtgaaaccccgtctctactaaaaatacaaaaaattagccgggcgaggaggcgtgcgcttgtagtcccagctactcaggaggctgaggcaggagaatggcgtgaacccgggggggcggagcctgcggtgagccgagatcgcgccactgcactccaacctgggcgacagcgagactcagtctcaaaaaaaaaaaaaaaaaaaaaaaaagtggatctgcttaattcaaaactgtccgcatgttctcactcataggtgggaattgaacaatgagaacacatggacacaggaaggggaacatcacacacctgggcctgttgtggtgtcgggggaggagggagggatagcattaggagatatacctaatgttaaatgacgagttaatgggtgcagcacaccaacatggcacatgtatacatgtgtaactaacctgtacgttgtgcacatgtaccctaaaagtataaaacaaaacagaacaaaacaaaaacaaaactgtatagttcaagggtcaactgtacttccttggtttcacaaggccccaagggctgtgagaaccaaatcgataaatatttttcactatcttatccctaattgaaccatggtgactttttacctattgaccttgtccttggtttcttaccccatgagggagcatcattgcatgtcatgtcaccccatgcatcctgtcttattttttcagattgtagaaacactgtttaatgctctcaaccaaaatttggtccagtttgagctgaagccgggggtacaagtcattgtgtatgtcacacagctgacgttaggtgagtgccactgggaactggggaaatgggaaagaggatctgttatcccagagagaaaaggaggagagaatcatgaaaccctgctgcataatgtctgaaagtggctttgtagaagggtcctttttgtagttatggttcagaaggattggtcacatcagtcacattgttctgaaggcatcctgcaagaagactttcttaggagtagctttgccattgaatccctagacggtctcggagaaaacctacaatttacttgggtcttaaccttattcgtttgtttgtttgtatatttctttattttgtctgtgacagttgggattatattggacagtcctctagctctcttcattcattcgattatctgattttatgaatcttggatggtaggccacagaactttaaaactcccttctagtttacaatgtgtgagtcaaagtagaaacaggaacaaactctagttggcttatttgtgaaaaaatctaaaaaggcatgtcccattgggcatctactttgggctctctgggaaagcctgtttattaaatggttcttaataatgtaagacttttccaaggtgtaggtcacaaatgtgcccatccagtgggtttttatcagaacagtgtaaaggaagagaatgaaacactgcattagtacttaacccaaaatttcaaatgggctccctgtaattatggtgacaggcatgcagcctatctaagagaaagagcactggagcccttattccactcccctgagctggacatacgttgttcaatttataccaagaactagcaagtttccccaggctgaacagagaagtttactttccctaagaagctgtactcaggtgccattgccatcattgaagccagactttctgcacccagatatcaggcaggggaattggagactagacataaggatggagatcagtggcctccttcctgcaatgaatactccctccagctaacagcttccaagtgagcatatctgttcttttccttatctgttcttctttccaagctccattggtggactccagtgctgggcacagcagctcagccatgcttatgctattatcagtggtatttgttggcctggctgtgtttttgatctacaagtttaaaaggtatgtcctattatcactcaatttagtagtggggttggggtcattgcaaatgattcttcctataactaactttactaaactcatcgcaagaatgtgatttttaattctccttgaacttctgtttgacaatgggtaaaagcaagaatggttgagggtcatggattaaatgggtttgagactctgaactctatctattatgatttataggtgtaatgagttaggtaaataaagactggccaatgaaatcaatttattatcttcaagagaagtgtaaggggttttcaaacctcaatcaaacttctaaagtaaggtcttatatattcagaagatgtttttatatggatcaacatccattcaggtggttaaatagggaaaatgcaactaaaatttgatacatacatgtacagacaccgatgcatttttttacctcctgttgcagctattcagcatctctctttaaatttgcatgctaaagatattcaactaccatccctctccctctttttcctattctaaagagaaattgattaggagaacaaaactccacatgtcttgagaaattatttttgaaagccacagaaggggtggtataacaagatacttattagaaacgtaaaattgaaatcaataattttgtactaacattcaaattataacttctactaggatgtatactaattaagagtataaactctgaaataagatccaattttaacttttagcgtttgtaaccttgggcaattgttatttgcctctctaagtcttaatttcttcactggtaaaatgagaatagcaataatattttataggtttgctacatgatttaaatgtcatagtgtgtgtaggtgctacgaactaagtaatcaaaaaagctatgctattataaataacaaagcacatgcctgccaaagatgccctctgtgccataaactgtcacataataggccctcagaaattttatcagtggcctagaaatgtgctccctgggaagcctgggtaaagtaaaaatgtcattaattattgtcagatgagtttgaaagcctcctttagtcctggagtctttccaggaactaaagataatgcttttaggttttggtagagatcagtggtaaaggtgcttgactcttcctgccccccttcttcctgcttatctctcctttagtggctatttcattttcttaaaaacaccagtttaattcagtatacctctcagcattagccgcagcagcaggaattctatcaacaccctccacgctctctagaaggacagagtgagattcaccttcctactcaacttgtagaccagtatgtgagttcatgtcctcttggatcaagatgtgttaacccacatacccctgttccctttgaagggtggataaaacctttatgtcacaaagtgagaaaaggttcaatatagaaacagcctggttaaggcaacacccatttatttatagatgtacttcaattatatgcaaagaacatttcacttttcactcagccaagaatttgattgtgaggaagcctggtggttgctgggcgtgacaatcaactaaaccaaatgtctcatctctgactcccagagcagcatagttgctgaggacaagggccaatagaagtcctgtaaagagtcttttgtggcttttgtgtcaggtggatccaaagtaaggatacttaaggatcacttatactgtgacttggaaaacttctttttttgttttgttttctttttataaatgctgttaaactccttagacggtcaacttactaatgtaggcatctttagatgtatacactttaataatgaatccataccaggtaatgacatctctaaaaaattctacctttgtagttcccaggtatcagcccaccttttctgtgtccctgacagtgagtcatgcagctgaggccacaggaaataaactccaatcaaactggacaatagcagcatcagttaacagtaactagtcatcagttaacctttacttttctggctccttttcctggaagttttactcccaatgcttaagccctttggttgaaattctgtgggattttcttttatttttttggtctcttttccccactcatcacatggaaccccagtaatggcaacatggagtgtacctggctcacaacaagtacgtaggtcaggttcctagccctggattcccaaagtctcctttgcttctttcattactatccaatagaactttggcaatgtttaaaatgctctatcatcagtactgtttaatacagtagccagtagtctgactgaggaactgaattttaattatacttaactttaactaattaagtgtaaacagcaacacctggccattaaacgctctgttgagcagcacagtttagtgtaaagacatttctgtttctgtgtccagatcattggccatactgagtttccagatccaaagcttcctctctgtaattgccagtattaacacattaagacattcattcatcctacaaacatttattgagtacttcctgtgttccaggcactggaaatgatctcagtatcccaagtggtcacttgacatagaaaaagagaatagaattactatgagcctcaagcttcctttaaatgagtatcacctggcctctcgcaggctctcttgctcttggatagtgactgctattttcttatatctcaagtaatgtaattaaaaatcatcatgagatggcttttctttctgaagactgcctaacaagaatttctttccataactgaagatctgctttttctctatccaggaaaacatttgagcttctatattccttccactgtttttttaggagggctttccttatagtccaaagcccactttgctttctctaaatttcctcctacaggcttctaacactcataatagatggataaatagatacaaactgcagttgggttttgttttttgtttttagagggagacttgagcctatccatattactcctcttatttaaacctgtatgaatgttggtccaagacatatctcttgatctcttcatttcccacattccttgtatgcagaagtggagttcagacttatattctcaacagtcctacaagcggatgtgttaagaaatgaaaagcaacttgacaaatttttaaaattatgcaaattgagatacaaaatttattctcttccaaccatcgattgcaaaaagatgaaaaatatgccagtttttagatgtgttatttggaaattgaaataaagcgaataatctctataagggcaagtttatccaaatcctcataggtattgtgagaaaagcaggaaaggggaggcagttgactctggttacaactgtgaagtacacaggcttatgtgatcaggaatggtttaaccacccccagacctaataaatattacggttgatcccaaccttcatgagcaatatgtacttttatgattgggaggaatctcagttattagactgtattttcatttatataaaaaggaatataaaggccagcattaatttttaattataccacatttagagagcctagtgtgctgcctcacatggatgctgttcactttgggttcttgtaaattatattaaactggcttagaccagtaggggtcatggggacacctcctttagtgtatggaaagcaaacattaaagacatgaaaactgaatgtaaaaaataattagaagcaactaagtgttttaaacctattttcagattttttcttctgaattagctgcaggaaacccgtattaagtgcttccacatttcgcatcatttggagttggagcagataggggaatgtagaagcttgagaataccactgcttggcacaaggacaacaaagtgattttcctttagagttgcatgggatgtcctggattaggatgggtgtccgatgtcccaagtttcagtgatatctatgctagtaattggctttgtgaaatgtctagacattagtctaattttcccatcctttgatgaggtaagaggggtctcttctagaagtgatattctaaaataaaaatataatctttttattgacaaatatagtatagtaaagtagaaagagcacaggatttaaggtaatttattcattgattcaaaaaatgcttaataaatgttaaccatttgccaaacactgtgctaagtcgtgtggatagcagagaggatagaaaacatagaccttgcctacatggggctgttagtatagtgggacagaaagacagaaaacaagtcaataaacattgcctattacatcaccctaaaccaacaccatatttatttcttacataggcagtgttgcatcgtttcatgtttataatggaaagttggatagtcaggggaagcctctcagagacgacatgtaagccaagctctgagaagagcagagggcagtgtgttacaggcagagggaacagttggttctaagtccccaagatgttgaagagctgcttctattagagtcttgtaactcaaaatttgggtctccaactgatgaacagcatcagcatcacctgggagcttggcagaattgcagaatctcaacccatccagtccagacttacagagccacaattcacattttaaggaagactctgggtgatgcttaagcctgttaatgtttgagaagccctggattaaaggaatgcaaaggagtctcccgaggctggaacacacagtgtgtgaggagataatgaagatgggtcagaagatgaatgcctcaagaagatttcagtgtgaagccgctcacttctccaaccccaagctagtctgccttgcgtttccaaatcccacctactatgtttctgtctttgaatagagctatttagcttctcttaatccttaatcatctccaaaatccaaaaagaaactattgtcatccccattgaacagatgaggaaactatccaagtatttaaggtacttatcccataagtgatgctctgaaaattgtagcaaaagctatgaatctattatttcttgactatttattttaaaaaagccaatgtggattgattaaattgatgcaaccttagaaataggtgtcttttcactctgtacacacttagagtttcaaagtctagctcctttaaaaacttaataccaggtaaatatttatagggttttattatctaactgcctttttgtttataccttcttgttttttacccacaggaaaaggtgcattcctcagggagttctatggtttacatcttccctgggcatctgggttcctagctggctttgtgttccttgaccttgtagcctcattgtctctggggttaccaatatctttccctgacatggacccttcctattaatagcttcttcctccccttatcccccaggatttccagctgcccaagtttggcacaccctgtgatcttaacctgattttgctcctgtcccatgtaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggtacatgctcctgctccactaagctcccctgttctgtgtcctctaaacactggcctgcttcatctgtcccccatacattactggactggagggtggggacaaacaactacctacagtgacagaatcatgttttaaatttgtctgccacctctggccacaggaaattggcagatatttttccccttagaagttaatcaggattggaaatactggagtctgagtgggttagggatgaagccaactatccattactgacgggcttttacttctttttctataaagcaaaagtattatatgtccttactaatgattacatgaatgtggaatctggcatcagatagccctggatccatttttcttgctctgctaatctactacatctgtgacctctctgtgcctcaaattcctgatcggtgaaatgggagtagtagtacttatgattcatttctatttctgtgtagtacctaaaaaaaacaattctaagactgttgtgataatgacctgctgttatgtcattagcccagtgcctgccacatagtaagtttcaatacacattggctgttactgttgttatcaatagaatataagatagcagtcaatgtcttgatcccacctgtgggctagtgtgggaggtagcatgttaaacatggatgacataagtcagtgagctgataggtaacgatatccgggtgccttttaaataaattcctattaagcacctgttctgggtggcttggtatttagcagtgaataaaactaagatccctgcccttgtggaactcacatccatttctccctgtgtcttctcttctctgcaggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 135 - DNA, 186040 bp, Homo sapiens
gtggaagttcaattgtctttatttttcttatacagattcagagaagtaaaaaccagtaccaaactccaggtaaaatggtttgatctgatcgatttggctgcatactttcggtacgtataacattctaaacttaaaatagaaatttttatattacaaaacgtagaagtaaaattttaaaaagttaaagtactagcacatatatgtgttaggaaaatggtctctgtcaattgcccattttcccaattaaattaacctacgatttcctttttttaacagcttatttttttcataaaagttgtactttgagaagttactttctaattacgtcatgagaacacaacttgtaattagcaacacttctgtcagtctagatcacttcttctgcagagagcttttcaaccaagttggcatcaaccagcacaataaagttttcactgttttacctgtttcctgtatatggtgtaatcagtgaaagaaatggcatttcacatcctaaataatacggtgaaacactgtctaaaaattacttagatttaacagaattgcaattaggttttgacaatgtatttacttcaagacaatgtattttatcaggaaaaaatatcttgaaagaaagatctctgaaattatttttcatttgatacgccttttctgtgacaaaattttggggtgaaatgatgatgtttactgattgatttagtactaaaaagactagtactaagaagactaaagacagttatcttataataagaaatatagtataaatagcaccttatcaagaattctgcaggggttttaacacttacaataataggaaatagccattaaaaagttgctctaactttagatttctaactttagtgttctttaacaaaggccatattttgtggccttaaaaacaaaaaattatatctggctttatctattagtaaacacaaagggtccatattttattctgaaaaaatatttattatattcattcataaatgttctaactaatttaactaaaaaaatcttctagtattttctgatgccacaagcttactagaaaattacttctaaaaattggtaatataaatcatcaatgatttacctactttaaaaaagaggggtatctgtttctcttacatttaataacctgaaaatgagtctataaaaatattttttaaaaatacagtaacactgctgagttttgttaggtcccttgtttttttaattttttatttatttatttatttttagcaagaatgtacaattctttttgcaattttttgctaacaaaagacaaaaagaaatagtgctcccttcaatttagtagcaataaaatcatctatcttcatctctctcagagggcttagggagagtgaaaggaattagaggaacataaaccatgggtccttcaggtaaaataagtcatttcatagtgatggaggcaacagcaggctacgctcttgtctgcctgtacgctcagcatcagcatgccctgcccctcctcctcccacataaggtgcaccaaagccttcttttcttctacaacagagtcttccggtataaaggtggcaacagaaaattgttgctttgtccttttggggcatctcttgcatctcctgcttgttttgcttttggggtactataacttgtctctttccatttcacaactagtatcctttccacgatattccataactttgctacttcatctctgaccttttcacttgccttctttccaacatgatccaatgtactctgtacatgtatattccggtagatcaaaaggaatcttatttaagatccccaacaaataagtcccccatggaaattgaaagtatcctctcagagactcaaattattaaagtctttcaaaaaagattaaattcatagattataaataatattagttcaaaatattaaacagttgaggacttcattggcaatgcaggcagactgcatgccagttgaacatgatgctctctcagtccttaaaagctaattaaaaatggttttggttacataagaggtattgaatacatatttcatgcctttttataccaactgtagcaaacaggattaggataatatacttaggaatcaattttactgaattcagaaacatttatctccaccatacaccctcaaagggcatttttttttacatgtcagtcagagatctgcttcatccttcagtttcatagatagaattattttaaacacttgaaatctaggaagcaaacctgacaaggcttcagaatttaaaaagcaacagctcactgtgtgtggtgtgctatcaggttgaaatctatgttgtcctgatgttttcagagttatttcaaaagacaaaaatacagttgccactgatttatcaaaaacatttggctgccttttgtcatcagctacaaaattacagtgctttataaaataaacatcaaggccgggtgcggtggctcacgccagtaatcccagcactttgggaggccgagatgggtggatcacctgagatcaggagtttgagaacagcctgaccattatggtgaaaccccgtctctactcaaaatacaaaaaattagccggacgtggtggcaggtgcctgtaatcccagctactcgggaggctaaggcaggagaatcgcttgaacccagaaggcagaggttgcagtgagccgagattgtgccattgcattccagcctggacaacaagagcaaaactcgatctcaaaaacaaacaaacaacatcaagaaaaaaaaaaaccatcagattctaagctgcaattttttaaatccccagttgtaatatttcaaaaacttttgtttgaataaaatgctcataattagtaccaaactggtctctttcacaagatctgtagtgtaagacctgtgactaatgctgctgctgctactttcccgctggagggactaagttgtctagatgctctgcagtaaaataacgaaagataagctacaataggactgtgtgcctttataaatacagactaataagagccatcagagccagcatggattcaaaattacattgtattccatacagtagaattttactatccatacaatgatttttaaagctcaagttaaatagtttttaaagcatttggtactactgtcatcaatacagtttttgaaactgtaaatcaggtcgaattttgtgcacatttcctggaccaagatgccctcagaagtaactgcctgtggtcagctttttatggtttaaaatcaattggtgtataaatttcaattaacacccataaagcttagccatggggcagcagagaagaaagagaaaagtattctgcataatcaatcctgcagacacaattctgtataatctgtcacaagaacgcaggcttgcagaaaatgaaaatagaatatttatttatgtttaacttaagttactctcaatcaaaaccaggcaatgattaaactggcaacataaaaaggagggagcacgagtcatggaggcgggaagtggtgcacctgcagacttgctctgctccatcactttttccaagaggcccaggaaatgtaaggtcatggctacatccaagttacaatggtagtgattacagccaggttagaaagggctcacttttgttcagagcagactctacatcattgaagagggggatcaggtcttcagattccaaagttcctaagtcaacgtttgttcctggaagacagtcaaggaaatcagggaaacgggtctgttggggattgatgttcatgggtgtttgtcctgcgttttctcctataacaaaatgaaaagaaaccattttaattccttcttttaggctcttgaaggaggaacagttcaagtatttacataaccctcaccttcatgtcttcaactaccacattattgacccttactcataagaggtacagagatgtggaagaaatcgaaaattatttctggataggtgtggtccagaatggaaaaggccaaggagataagaaaggagcatgtgaaaggcactgtggatctgatctatgatctgtgccttcccatgacaaaggtgtgaagaactgttttacaaaagagtagagaggccttgtctgtaataaacagcttattacagaactataatctacaggtttcattgtaagcttaggtttacccataccatccttctttatgttcaaagagaatggtgtgaagcttcttttaaccaggctattaaaaagttgtcttcattgatgactttaggcatcatttataaaggcagttctgcagacgttttccctctttctgtaatacctacaccctacaactatctgcctttctcacaagcatatgagcacagtgcatatgagcatgttaaggctttaagtcttagagtaaagaaatcttttgttttctttaagacactatttcctaaacccatttaatcacctaaacctattttggcagtatgtgtattcaaataaaactgaagttctacagaacacaggtgagaaaatgctgtactagaggaaaagtaggtgtctgggatatgacatgaagaatataggttctttatgtgtcatagtatgggacagaatgcactactgactttggtgtcattagatcgagctttgtggctgtgtaagcttagacacacttaacctgcctgattctcagtttacccatctagaaattgggatcatatgctccttttacaaaagttagagtaaagtgccatatagtgtctgccacatatccatggctctgggtgtcattgatatatacaaagttatatacatacaaaaatataataaatgttcattgtcctgagagaaagaaaaacccaggtcttcagccactattaattacacaatatcaaaacaacaggttaattcaaaaagtcccaaacaattttctgaagagataatatctacttcaaaaattgagaagcattgataactaaggccagcttccaccataacgtcattttttaaaaacttgttaaattatcttttgtgtgttacaagtgcagtagccttcctgaaacgtgtgtagggaagtttcactattttaagcaaaattgccgaaagttcactttagcaatctgtgttttccagggagaaaaattatatccttccaaatgatgaaggaaccatcatccaatttggattttggtgatagcaaaacacaatggcttttctagaagtcacaaaatataaatgactcctgggtaacattttacagtattttcattgcaaagggtagtaaactgaaaaattaaatcaaattcaacaatatgacctcaatatagtgttactgatattgaaaaataacgttaaacgaaaaaacaaaatccaaaataactttcttctacttactagagtgtaacagataaaaatgaggctttaaaaagtgtctaaaaaacaatctgatctaatgtgctggatgcctttttttctcttcatctccagttagaatcattcatttttactaatttcccattttaactttcagatactcaagaatataatttttagccaagcaaaatctctgttttaaagaattcctaggccgggtgtggtggctcatgcctgtaatcccagcactttgggaggccgaggtgggtggatcacctgaggtcaggagttcaagaacagccttgccaacatggtgaaaccctgtctctactaaaaatacaacaaacaaacaaacaaaaaaaccccaaaaaaacagtgccaggcatggtggcgcacccctgtaatcccagctactcaggaggctgaggcccgagactcgtttgaatccaggaggtagaggttgcaatgagctgagatcacaccactgcactccagcctgggtgacagaatgagaccccgtattaaaaaaaaaaaaaaaaattactcttatcctttcttctcaggatggaaggcatgaggatactggctaagcttcttcattaaagttaacaatcttaaaatagaagcagctctgcaatctcatagtaatctttttggtctttgcagtttatccacttaaaaagtggaagagacaaacacaaggcaattcttttttttttttttgagatggagtttcgctcttgctgcccaagctagagtgcaatggcacaatctcggctcactgcaacctccgcctcctgggttcaagtgattctcctgcctcagcttcccgagtggctgggatcacaggcatgtgccaccacgcccagctaattttgtattcttagtagacacaagatttctccatgttggtcaggctggtcttgaactcccaacctcaggtgatccacccacctcggcctaccaaagtgctgggattacaggtgtgaaccaccgtgcccagccacaaggcaattcttaaaagggtgtgattactgcagaatattctggaaggatggatgatttcccagcctttgctcatgttattccctttactggatcttcgcaccaagcccagctgttgctgccatgtatgttttgcaaatggagtgctcagctggctcgtttcccttcagcatgtggccagcgcgtggtccacaggcctgatagatcttttctagccacacttgagctctgcctgcccccacagcttccctcattttgctactgtataattaacatttctccccttgagaagatgtatgtccagttcctacaaagacttcacagaggtggccccacactcaatgagctgactctaacttaaccaggttaacttggcactcacattcccacactcaatgagctgattctcacttaaccaggttaacgtggcactctgacattatcaagtccattgtatgtatgacatcagtcttcttactggagaagagcactttgagctggtctctgtgatctcatgactcctcacaactctgccgtgagcatatcactcccactttatgggtgagaaatctgaggctcacggaggttatgcaacttacccaaaggcgctactaggaatggagaagcaaggattcaaatcaggctgcctgttggctaaaactatgttcttttcaggacgtcatttaattccacattacggcttcaaaataaaacactccctacttacccacttgaggttattttaaagagacatagagtagaatccatcctcttttatggttttttttttttttttttgaatgtcaaacttagatttagatctcctgagcttttttccttaactttgctttttatccttactggcttcccagtgtttagaagatgaaagtaaagaattattaaacataggaaggagccacttcctaaggctattccaaagatagcaaaataaatctcacactcaaaaagcagagagagagataaaggtggcagggggtggtggtgggggaagaactgaagtaataaactgaagaacagtaaaacaatcagtgcaaactattcctgtgtcactcctcacaagatagtctttgcaatcttctcaatgcaaagatgacaacctacacgaaagacgccaggggagcagctttaatgtactgcatttgtaagacacctggctatgagtttgactcttgatctttccaacaatttagactcacaacacaaagagaagccatcaaagagtagagtgtaaaaaactacaggcactatggcaaacactttgggggaaggaattttttattttcaacacaaaacaattactttcgtcaatgataatggagaaggaactttcatgaataactccaaatagtggacaccctggctgtcatttatttttggttctagaatatcttcttagagtttatgactttcataattaagtctaggtaaggctaataagactaacttcagtttctgcaattggaagtctcactccttgagaaaaggagaaaaagaaaggtaatcgggaagcctggtgaggctggacctgaaggatgcacaggctggggacaaggtaagagtaaccctgactctcttctctttaattcctgagggaggatgtcgttaccatgttggaacttggaagtgacaattttgaatcctctgagttgctcagcattccaaatacccactgccaattgcttttcaaatgcagtgaatgacatgaaaaaaattggatactagaactataaaccagtgtcactttccaggagaaagggtggcccatatattacaactaaaaactagaacagcataaataccccaatgtggaaacatggcaaacaaacagtggtgtcttgatgcaattgtgaggaagggactatatggagcaaagatgaattaaaaaaaaaaaacaacagaatttaaaatcctgcgcccagatgtaaaactatacttgtataatctatgaggaaggggctacagtttattaatagtgcctgggggttcagtggcttttcagctgttattttatgttgtcgttgagattgagtgtttctggttggattttaaaattgagatgaccgtactcgctctggcagcacctatactaaaactggaatgattagcatggcccctgcatgagaatgacatgtaaattcatgaagcattccatttttttttttttcaacatttttacagacactcgggactactgggagtggggaggaacaaggggtgaaaaacaaactattgggtactatgctcactacctgggtgacgagagcaatcgtatcccaaaccccggcatcacataaccatgtagcaaacctgcacatgtacccccaaatataaaataaaagttgaaattataaaaataaaataaaagaaaaataaaattgagataaccgaagagatcatttaaaaaacacaaacccattgtaagtgcttgcaggctttgctcctacctgtatccatctcatccacattgctgaggaagtcctccggagttgtggggacactgtagcaccctaaccccaggccactgtcagtgctctgctccctcgaatgatatggccctctgcaaagcaaaagatgaagaaacttcaatatgagcccactaaataaatctcaaaattaaaacacagtcacaaaagctctaaactagtgcagttgtgccatgctgcccaactttccaggttagggaggaaggaaagttttaattttgaaatacataccctcatgaaaatgaaaataatcatgtgtggccattcacagtaaattgacattgatttccttttcacctcaaaataaccatttgaacattcttcaacatacagagtatgacaccatttatgtaaaactttaaaaaaaaaaaacaaaaactatgttgaatattgcttatggatacatacactaacgggcagtaaggggtataaaagtctgtgtgatggacacacgccagtttctgaatagtggctaccactggggacagaagggaaaagaaacgagatttcagtggtggggggatggcttcaaatattaattgtaatattttatttgttaaaaagtaagattaaataaaactatggcaaatctgggtagtgggtacatgggtaattcatgttattctttgtacttctctgtgtttcaaatactttaaaatcaacaatttaaaacctccattaattattatttcagctactatttgtttttatctctatctttaataatgttcataattgtattgtttgtttgccagacgtctctgcaagggcagaataaaaggcacaggaaatacagaattgccctttttatttgatttaaaaactacttctgctcatgaagatatttctggctaaattctctttcccttttgctcctttgttttaattactttttaaattgtgaaattattttaaactcacatagaagacgcaacaagagtacagagcgttcccatgtacccttcaccagcttccccagtgataacatcttacataaccatagtgcaattaccaaaatcagaaatctgacactgtagaatattatttactaaactatagatcttattcacatttcaccctgaacatcatctcttttcttttctttcttttttttttttttgagatggagtttcactcttgttgccaaggctggagtgcaatggtgcaatctcggctcactgcaacctccgcctcccaggttcaagcaattctcagcctcccgagtagctgggattacaggcatgcaccaccatgccctgctaattttgtatttttagaagagacagggtttctccatgttggtcaggctggtctcgaactcccaacctcaggtgatctgcccacctcggcctcccaaagtgctgggattataggcatgagccaccatgcctggccgaacataatctcttaattgttctgttctcaatttgccatatggcatgcttttatcccctgttggttacataaaaccagaagattcttccaagtataagtactagacgacaccatcatgtttaaaaatataagttcatgcccattttcaaattcttgactaggggtttactctacgtcctatcaccaattttttaatttggaaattttttaacaggcagatgatttcccctgcttttcttttttctgccagctcctcccacttcctccctttattctcaccctcaaccctcaagctccccacctcttcccaatgtaaacaaagatcctattatagtctagatcacataataaagagaataaaaataagtggcccccaaatattaacttacccattgaggaaaggatctgagctattattagtgatggatctcatgtctggggtcatcgtgggtgggttgacagcagcctgaactggggcaagagtctcagcttccatggggagctgtcgacagagggcagcttcctacagtcagaatgggaagcaagagtcatgcactcattgtcacaaggcatggagcaaagtgtacttcacatcaaaacttttcaccaaatacaaagcactgtgtatttactcccagcaagtcaaaatcaccaggcaaccattagtattctttctccgaagaaagtcttacagacataagtcacttcacattcacaaagttaatgggaagctcagctattatttgatctaagggcacttaatgttgcaatcatcccacccatgcaattatttaaacacccaaatcatagaaagccctctcaaaacactttgtcagagacaaggctttttctatctcaggttctcaaaccaaatctacatcaatcaaagcaatcagactcctctggactataaagtacattctggtctttgccacttacaggccagtaaaactgtggaattacagagtccaggctctacattaaattgcatctggcagttttatgtttacagacaggaaagcaaaacaatgagttgaaagtttactttaaaaagtcaatcagtggccaggggtggtggctcacgtccataatcccagcactttgggaggtcgaggtgggcggatcactggagcccacaagttcgagaccagcctgcaacatggtgaaaccctgtctctacaaaaaatacaaaaattagttgggtgtggtgctacttgggaggctgaggcaggaggagccctgtgcctgggaggttgagactaaagtgagcagagatcacgacactgtactccagcctgggtgacagagtgagacgctgtctcaaaaaaaacaaaaaaacaaaaaagtcaatctatttgactactttgttgactaaaatgctgaaggttggggaaccatgtagatccaatccaaatcccacagacaagtaactgtttcacagcatatggatttcattagcagaaacaaataatacaagcattattttataaaagctagcattacattgctaagaagagtctatccaaaaggctacaaatttactgactgcaactactttctctaggtataatctccaggagtctctccatcttgacaaacataaccagacatcaaattcctttcaaatttgctgatgtttccagagaatacttttgtatgtttacatttgcatcccaaaccaaggttaggcctttccccatatttatgcctatcagtttcccactttccatgctgaagtcattggtctcactgtccctcaaaccctaaaaccatggctacaatggcaaacagaacatttaggacttctaaattacagtatcttcgttagatctcttccagccctaacatgatgtgactttagagggtagctgctgtctagacaagtcctagtgaagtcatcggctataaaaattttcagttactagagttggttgcactgttacaaaccatgagagacctgattgatttaaaaaaaaactgtattgttaacttatactgaaataaatctagctggaaagggtctttggctcacttctgttcatctagattgcaaataatcaaatacttaactaacaaattttattcaggaatctacaaaaagcaaaccaaaaactggagatttttttggtaaaaagtgattttcatcatctaaatcttggaagtgccttctgaataaacctagaaaaatcaaattattttctgatagttgtttttaacatggcaggcagggtgcattagaaaccttattatccaaccaaagttttcctgaaagcctcagaaggaacaacagggattgaatctggcataaaaagcctgagtcccaccagtccccatccctcaagcacactcatacaccctgagccacagtttgaaaaaatgtatctcatcaatggtaaatttctaatactttattaaccataaatgcaagaatcttttgactcataaccctcattatccaaaaacatgaactttactagaatattccatttttcaaccattctgaataaatgtgggagtttacctctaaacaaatacacttttaatttaaaagttgatgagatggctgcattcctttgtattgaaaaaactttatcaacatatgtcttaagaatacaagttgaggccgggcggtggctcacacctgtaatcccagcactttgggaggctgaggcgggtggatcacgaggtcaggagatcaagaccaccctggctaacaaggtgaaaccctgtctctactaaaaatacaaaatattagccgggtgtggtggcatgcacctgtggtcccagatactcaggaggctgaggcaggaaaatcacttgaatttggggaggcggaggttgcattgagccgagattgcaccaccatactccagcctgggcgacaaagcgagactctgtctcaaaaaaagaaaaaaaaaatacaagttgaatctgcaatttccaggagttctaaatttatatatggtaagaatcatttctggaacttcatgggataaaaaaatacactatatataacacacatgaattgttatctgtaataatatataaaattataagaacaaatatcaaaaattagatataaaataaatagttctaaactttcctattaatttaaattactcctagctatttccagtaaataaaacataaaataatgcttgtgtgtgtctaaatatataaataaaatatataaataaaatttaaaggattatttatgataaccaaagctgaaaaacctatactatattggaggaaatgtttcactgtgccatttcacatttgttccatctgttctaaatcaaagagaacagaagctctagtctccagcactgatgtttccctaactaccctgaagacttaatcaccaagtcatcctaagggcaaatgccgccttctgtctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgcaaccttcacctaccgggttcaagcaagtcttgtgcctcagcctcccgagtagctgggactacaggcatgtgccaccacgcccagctaatttttgtatttttagtggagatatggttgcgccatgttgcccatgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaagattattccaaaatcattcttaggtcacaagttattccacatagcagccaaagtgaagctcacgtgaccccctgctctaaagcgacctgcttcttgttccacctggatggtaaatagaggcaggtcctcactgcagaccaccacaccctgcataacagccctggccaccctttcctcccatgtctctgatgtgctcccctccttcacccccttccagtctcctggtttctctgctgctcctcccacctcctgcacctgcgccaactgttctatctgcttgcaaggtgttcctcgagtcttcctaaagcttattccctcacttaacgcctgcctcctacagacgccatctcttcagagatgctcctacctcacccctgtctaaaatggcctcacccctgtcattttctgtctcttaatctgcattaattttcttcagtgcaacttaagttttcattctctgtctttcctactagaatgtaagctccacgagggaaggggccttgtttgtcatgttcactcctgtacccaactaccttaacagtgctaggcatacagtgggtacttggaaatataaactaagaacatgcaatctcacctcagccacaaatatgagagaaataatagcctattgtatacaacccaactagccaggtgcaggctccatcctcaagaaatggtcctgctgcactctttcctgctcctcacataggatgaacaggagggccgagtggccaggagctagatgcttgaattggaaacctggtcctgctatctaacagaaagttatttaaccctctgttcttcatttgtaaagtggggataataagagcacccacccaagaaggctgctgtgatgataaaacgggataacactacaaggtgcttagaacagtgccaggcactcaagatcacataataaatactgaaggaattattattatttcattttctgaattccaatctcaaaaaaaacaaaataaacaattttaaaagtcacactgtcatgtggaactgatccactttaagtggtgagaggtttcttcctggtcaactttcaccttggagggattaaaccaaagtgtgaaattcatcataatggtcaccaaggctaagaaaacaattttttttaaacaaggagaggtttataaaccatttttatataacataaaatttgttcgaatataaatggaaagtagtgagatgttttacttcacttaaattttataatacgagttctatatttagaactttaaaaattctagcctttttttgaatgaaaatacttccctattccaactcatgaactgaaagagaaaaagaaactgtacaaaacccgaggtctgaaaataaaagggctaacctcaccaacatgttgccatccaaacaggggagggttttgttttaaactaaatttaggtataaaattaaagcccagacccagtaggatttggactgccacatgacatccactacccttgcgtgggtaaaaatgaaaggcaaacgtctgacttagaccaaacagcagcagtcaaaatggatgaaactaaagcagctgaagcaaagacaaagacaggcactggatgaagtaagcttccatggaaacagaggggtgacagttggtcaaggctggctgagggcataactcaaggcctctgccgctgagcatcggtggtgcagctgccttcactcagcaccccttccttcctctgctccctctagtcgaggcaggaaaacaaacgctaagctggcttgtcactcatttcccactgtgctccagttaaacatgtatattcacagatcccttccagggtcccctctgtgtccaccctgccctccaaacaaaccttcagtttcctagaccaagctcaaaacctgctttctgtctcaagaagcaggtcatcattgcttctctagctagtccaactgacctcttcctccaatcaaccttcaagtgcaaggctgcatccaggtccctacccaacactttatcttactgaaatcttttcaaagagtgaccagagaccaatcaggatagagaggggtcagggcatcacatcctatgaagaagagtggggctatttaaccacaggggaagactagaagggcacacagtggctctcaaattattaatgaactgtcacaggaaagaaggaagatctcttctagcctagatttgaggcagatacgatgaagggctttctagttacttatcagttcagggcaggaactgccttcttctcaattctccaggctattagccaccggatttctgaaacagtagttggggtttaagttggggtccagagcttggcaccgaaaaggcagcatggcacaagagcaaaactgtctttggaaccagaaagattggagttcaaatcccagttcagttactacatgttgtggcatcttgaactaaattcttaacctttcttgacagtttgttcacctgaaaaaaaaaaggtggtttataagactgatcttgctgggatgctataaagattagaaagcgtacttataatggacctggcacattgacgcagttaacagaacaagctgctgatagtgttaaatggtgtgggaggcagagatactagctaaaaattgcatattgcttactgtgtgtgaaacactgttctaagccctttaacatgttatttcccatcctggctaacatggtgaaaccttgtttctactaaagatacaaaaaaattagccgggcatggtggcatgtgcctgtagtcccagctacttgggaggctgaggcaggagaattgcttgaacccaggaggcggaggttgcagtgagccaagatagtgccactgcactccagtgtgggtaacagaatgagactctgtctaaaaaaaaagaaagaaaaagaaaagaaaagaaaagaaaaacgtgttatttcatctcttcctcgtgacaacccaattgtctccattttacagatgaggaaactgaggctcagagttaagagtgtggcaaagtctcagtgtggcagagaaagaaaagttgagggttgaggttgacagacctcaaattgtcaaccctttcacctgctggctgtgagaactgggcaagttacttcacttttccgagcctgttttcccagcaataaaatagaaagaccaacccctctacctcagacagttcagaggaaatttaatgaaacagccgatttaactttcctgaacatagttttcctccctgaacagggcaacagaatgaactggatgtattcaatgatagttttcaacgtatatgagtggagctcatgtcctaggaattcacaacccatcaagcaaagttacaagttccaatttcaagggcacttttcagaaggaaagctctccctgctgaccctgacccaaccctcctccaacaaatttatttttgtctatgtccaagcttggggtggaaagacttgcaaaataagggctcaagaatctcttggtgagtttgtggtcaactatctagctctctgaagtgagtaattatttatgggctaaaaaataccctttcctagcagctggaggacgggtgatgtgtaaaatagctgaagaagtaaggatgtgaaagacaaatgattatttgtgagctgaaggtgtcccaggaagcaaacctcaaacctcctctccttctaggtccttggcctgcagcttgcctgtggaataaaccaacagaggaggtgagaaagtaaacggcagctgaaagcatctgcagctctgtcccgccttggctgagggaacactctgccagccagctcctgccctcaccagaatgcacttcaaaagggaaacaaatgacaatcagctcttcagaggctgctctgcttgatttaagtgtgtgtggccagggactctacaaacatggaagattggattgttttaattataaagggtggggtgagtagaaagaaaatgaaaaaaaaaaagacagtattttgaaatcctaacattaaaatagttattctggatgcagagaaattgctttctctgccaaaaccctgagggacttcagagagagaatgccgaattatttaccttctttacgggggacggcggggggaacaaaaaaaaattactgatgtatatttctttttaattcggtgccaagggattctaaaatgcactgtcacacttcccggagactgcctttttgaaacaactcatcactaatgctcagctgccagactgtccctacaaaagaacaatcgaaactgcgatacttttaggaagccatttactaagtttgtcattattatctatggtctatttgttgctctttttactcagagtgcataaagcaaatttgtattattccacaactggtttctgttgtcctttcaaatcacattaaagaaaacattataatttagatactcgtctgtcttcacttaaaaaaaaaaaaaaaggctgaggcctggtgcagtggctcacacctgtaatcccagcactttgggaggccagggtgggcagatcacttgaggccaggagttcgagaccagcctggccaacatggcaaaaccccgtctctactaaaacacaaaaaattagccaggcgtgatgatgcgcacctgtaatcccagctactcaggaggctgaggcatgagaatcacttgaacctgggaggtgaaggttgcagtgagccaagattgtgccacagcactccagcctaggtgatgaagtgagactgtgtctcaaaaagagaagaaaaagaaaaaaaaagacttgaattgatactattgttcaacaacaagggcacactgggacattttggaaaatggattatttctgggacatgtaagcaaataaaacgcttgacacaagctagaatggaagctctgtgagggaaggggctggggtctgttgttcacagctgtacttttaatgcctagagcatttgtaaaacaaatatatgaacgaatgaacttaaatagccaagcttatatggagggatttatagattcacaaaatattagactacgtgacctctgttaacccagtcaactctgaaacctaatgctatgaaatgcttttctaaaagttaaatagtcccctgttctgaagcaaaggctatgaaatagcctacatttatgcttcatgatctgctccaatacgacactctcctagctcgctaaatagctattctttgcatgacaaaaaaaaaaaggggggggcctcagaaccttccccaggccagtgctgctcacagccaggtgtgtccccctccaggagccctctgtcaggatggctgtgcgaggtcagccagctggcccgccgcgcctggtggctgtcaagcctggcagaaatcccacagacctgccaaaagaattccgaggcctccctcttttctcgtccctgttgccccggcgacccgaggccaggcttagtcagcatttttgtttgacaaactgcattctcctgtcccccaacccccaaattaaaaaaaaaaaaaaaaagaaagaaaaggttgagggtaaaagcagggctgaatttgctttgggaataatgatttctctacaaggcagcccccgtgaagggacaagggggagccaaggctttgccacttactcgtcttccaggtcctggtcctcgaggttaaaatcttccagaaagatggccccaaaccgttatatttaaatgaataacacacatgaaaagaaatactctcttcaggtaaagccatatgcctgttttcatgtcaaggaattgttcttttagataaacaggcattgagaagcctgtttctcaatgtctgacctgtgactacgatttcccacttcatttggtaaagttgcaattgtgccttttaggatactgagcaaatattgcgttgaatttttcagttgtaacaacagaatactctgtagtcattgtgggtgtgtgtggctcatgacatttaaaaatttatgtacggcctgttgtagaaaggattctaggcgctttggaatgggtacatacaaagtcacagcacaacttcatggctgacacagaataaaaaaatgacttcccaatatattaagaagaggcaacaaagcagtattaaagtatgctaccacttttgtgttttaaaaaacaaagtagacacattgatacacatgatacatacaaaaagactagaaagaaatcatcagcatatttacagccactctttctaggtaagagtataggtgattataatttccttctttgttgtttagtattttatacattccgtaccataaacatacgttttgtctttttgtgtgtagcaattcgttttcttttattattctttttgtttacatacagtaaaattcactctttgtggtatacatgtctgagttttgacaaatgtagagctgtgaaatagccaccacaaccaagacacggaactgtgccatctgccccacaattcctcagtgctgcccctttggagtctactctttctgtactgtcaaccctggcaagtgctcatctcttctctgtccccatagttttgcttttccagaacgtcacataaatggaatcatacaggatgtagttttggggggaagtctggtttcttgcacttagcaaaaacacttttttaaatgctaatcactaaagtaactcagtaaattatatttttaattttttttttttgagacagagtctcactctgttgcccaggctggagtgcagtggctcgatctcagctcactgcaacctccacctcccaggtccaagagattctcctgcctcagcctcctgagtagctgagactaccggcacccgccattatgtctggctaatttttgtatttttactagagacagggtttcaccatgtcggccaggctggtctcgaactcctgacctcaagtgatctgcccgccttggcttcccgaagtgctgggattacacgcgtcagccaccacgcttagtcaaaaattaaaatttttttctacttaaaaaaactcaacaaatcaaattttaatttccttaaaaaaatgaagagaaagcaaaacttcaataagaattgctttttttttctagagttgccatttctttggtgaacctgaagtagcctcacagcctttgggaaattcagtaaaaataaaagaaaactctatcacagacaaaagacttcctttcacagaaatgcactctttatgtcttccatgttagattcctggtacccctccacttgaagtgtctgccgcattccaagataattcatcaattatcagatacaagtagctcagctctgttgctacaccagccaatgctagattggagggactgcatttaaggaaattctcctgcttcagaagattccttatcagcagagataccaaaccttactggctcttttgatcctaattctgtagccagtaacctgaggggtcactggaaagaaaaaggagtatctgatgctcactttcacagaactctgctcaggtgcatctggtctcagttccagtaatgaaagtcaaagatggtagccactgggcccctgtgaagcagggaatggttttaatttactcttctggtctttaacttggattaaagttaattatttttccttttctgcaaaaatacaagttatctgaaggcagtcacatcccatttacctgtctgttattttctactaaataaatattgattgaatgaatgaagagataaaggaatgaaggaaggaaaaaaaatatgagcttccatactgaaataatgaaggctcactttagatttgtaatcaaagtttcctcagatccattttgttaatgttctcgcatgatttcaatgccaatgagttaataggtgaccctttggcattgtggtatacatcaaatcatgcaacaaggaccaaggagttgtttttttcatggcacaacatcatcaaactatatgcctagtggaacaacggcatagcagaaggaacaggaagaaaaatgaaacaatatttatatagcatattctccacagggatctttcagattcgtcgtatcattcaagaatgataaaactatagacagcgtgataatttattagtaattaggggataaattcatctacttattaaattttgccaacctccctttctactacagaaagagagcatagcctggggccttgctcccagacaggctcagttggtagaagggcaggtaggtctaggcctacctgcagggcctgggccccaagaagacaggctgtacaattaaggccgcctacaagcaagaggagagccagtgtaattacaaactgtccactgagcaagggatattcaggcagttgttgactacccaggacataggggtaggacagagagaacaaacagaagtgtacagataatctttaaatttcaccagaaccaccacttcccccatctctccaaattcctaccagatgctggaaggcaactaaacaagtgagccaaagatcacttttaattccagtccatttccctgctgctgccatggcttaggttcaaaaagtgaagcagaaaatcaccaaaagagttcaaaaaatccaccaagatgaaacacagagcccacacctgaatactgaataatcaggtgtcctggcaaatgccccagaaaactattatagaacactccaatgccatttattatatggtcttaaatcatatctttgacaatcaggagcatgctgcttctgcatggggaaaaaatctgccatgattaaaaagtctatttagaccttttcctgtactccctaacaaaaataaaaaggcatcagaacaccagaaccaaccactccaccattccatctcctcctaactacacacacacacacacacacacacacacacacacacacacacacagagtcaaggctgaactacatgagtccctgtgagcaaatctggacaatcttttctcctgcttcatatacaatgcaacaatgcaattgctcactatgatgcagcacaacgccccacgttccacagcctccaaggatcagcatttaaggaacttggttggcatttctgtaatatgaaccatcagtactacatcctggttcaaaggcacctacagctggaataaaggaaacaatttggggcacttttcccaccccttttcagaaatactttctgtgggaaagaaggaggagaagcaagagaaagagaaacacacccgcaaaaacagagaagcaagtcattctttgcagaatggtcacaactttgtgtaaagaaaaaactcactaaagctcatttaagtataaaactgagaatgtataaaatgctgttgggatactgtttaatttaccttacattataaaacagaaaaattattccaaataaaattattattcaaagacagaaaacaattaacaatacaattacttcccatcaagaaacatgacactatatatctaaaatcagtataaacaaccgttagcctgaaataaccgtgaaagttcaaacataaatcctcagggtaaaagacacaactgtagttacctaattattaagttgtattcctcaaatttggaggaaagttcagctgagcaacaaagcacaatttatattcattttccttattttcaaagactatatctgagaaatgattttaatttaccatgcattttaaacctcacacaatatagatttcttatatcctggaatgtatttgatgagaaatacattattcattcatggaagtcaatgtgtatttttgaaagtatcaaatgtagctttaaaaaaacagcatttaccctaacatgctcggtcctttcctccaagaaagttctctggaatgttaaaactacttatttctctaatttctctaaagtagcaaaaggaagttattcatgtatcttgcttcatgtgagtcacaaaacaaagtctgaaaagttaaaacaataaactgaagcttttctccccaaaaatgtagccagaaaaaaagcatgagacctgaaaacatgggttatattagtttagcaacacagaagaaagaattctgctcttccatagaccaagccactgaaacagggagagcactgtgggttcttttaggaattctcttgtattcgtttttgaagtacagcactgagcctgacccacagagggcacacggcaacacactcctgactgacggaatgaaaactgaatgaatggagtatggtacaaaagtgcctgattgatgcccaggcagttttgcagagcactctgttggagtccatatacaaaccactttcccttctcattctcccttcagcttccctctttttcatgctctgtggtggaccaagatcctttgtcatttcttctgaggaacatccactccactatctgcttgaatctcggggggttctctgtgactactttgaccaagagagtgtggcaaaagcgactccacgaccgtttccagagctaggccccaagaaattggcaacttctacttcctgtctcttagaatgctttttcttgaaaacccagctgctatggaatgagtaccactactctgagatcgccacaccatagatcccaggcttttgttccagcttagcccagtcttccagcaatcctcaccatcatgccacccacttaggtaaagccattgtgaactatccagaccaacccacctaccagttgaataccactaaatgacctcagtcaatgccatgtagagcagaagaatatcccaggtgagccccttctaaattctgacccacaaaattgtgcgatataatgaaatggctatttaagcaactacattttgggataatttgttacacaacaacagactcttgtctctctactttctcctttctctccttctaaagactagcagtggaagccaaaggcagccatgctaatacagctcgtccttgtacccttaagcttcgttctgaaaaggcaggcagaacactgagagaagaaactggattttaatcaagaggcttggagtagggctttgagccctattgtctcttcttctctagaagaattaccctgaaggtaagcagctacctacccatcagctttggcaccaaggccagggagcctccaccagacaccatggaaagccatacctgcctcatgagctcctcttggcgcattcgaatcctttctctctccatctggattctctgaagccgcagtttctgctgctgctgctgctgagtggtcagcgcattgggcatactcatgagccctgcgggtgggttctgagtggggtggttctgctggctcagggtactgggggccatctgctgctggtgttggtgattcatcactgcaagagggaagaacatacagattaatgaccagggcccacaataccttatcaaaaatagaccatcagaatgttttctgctttggagtatagattcctgagattccttccaaagtactttcctgttaaccattactgtttaagtaattattaccttaattcaattcacggaggctcgaatactggccccaatcctgactcatctagcctcggcttttgtttctgttaaaatctcatttcacacctccctgtctagagtacattttaagccttacatagaacatagtggtctaaagcaaattccacaaaggttatcacaagttatgagataatttcaccagatcatttgtgtgtgtgtgtgtgtgtgcatgtgtatactttctcagttaatttgtgtgtttatggcagaggtaaggagggcatgtgatctttggtacacaaaccagtgaattgacaaacaacatgtaacacaaagcacctagatcaggagccgacatataaggaggactccattaatcctttgtttgaaaagcatgctgcaaggaagcctgagctatgagctaaactcaggaacaaatatctgactgagaaaaaaatgtttgtttcttcaaagggagaaattagtgagaaagaaattatgcagaaatgctaaacatgttgtgcctggataaacgcatgagaaatattttcaatttttttaaaatgctctatttatctgcatttaacaaccagtgaaatttcagcatatagaacttcactttacggccaggagcagtggctcacgcctgtaatcccagcactttggaaggccaaggcgaacggatcatgaggtcaggagatcgagaccatcctggccaacatggtgaaaccccatctctattaaaatacaaaataattagccgggcatgatggtgcatgcgtgtagtcccagctactcaggaggcaaaggtcagggactcgcttgaacccgggaggcggaggttgcagtgagccgagatcgcgccactacactccagcctggtgacaaagaaagactctgtctcaaaaaaaaaaaaaaaaaaaaaaagaacttcactttacaaaaataattttaaaatccttaaataaattttataattggtatttctgcaaaaatgcatttataaaagtgctagtttttctcaaaattgtttaccagtcaaatttgcttaacttctgctgggcaatgtcatgtaataaagaaaaccatgcttttcagtctatttcctcctaggtcagggtcaaagaaaacaaggtataattttatatactcacttcatttctgagaaaaaaattctcaatttttgctatatttggtatcattaactttaaaacattttataatatatgtatattttttataatatttcatatatatgtatatattttaaacatagagacgaggtttcactatgttgcctaggctggtcttgaattcctgggctcaagcaatcctcttaccttggcctcccaaagtgctgggattgcaggtggaagccaccacgcctggtggcttaagttaaatacttttcatcttcagtttgctatgcatattatgtagaaatatgatttacaagtaaatctccttaaatgaatttaagtagcccaaatctccatatattaaatatatgtattaaatgtataatatatgtgtatatttgaacgacatatatgtacatttgaaagacaataccaacactgaagcttttctagagaagaatagatttctttgaggaagaattcaatggcaaagatttctccaggatggaggtgagggtgggataaaaatgttcttttttgtccatacgctcactgaaattgttattgcaattcctgctgcgtgtcatgcactgggcttaaacttggaaaaatagctcctgccttcatgagaactaacggactggtggaagagaggtgtgaagaaatgagatggatttttatgagtggcttatggaacatgaaactgttaggctacataaggaacctgggagattatctagtccatccccttattttatggaatagggactgtaacccagaaaggttaagggatgtgccctggttagtggcaagtagagccaagaccaaaatcgagatcctcttgtaccccgtccaactgtccctagccaccttctgtcacatcttagactgaagaagaggaacaactgctgaagcctcagagcaaccctgtaaagacaatctgccttcaattgtttgcaagaaagtaccacacacacagcaggtcatcaaaatagggacccaaatgttgcttgcgttactaagaggaagggctcgaggaaagcctggatagatttacaactctgggcccaataacatgctagtaaaagggaagatatcagtgtatattgcctagacagtttaggtttcccccttagaattaagcctgccaccaaggactctcacctcctggcacaatcccaggtacacagggaaagctcaggaaacgatctgatgaatgaataaaatcagttgggcatttcttacactcttagattaagaacaagagaaaaagcacagtcatgattgatgccaaaaaacctgagatgagtatttcacttctagagcttgttatagtataattacaacttctacttgaaggcctggggtgggaggtaaagggttttgcacagatggtgtcgcaggggaaaagttcccttaagtacagattcaagtaagacaaaatccagacatccagaagggtttaattcatgaaacctatttcaagccagggaagagaggcgcagatggaagaatgataattatttcaaggaacaggcatttctgaaccttctataaaagtatgttcttactagtagttatatttaatatggtagtatctgacacaactactagagacaaaaaagatgcccaatagttctgatatcagaaatacccaggttaggaaaacaaggcttcaaaggcacaggttgttaaccctatgttgttgttgttattgttgttttgagacagagtgtcactctatcacccaggctggagtgcagtggtgccatcttggctcactgcaacctctgcctcccggtttcaagagattctcctgtcttagcctcccgagtagctaggattacagtcgtgtgccaccctgccccgctaatttttgtatttttagtagagacaggattttgccatgttggcaggctggtctccaactcctggcctcgagtgatccacctgcctcagcctcccaaagtgctgggattacaggcatgagccaccgcgcccagccctatgttaatttttataacttagatactttggaaaattttataactgactcaggtgacttactgacataacaaattctagtaggactatcatcagtcacttaggtagactgcccttgtcggtgtacaaaatgctgcattgggcgtactctcaagcagtgtactgtattactgaaagccacatagcaaccagatattgctcagcagattttattaatacctgaatcctaatctggaggagtttcagacttggagaggagctcttcccaagccacatctatgtgagtctttaaaacacttgcccctacttgagacattcacaggaggtaatggtggaaacactggtttcttccatttaatttagatttgatctttcagactaaacatctctcattattaactgtagagtctggaaaagggtggaacttagatgatagctttgttttcaaagtaaagcacatatcaacagagcagtttgtacaaggatattcaaaacagtattgtttataattgcaaaagattaaaaatgatcttaatgtccatcagtgggagatatggtccacccatttagagaaattctgtatgatgattccaatgtttcttagagatcgtccagaaggggaaaaacccaaaggacagaactgtattatgagcatgttactagttgtggttagaaaaggtggggcatgttatgcatgtgcagcaaatctccacagaagggcacacctgagaccggcaacagcgagcacctcggcagaagaaactgggtatcagggatgggagatcttccttttccttttctgtactattttaagttttcccacatgaatttatcatttaatgtaaaacataagtgaaaataaaaattttaaagcataaaacaaaaacatggccatgtaagcttcaaactcaatattttgttggtagagtgaaagaaagaagccccaaattatctgaaaaacaacaaatacagcttaggatataatcaagactgtcaaagctgagagtctgcttggtgcaacctctccttatggagatgaggaaaccaaaactcagagaaagtgaattttatcaaggtcataaaaccggtcggtatcctagaagccaggtgacttgtctcaacccaggaacccaccattcaccttgccactatgctccctctagttgtttaatttcaaaccatactgaaccatcattgacactggagctcatgagcttcacttgtggttgaggttccttaaaaccaccgcttttgacactgagggcagaggaggcctaaggcagagaaaaagagaaacaaagtcctcagcagagcatgggaaggcaaaacatctaaatttgtgatgaacaaaatactccttgggataatattccagaacattttagggagagaacaatagttccattaaaaaaaaaaaaaaaagagctaggcgaggtggcttacgtctgtaatcccagcactttgggaggtcgaggcagatggattgcctgaggtcaggagttcgagaccagcctggccaacacagtaaaaccccgtctctactaaaaatacaaaaaattatctgggcttgttggcaggtgcctataatcccagctactcgggaggctgaggagggagaatggcttgaacccgggacgtggaggttgcagtcacccgagatcacgccattgcactccagcctgagcaacaagagcgaaactccagcttaaaaaaaaagaaaagaaaaggcagagtattccaaatgcagtatctgaggccaagccggattaagggcagactgccacaaactgcctcaaaaaggctaaagacctcgtcagctctagaccgttgccagtccccccagaaaggaataacccaaacagaagatttctccatagaagcaggaatgcatcaaagctaaagcagggacatcttttttgtttttccttccaagagagtcagaatttaaatttagattcccatttatctttttctttttcattgttttcatctccttttccctttttcttttttttttttttaataattggctttctcttctgtgtttggaaattgataaaaccatgctctgcagatgtgtgaccagaaacatttaattggcattattcaatataaaggaaaaaatcacacacacacacacacacacaaaaccgccagtgccaaggcatctgagatacaaacacacttttgattcaatgactgtgtccttggtgaagcaaacagtcaacacgggaatggggcggggggtggggttatttacgtaggacatgaccctctggttagtgctgcctggggcaatatacacttggtcatttctacaaagctctaagtgtatgctcaaggcaagaaagtcgcccggactcaattctaagccagcacaagatttgctatataagaagcaaacatggaaaaggtaaaggcttcaatcctgaacttttgccttttgcaacaccaggaaacagagagccacagctcgtagagaaagtgcttttggcagcttccctaagccaggagctgcagacgatgagggaggccagtgaatcagaggctgcccagagcacctcctggaatgtttcacaaacgtctttttggcctcggcaggtttcagtggcttgctcttctatgtcctgggcttgcttccctcatttttaaaataggttttagttacacacatacacatatacaatgccaagtgaagaaaacaaaaccataagggtaggctcaactacgaaaaccatagcggacaggcctgcaaggggctggctctgagtagatcatggaaagaacagctggcgcccagtggctagaagtcacacctaagtgctaggaagacacagaaattacttggctcccttcaaatccttctcctcagttcacatgtgagtcttggaaggtgaagaagaatatcttcggctagtatgcgtttcttgttgtatctccctcctctctcctttcgacaacaaacttctcagtggaggtatctctactcttggcactttgaggtgaattttttagaatatgtggttttgttaatgtgtcagaggcacaattccatttaagtgaatgggtaaggcctccccaagccctccatgactttttccatccccagcacctatttcctaacagtacttcggttccaacaataatagggagttttcacaggctgtagactgtggttcattagtttactaaaaatgtaatttccacaaatccatattcatatgaacagataattaaacaaataaatggatgaaggagagacaaatctcccttacagaggaattcaaaatcatttatgtagacacaccatgctcaaaggccggggggatgggaggcaacataactgcaaatagtgagttcattccaaagaacacaggattgaatgagtggtggctgatgggagttggggggcaacattactgtgcaaaaacttggaagatactaccttggccaggtgatcaaggtcaacattaacagtgacaagtcatgataatggtgtgcacccttgatgtgatgtaattagaataacactttatatctgtagtcttcctccaaaaacctataactccagtctacctaagagaaaaatatcagacaaatttcaatagaaaggcatcttacaaaatacgaaagcaacactccttaaaactattgaggtcatcaaaaacaaggaaagtttaagaaactgtcacagccaaaaggagcctaaggagatatgatgagtaaaggtaatgggggctgagcgccatggctcacgcctgtaatgccagcactttgggaggccgaggcaggagaatcactggaagccaggagttcaagaccaacctaggcaacatagtgagaccctgtctctacaaaaaattttaaaaattagctgggcatggtggcatgcattcgtggtcccagctacttgggaggctggggcaggaggatcacttgagcccaggaggaagagactacaatgagccataatcatactattgcactccagcctgggcaacagagtgaaaccttgtctcaaaaaaacaaaaaacaaaaaacaaaacaaaacaaaacaaaaaggtaatttggtattctgtatgggactctggaacagaaaaagatattagataaaaactaaagaaatctgaataaagtatggatttaataataactggctcactaattataacaaatgtagcatattaatgtaatacactaacaacaggggaaactgggtgagtgagtgtataggaactctcttctcaattttaatataaaactaaaactggtttgaaaaacagcaaattttaacgtgcccagtgaataccaggaactttgctggctactctctttttaatagtcaatattaatttaatagtcaatggttggggtatgtacaaatggacacaatctttaagagaaaatctggtctataatgtgtcccaggggaataaatagatattaagctaaaactttttaaattgcttctagaagtgttccctggtctaataagactgggaaatgttgggctaaagaaagttaaaataatttattttattggaagatttgtcagtctttagagtaatagggggtaccaagactttctgaaagagatatatgaattcaacaactcgtttctcaaacttgcaaggctgatattcttctggataggaatactaggaaatgctggtccactgtaactcagtggatgtcttggcagagtactgaattataaattaaatatgaatgaatattatattaagtccctactgtgtgcttagctctttaaaattaattaaagaagctgtttaggacacggagccagagaagggaaaaaagcggacagggaatgttgaacaaagcagtttcatgtgcctagaatgagggactgctgttcaagatacagagtaatagaaaaacaaagcaaaacaaaatacaggaaaagcaagggttataaaagactgcttgaatatctgctgacattttccataagcacgtgatgatttaaaaagaaaatttcaaagatggcttaacttccgtatcagttttcacaggtagttagcaaagccttgctaaattaacttcagttacatatattccaaattatctatcttttagtttttttttttctttaaaaagcttgcttctataataaaaccacatcaactattccaaataacacttctaacatcatcctttaagagtagaacaggtaaagccggcacggtggctcaggcagtaatcccagcactttgggaggctgaggcgggcaaatcacctgaggtcgggagtttgagaccagcctgaccaacatggagaaaccccatctctattaaaaatacaaaattagctgggcatagtggtgcatgcctttaatcccagctactcgggagtctgcggcaggagaatcgtttgaacccaggaggcaggaggttgcggtgagccaagaccacgccattgctctccagcctgggcagcaagagtgaaacttcgtctccaaaaaaaaaagagtagaacaggtagaggctgacattgtttttaaaacttgaatgcagtctcttcaaaataggtaaatatgcaacattcaaaggcatacactgggtaatacacttgatatggcatctgggaaacttcctccttggaacaagtgtttaattcagtttgatatttgggccagtaagttcatataaacttcatcagaaacactttccaggaacctaaacccaacatgagaggggagcataaaagcttccaaaagttagaatgcaaagctttacaatcacctcattctcttcttctctgtcacagagggtgaccaattatcctggtttgcctgggactgaggggtttcccagaacacaggtcacagtgctaaatctgggaaagtcccaggcaaatgggatggtttttcactccaggcctatggccatccatagacctagggctaactcagggcagcagaactcaaatttcctatttccaccctaatgccttcccttaaaaagagaaccaggagccagtacaaaatgacctttcattattcagaactgtcaggctatccagattagctgtcagtgtgtcctccttggattaaaaattggtggttgtccttttgtatccatattatgtgataattggaatgggaatattacatactcattttgtctgtaatttttgaaggaaatcaagcactatttatgacatttattttatgactgcattatatcacccataaacatgcacttggttaaatgcaaaagtcaggaaaacctttcctgttggactcctggttgagccatacatctgaagtaaagctcttttaagaaacattgaactattctcttcctgtgatttgaactaactctcatgttcctggacttgtgctctttataaacaagacctgggaaagagcaaagtctccccctacccctcaggaccaatcacaatgatatggatcttcctttcttacaaaaatggaacaaaaataattttagtgcatttcaaatctgattaaggcacagagtaggcactaaatacattctccccaaagtaaggttaagggaggttagaaattggtaacaaaatatcagttccatttatagcaagatgatcatcataggctttttaaatttcaaatagaaacataatcaagatgagaactgagaaaaaaactggcaacgcctcacccataactcatcttctctagaggatgcattttaacccttacctctagagtttcataggggaatatccaaagggtaccacattctagttgctgcttcctcttacttccagagcatagttgcctgcttagccccatttcattctgagtttcacacatgatttacaaactcatcactttccccacagcactcattataggtgagggccatgtatttacccgagtttgtgctatcaccatagaaattcaggatagaagggtcttagtccatttagagcaatggttctcaaacttttctttagtagtagaatccttctccagagccaagtgtacggcttgaagcagaggctatccttatgtcccagggttctttcatcagctgaggaaattagcacttaaagtcagcacctttgactgtcttctctaaatcatcttggtcttgctttcactctgctttcccttcaggcatttctcaagtgtcatgctgaaactttaaacaaatgtttaaaacacattgaacagggcccagcttttggaaactgaacactaaggttagcttctgctcacatccccctgagattctagcatgggactttgggacagactttaaaaccaatgatttagactaattcagttattttagagatgaagaatattggaagattaaatgcctcagcccagatctcaggaacaggctgcgacaaacctaggaaacccggaacgcctgctagaatactacagctggcatcagctgcatggatcaccaattactgcccaatgatcaccaacggatcaccaatcactgcccaatcctttttcgtagtcatcaaaatatacgtgataagttaaatttggtgatgaggccaagtagtgtttccttttccctatttcatgaaaaagtctaacagactattttaattaacttatttactttaaaatgatgggatcaacgtgaatcgcatgttttgatgacaccatttgtgtgacctcactttatagaaatggtagagcattttgttcttcaatcctccaaaaaaaaaagacaaaaatcaaataaactttgaaaactcacatttcataatttagaaaggcttatatatgggaaggagaggtgctgccatcagccaatggtagaccttctggccatagaggctttgtgggaataatgatatgcaactgaaagaagcaagccaaaacatacaggtgtaaatcgtttctgacttatgtgcagacccagccacatcaagctttgaaaaatatttcagcatcaagagtgtctgggtgcagctgcgggtcttttcctctgtttatgcgccgtccatggcttaactcatgtgaactggccaacgtcaggtgtcacgcagccctgtctgatggaaaacatatgtctacagaggtaggaagaaaaacccagccacaatccagccttgactcagtcacgatacaatgaagggaaaaaaagggctgcagacgcgtctctcgccctccttgtgtctctctcagctcctgccaacaatgagccgcttgtttctcttatttcccagaaacagtattagccatccaacaaggtcagcaaaaaaaaagcagcttttcacttcagggtgcatttggttccaaaaatctgtaaagtattaaaccgagaagttgtactatcccaacttcacactgagccctttattccaattctgggtgagaataactgcaaggaaatttctcagccggctcagttgataaggcacagagctctggaatatatgttgattcagccacactttcccagcttcactgtttcaagccttaaaaccacttccaggtgccccaaagcttgccagatgggcctccggtcctccagatgccccaagcctgtctagttttagacttgtaacccaagcttcgtttacttcacaggaaaccctgaatttttagcaccaggaaatgattttcctacttgctatcctgcctgcccatccaaacaataatgtagtccacacaccagtgtgcaagtatctaggcaactctcctttttcaggtgtaaaatagaaatgcctgtaacactggcttttatattttcataataactgcattaccccaaatgtatattttattggcatttaaaggattcagacattagttctcatcattataatatatccagggaagtctagggaaaaaaaaaaatcacatctttctggcaggctgatttcttctggatcctttttcctgtaaagaaagaactctttcttccacctaaagcagcatcagaatgtgctactctgactccatttgattgcagggatatctcaagatttatcacaagtggcccgtggcaggaagcacctctatggagttagtgaatttagaaaaacaattatctagcctgtgaaaaagaggaaatttagttattcactttgctgcttcacaaagttgtccttgtgattttgaatataattccatggttgggcaatagcagtacaactacaactgttttgttatcttcagacaataggtatacttttatccagcaggaaatggaaactctgattcatgcatttatttttctttagtcagtagagagtttattgtagctttttattggttagctttcctgaatcattttaaaactactccaggtgcgaagtatggcagttgcccaagctaagagaaaacgaatctacagctgtgttccacacggaatggaagaaaagttgccagcgtgagttgctagtttttaatgtgtgcatgtgttttttaatagcatgcccttttagtaaacatctttattatggagatcatgtaacagatactaagattccaagaggtagtcaaaagacttgaacgattcataaaagagaacatgcaattagtaataaaatatggcaaattatcagcttcgtaaggaatcacactaatgcaaattaaagaaacagcctttttcagcaatcaaataagcaaaaacaatagtgtggtttaggtgctttgcattgggccaggaccactcaggaaaaaaaaaaaaaacgaaagaagaatgtaaccaggggtaacaggattaggaaatctggtagaagtatatgccaaattttggaaacctgtataaatatgcatttcattgaggactgtacccatatatcttataggatttctagtgacccccaaaaagttaattacctttgaaatgaaaaagtattagaatattaacagtggtggtgtttcgcttatagaactatagatgattttttttctttccaatgatctacggttcacctagctattcatttcccctgtttctaggaagtagagatacaatgatgaacaagacagcaaggtccctgccctgtaggagattatcgtctaacgaaaagacaggctataacaaatgtacagaataattttagtgataagggatttgaacaaagaaatgtggagctattttaggcagggaagttaagaaaggcctctgtgaagcagtgatgtgtgctctaaatctgaatgaagtatggaaatcagggtgggggacaagtacaaagatcctaaggtggaaactgtgagcttggagtacttgtgcaaaatcagagcagcccatgtggctgaggagcagagggtgaggggccgggaccaggtcccttgaggcctcttgcctgtggtgagcactgtggttggcctctattccagactgatagaaatctccttccagctgactgcctggactgcatgggaaactgccagattatttcacactctatggtaaaatttaaaattctgaagaaatccagagactctgggggcacacagtgaagtgagtcaaaaagtgtgaagcaggccgggtgcaggggctcatgcctgtaatcccagcactttgggaggccgaggtgggcagatcacaaggtcaggagttccagaccagccttgccaacatagtgaaaccccgtctctactaaaattacaaaaattagctgggtatggtggcacgcgcctgtagtcccagctacttgggaagctgaggcgggagaattgcttgaacccggaaggtggaggttgcagtgagccgagatcgcgccactgcactccagcctgggagacagagtgagatgccgtctcaaaaacaaacaaacaaacaaaccatgaaggaaagaggccactccttgggatcaatgcctctcggtttgttgtctctcagccctgtaaagtggttcaggatctttgggaaggaaaggaataaggtttggggcaaggatgggggaacagacagaaaccaaagcagctctgcttttaaacacttacaaagaggagattctgatcccaagcaaaacaaaataaaagcctgtagctctaaattttatttgagaaggtgtgtcaaaaggagcttccttcttaaaaatgaaaacaaaacatacaacaaaaaaactacagttctggattttctaaatgttatccttgaatcaaaatgcatatgtagtatacactcattttggtcttctgtgaacactggctggtgctctgagatcatgccactacccagtatttaaaaagactatagaaaacttccccataaaactcctagtgttccctactggaatcttctttttttttttttttttttttttttttgagacagagtttcactctgtcacccaggctggagtgcaatggcacggtctcagctcactgcaacctccgcctccctgattcaagcgattctcttacctcagcctcccaagtagttgagattacaggcgcccaccaccacgcccagctaatttttgtattttttaatagagatgggatttcaccatattggccaggctgatctcgaacgcctgacctcagctgatccgcccgcctgggcctcccaaagtgctgggattacaggcgtgagccactgtgccaggccactactgtaatttcttttttaaggacattgtcccctagatcacagagtctagatgacttacggggaagtacaggagaactccctcttacatctctgtgtctagaaaaactacatttctcttcaacaccatgaaagcctttatctcttgagtgatctgactcctataacagagcatattatcttctttacaagatcccccaggaatctcacagccaaatctgtaggtacctctagcaaccacacaaggccccatggtatgcattttttccctggctttttttctcagccacagtcctttaccccaacttaattcaattatttatttttatccttttgaattacatgttttggccaggcacagtggctcacccctgtaatcccaacactttgggaggctgaggcgggaggatcacctgaggtcaggagttcaagaccagcctggccaacatggtgaaaccccatctctactaaaaatacaaaaattagacaagcgtggcggtgtgtgcctgtagtctctgctactggggaggctgaggcacgagaatcacttggaccagggaggtggatgttgcagtgagcggagatcacgccattgcactccaacctgggtgacagagcaaggctccatctcaaaaaaaaaaaaaaaaaagaattatatgttttttaagatgcaagagtagggaacaaatgaatggaagcatcataatttcattttaaaactactcgtgtgtcagtcacagattgccctcaatgagaaacttgtaaacctgtgaatgggccccaagcagtacacctgccagtctaggactcagaatgaagtgaaggagaaatgggttttttgtggtcttgagtcacactgagacagtcaactgcttgtgactctaataaacatagcctaccttttgtaaataaattaaaaaaaaaacctacctgtgtgtatatagctgcacagatatattatgtgtcaaataaataatgttctgtgaagcttaactgagcaggttggaaattttacttgttagtcatcccgaggggaagagtttacatgattttaggccataccttatagagacctggtagaccaaaaagcctttccacatatttcattagctttacagaacatattcattagaggagccatttggcacaagcatgctctgctgcccccaccccaccttccatagacactaccttcatcaagtgatcaaagctaatgtcacctatagtggaacaaatcgtgtgcctcctgataggattcaatgagaagaacacaacatcacttccatggtattcctgccaaaaatttataacctaaaccaaaatcacgaagaaatgccggacaaatccaaatttaaaaatgattcacaaaataactggcctatatattcctcaaaaatgtcaaggtccagaacacaaggaccgaagacttgttccaaattagaagagattatggaaacaggacaactaaatgcaatgtgagatcctcaatcacatcctgggccagaaacaaaaatagccacaaaggacatcaccgggacaactgaagacatttcgaatctgggctattagataagagtattgtatcaatgttaaatttcctgattttgatacctacactgtgcttatataagaaaatgtccagctgggcacggtggctcacgcctgtattcccagcactttgggaggccaaggcaggcagatcacctgaggttaggagttccagaccagcctggccaacatggggaaaccccatctctactaaaaatacaaaaatttgccaggcgtagtggcacacacctgtagtcccagctacttgggaggctgcagcaggggaattgcttgaacccaggagatggaggtttcaatgagacgagatcatgccactgcactccagcctgggcaacagagcaagactccatctcaaaaaaaaaaaaaaaaaaaagaaaagaaaagaaaaaagaaaaaaagaaaaagtcttttgagaaaatataagtatttctgggtaaaggagaatgatgtctccaactttgtctcaaatggttcagaaaaaaaaatatgtagatagatagatagatggatagatggatagatgcaaccgtggctatgtttataagcaaacaattaacaaaggcagatctggggaaaaggtatatgggaattccttagactaaacttgaaactcttctgtaagtttacaattctttcaaaataaatagtgacatttaaaaaaataaaacctctctacacatacctcaaacctcctggagacagaattctcagtccggcagggaccagagaaactgtgttatgtatgggccattgttctgtggcactgttgaactttgaggaaactcctattaaacaatgcttttgataactgattggaatttggatggaacagaatcccagctgcaatctgtgctacataattctgatacctcatactcatagttccttccagcctcccacctctatccccaaccccaactgttaaatgattctaattttaaaacatagacagcctaggaagacaggacaaagagctaccccaacagaccggttggaggtctttcagaagaaacgccactggatagctgcccctgaggaccagacacccagaataggaaattgcaggttttcttgggaaggacctgggacaccaagagagttgactgtcaagcttgagatctgttgtgaaaggtccttacatcccagggtcagagctgagacattgctccatttaggtcttcttgataggaggaaaaatgagcaagctaagagtggaggatggagaaggcaccagtgaatgcaaacatatgaaatagggaatgcctcaggcgaaagccatctgattttaatatatcgtagtttcgacactgagattccctcaaattgcaggaaaaatataatgtgtacttaaaactagaggagacacagaggagaggagaaagcacaagcaaagaagacatgctgaggatcccagaagagaagtctcccaaggggcagccctaggctgcagtgacccaggcagaaatgatatagggaaggtgtccagaaacctccagcatggagccgccctgagcatttgttttgttaggatgggatgatccaattccatttggagagaaattatagttccattctaattaattcaggcattacagcagttgatacggcagaaattaagagaatatttttcttgacatttgaagtgtgagctttgaagcagctaaatgaaggccttgtgaaccaagactaaatcagccacattaatttttttttaactttctttctttccagcgctgcaaatatttaagtcttggcaaaattcaaaactcacaactcactcttcactggtatctgagaaatataatactgaaaaggaaaaggacgaaaataatatggaatgaaatgcatgacatgtactgggaagcaaaataacttccaacgaaacttccatttatggcttagtcaaaaacatatggatatacaagctgaaaaacagagttagtgggaaagctaggtggctggttaaaaatacactttttgtggtaatgttacattattttttaaaagaaagtaacacccccccccgcaaaaaatcccctgctccaggatctttagacaattccttagtttgataaaagcaaaccatgtcaaaattgtattttttaagaaatgtttatattttattcagaaacattccaaagaaactggaaaagtgaggaaattaaaggtgggcacaaaaatgtatgtgtgtgcaagaaaatgtattgaaacatcatttataatgataaaaaatagaatcaacctatatgtctctcaatagaagaattggttaaataaattatggcattattggttaaataaattcacaaaaggactactgtgcagccattaacatgatgtgatggtttatgaacaaaagaagtatgtccaagtctattcataagttaaaaaaaaagaacatactgagaatctagtttgtagctatcagaatagtaaaggctataagtttaatcatagatattattggccagggtacggggaagaaaacacactttattggtaggggtgtcaattggtatacctttttggaaagaaatggaacaacagttttaaaaactttaaatgtacatactctttgatccaggaattccacttctgcaaaattatcctatacataaacagcatatggcacaaggatttatgtccaaggctgcacactgtggcattgtttagtaatagtgaccaaccagaaaataaactaaatatccagcacacaggactggttaaaccaagtacagtatctcaacggagtggaacattacatattgctgacaaacaatgaacaaatcagtaagtactaatttggaaggctctctaagatatgttaagttttaaaaagacatactgtatatgcccaagcatgcatgtgtatgtagagcatgtctagaataatgctcaggaagctggtagtagtgtttccctggaaaggagaaaagggctgggggtcatggtgggaaggagacctaatttttcataaataccctttggaactatttggattttttgccatatgcgtgtgttacttttctaattaaaacaactcatcaaaaaatattatagaaaaatatttactggccaggcgcagttgcttacacctgtaatcccaacactttgggggccgaggcgggcggatcacctgaggtcaggagttcaagaccggcctcgccaacatggtgaaaccctgtctctactaaaaatacaaaaattagccgggcatggtggcgtgtgcctgtagtcccagctactcaggaggctgaagcaggagaatggcttgaacctgggaggcagaggttgcagtgagccgaggtcttgccactgcactccagcctgggcgacagaacgagattctgtctcaaaaaaaaaaaaaaattactgaaatgggaagatgctcatggtatattaaaaacaagctacaaaaaagaatatagaggagtttccaactatttttatgtttgcattgaagaaagtcaagaaaatatatgaaaacacactagtgtcattttgaatggtaccatggctttttattttctcatgttttgccaatcagcattttctacagtgaccaaatagcaattatgtaatatggaaaaaaataacattcttgaatcttgctgcttcaaaaatgtttagaaccttttttttttctgccttaaaatacagacacacacacacacacacacacacacacacacacacacacacacacaaagggggaggggtgatcttctttttagcacttaaggagaaagacaatcaaggcttttgttttcctgaggcttcacttaaatgatattgttttgctgacttcatcctggagaactattcagaataaagcatggaagaacagctgttcttgaccaccagcaactgcaaaacacccagggaataaatttagacttccagaaaggaagaagaaatcaatcagttggtacctgggtgggagaggtgatgatcacacacaggcgggagcaatattaccagggacgccaaagaggagatcaaagagaagtgtcaaaatatcactcagcacttatcaatttggaacaagtggctgaatgacaaaccacctcgaatcccactgcctgcctttcacccttaactgggtgaaattctccatagcaaggaagctcctgagggcaaacttttggaagtcagccagcaaacaggatgaaaattgtcaaaattatttttaaaactctcaacagaggtctacagctcggtgaagaaattagactccattacaaattaattaattaactaattaattaatgtggtgcaaacaaagaaaggactaaaaaagaaaacaagtttgacctagccttcaccttcctaaaaggcctccctcttccccaggtgtgggggtgcttctctggaattcgtcacggtttaggcttacgaaggcctgatggattctcaggcccactctctgcaagcaaaactgaagcagacttgtacatttacccagtggattaaacaatacatttcaagaatctggatcccaagctataattttcctcctcatttttgaagtttacttggaatatttggggtcaagatgctctgggaagccgcttcagcattcacttacccaatgctcatgtgcgcactaacaccaagcaccaaaatgacaaaagtcaatgccctagtaaatgtctatttcagacaaagaatcagttaaaaagttggtgggcatactccaagtccttttcagataaattaaagactgaacgattgagtaggttcttgtatttttattatactggcattttcccatcactgtgctaacgtacacaattctttttttgttttgttttgttttgctttgctttgaggcggagtctggctctgtcacccaggctgcagtgcagcagctccatcttggctcactgcaacctccacctcctgggttcaagcgattctccttcctgagcctcccaagtagctgggactacaggtgtgtgccaccacacctggctaatttttttgtgtttttggtggagacggggtttcgccatgttggccaggctggtctcaaactcctgacctcaggtgatctgcccgccttggcctcccaaagcgctgggattacaggtgtgagacactgcacttggccttaacatacacaatttgattgtggctcccacacctggctgatgatcagagtcatctgagcactcgaaaacagcatacctttccagattccaccctacatttactgacacagaaatttccagggcatattcctcctagcagcagcccaggataattcttttgggagcaaacaaaccactgtattctaaaaatgtatgtttaacaaatgcccccaagtgatccagctagtggtagatctggaccacgcttggataaacactgatcttagagactagtgaataatctatttgccacaggcagacttgctcaactgcagaggcctgagcattcttggttttgtctttaatacacatggggcctggagccttttttccaacacactgttctcctcttccaccacaaaaagctcaaggttctcccctgttgttctcactctttttttttttttttctccttttggctattacaaaagtaatataaccgcattacagagaaaatagagggaatcacccttaactcaaaggcttaactataatcactattaacatttaaaaatacataactgacttactcaacacatttattctacagaagagtacacctatgatgcctaatgagctttgcttggggctagaaatacacagatggagatcaagttcctgtcctcaagaagcttagtcttgtgaaaaaatggaaagaatctaagcaatgtgtttttcaaaaaaatagaagtataattatagcataaacaatttgtcatgctgtgtaaaattagaatgttacaacaaagttttccatgtgtctacatggtctatatccattatttcactgcttataaatatatttgtggctaggcgcagtggctcaagcctgtaatcccagcacttactttgggaagctgaggcaggtgggtcacttgaggttaggtgtttgagactcacctggccaacgtggtgaaaacctacctctactaaaaagtacaaaaattggctgggtgtggtggtgggcacctataatcccagatactcgggggctgagctgggaggatggcttgaacctgggaggcagaggttgcagtgagccgagatcacaccactgcgctccagccagggcaacggaccaagattgcatctcagaaaataaataaataaataaatttatttattttcatatttcaggcatttgtttatttactggctattataactaacacatctttgtgtatggttcccaaaatattcacctagcatactactttttttttttaaggaaaattgtggcatcagacatttttcatggcttttattatttcttatcaaagaagaaattttctacctaaatttctaaatttcatataataaaacctataagtctccatcacctaatcttaataaagactcatccacattaagataagtggaacatagccatgaaaacataagatttattttttatatgctattatgtcctgctttattacataaaaggaactcaatccgttgatttggtaatttttttcagtctcatttcacatattccttaaaaaccgtaaaagaaaggaactataaagaatgtccttttcaggccgggtgctcgtgcctgtaatcccagcactttgggaggctgaggtgggcggatcacctgaggtcaggagtttgagaccagcctgaccaacacagagaaaccccgtctctactaaaaatacaaaattagccaggcatggtggcacatgcctgtaatcccagctacttgggaggctgaggcaggagaattgcttgaacccgggaggtggaggttgtggggaggtggaggttgcggtgagctgagattgtgccattgcactccagcctgagcaacaagagcgaaactctgtctcaaaaaaaaaaaaaaaaaaaagaatctcctcttcgaaaccccaaagaaggtagccttcaataatgctgattaactagagtgtatttgacaatagatagcttcctcaaaatctaagaaaattgagggcacagtggctcacacctgtaatcccagcattttgggaggccaaggtgggaggatcacttgagactaagagttcgagaccagcctaagcaacatggtgagacgccccaatctctacaaaataaaaagaaaattgattttctacagtgtttagaaaacttttccttcttttttttaatcaagaaaatcatttttaaatagaaacctttccccctgtcctgtgcccaccagtgttccttttcttccataaacacaaactttccaccacaacaatcctacaacacctacaacacccacaacacccaacacttcacttccaccatctcccaaaaagtgtatgggtatttttttgtttgtttgtctctgggtttgtgcgtgtatgtgccggtgcactttaggctaatctatgctgcataaaccacaaagttccaaaagcagtgagaacatcagagctggaaaaatcacagtagccagatgtgtctgccgtgaactcaccatgtaaatttgattaagaaaaaaactaatggaaaaaaaggaaaacataagatgcctaagtagaaatctgacttctagtgaactttcagcatgtctttccaagtgctttaagcaacccagggcttcgatatcccttagctattttatttgctcttgatacaatgctaagcctctttgtatacttcctagagagaacagcaagccaacttagcaaactgagcacagacaagattttccatcttgtcttgaaaagtatgccctgaaaagaaaaaaaaaaaaaaacacacatgtgtttataatttgaagtacagctcgagacacagacctggaggacttagactctgggctggtggatggcacatcttcaaaggggtaagtaagtgcgtgtgtgtgcatgtgtgtatatgtaactttaaaaatttcctatagtattgaaaatacactctagttgcactttaccaaaagtttctgaattggctagggttcgcaggctggtgaagttgttatagtctttattttttcctgtactgtcaggaaggatactagcatctcaggtcagggtctcattccaacaaaaagcctcattagtgtgtgacagcagctcagcacaccatggtttatgatcactaggattatcaccaaaaaggcaaaaaaaaaaagaaaggaaaaaagcatgacactttcttttggtaaaaacattttaaaatatggagctactttaagttgttgcatgttttcagtatttgtctgctgaggaatgggaaaatctaacacttcactacttgcagaggggaaaatgttcttcacttagaactcagaagtgtgactgctcttcacaaactccctctgtgaatgacctgacagtcacaagcttgctcctcttcatcttctcacaattgctgtccgaggttaaatgttattttttggtaccacaccagctagtttcacaatttgtaagcaaaagtgcccaaacaaatataagttgcagtaaccatggttgggtcttcctgaaggaggaatggaatggctttctaacagagcatatcaaaggatcttcctctgattacacaggagccagaaaggggaggaaaaatgaggcaactggctaacaataatagctataacaatacaagtgctggcagcttactatacatcaggtaccaagacatggactacctaaatactcaaaacaacgttatcagataggtactatcattatcaccattttacagataaggaaaatgagactcagaggttaaataacccaatacataaacgtctaaattaagagaaactcagttctgacttcaagttcttccaaaacagtccccaccctccatcccacttccatgcccacttcgccaccactctaaccaaggactaagatctgcagcaggcttcattttctcaagcccattgttttatacattataacagagcctgtgtaggcagtctatttttttccctcttttgtttccctcttattctcttttttaaaattttagtaagtattaatagtaaggaaggcccacaacctacttaaaacatacaaacttctggctgggtgcagtggctcacgcctgtaatcccagcactttgggaggctgagatgggcggattgcctgaggtcaggagttcgagaccaccctggccaacatggtgaaaccccatctctactaaaaatacaaaaattagctgggtgtggtggcgggcgcctgtaatcccagctactccagaggctgaggcaggataattgcttgaacctgggaggtggaggttgcagtgagccaagtctaaagtcccccaaggtcgtcttttcttcttccatttattgcatatgtctgggaattcaggcttaaaggccattactctgctcagacagaatccaaattggtaaagcctgatttggcaaatacaaaaactaaaattttagttttaagctagacgaaactggagatggctatttgaattaaagtgcaaaaaaaaaaaaaaaaaaaaaaaaaaaaaaaaaaaaaccatatttttgcaattttccccttcagagcttatttcattttacttagactcagtgttcaacaaatctgccaacctgcagaaagaatcctctgtttttacaaagtcactcactccaggatgactaagtaatgggtctttcctcttgcaataaaaatatggtttgatttacaagtcgcattacaggaatacatctaaagctctttttgttgttgtttttgttgttgagacggagtctcgctctgtcgcccaggctggagtgcagtggcgcaatctcggctcactgcaagctccgcctcccgggttcacgccattctcctgcctcagcctcccgagcagctgggactacaggcgcccgccaccacacccagctaattttttgcatttttagtagagacggggtttcaccgtgttagccatcacggtctcgatctcctgacctcgtgatcctcccacctcggtctcccaaagtgctgggattacaggtgtgagccaccgcgcccggcatctaaagctcttataaaaaataaggtgtctagtgataagaagtttctcctgggagaggtaacttaaacatttccaccagagggcactatcctcactgaaggtaatgaatacattgttcctaatttaaaacactttgcaatctaaccagcccaaaataaatcatttttattctagaaagcacttataaagaacagttaaattgtcttaaaatataacatgctatagttaaataaaatataaaatattttttgccataaaaataatgataataaacatatattttagcttactatgtggcaatcatagttctaagcactttgcatatataaactcgtaagttcctcatatattaataatccccattgtacatatgatgaaatcaaagcacagacaaataacttaagggtcaccaaactagtaactacagagccaggattcaaattctggcagtcagacacccaagtccatgtacctaacctacagaaacatacagggaccaaatacaagatttgtttctgaatgtagttaactatgccactgattatatcacggctctagaaataaataaaattagttataaaaggtactattctatcatctgatagtaatgctattaactgtattttgacatccttttcacatgtatataaatgccttgcattaaagaagacctatcactttagttcacttatttgacagctacattccattgaaaagtaccaaagttctagatttaagaagaaggaagagtgggaggagaagaatctgctcttttctttttctagtttttaagagttgggggtctcactatgttgcccaggctggcctcaaactcctatgcccaagagatcctcccacctcagagccttccaagtagctgggactacagggatgcacctctacacccagctctgctctttttatttttatatgtttaaagatatataataaagactatgaaccacaggcagagttatggcttgaaatgaaatagtctgagtaaatcatttattattctgactgtattgagactctctaaattaagtcctggtctttggaacttacttggcattccaagttgtatttccatccttcagacacatctgtgattctccataagctagaaacacactttgcaatgggcaaatacacaaatattgttggaaaaaccccagaatgtgcgtcttgagaaattcactgccttattagaaatctggaaactgctgggtgccgggtctcacgcctgtagtcccagcgctttgggaggctgaggcaagcggatcgccaggggtcaggagttcgggaccaacttggccaacatggtgaaatcccgtctctactaaaaatacaaaaattagctgggcgtgatgatacatgcacatagtcccagctactggggaagctgaggcatgagaattgcttgaaccaggaggcagaggttgcagtgagctgagatcgtgccactgcactccagcccggatgacagggtgagcctctttctcaaaataataataataataataataataataataataacaaaaattaaataaaaatagaaatctggaaactaaggtattttactgagctacaggtaaatttgtttcagaatgttcagattacaacttctttagatatactttactagtgcaattggactttgtgtgtgtgtgtgcatatgcatgcatgtatgcacatacaggcagactcacatgtgccttcaatatctagttccaagcattcaagcttcttttaattagtccacttcctacatatcgcacaaattttaaaaattaaggagaatgcataaaagaacatgacaaaggatatccactccagtatttgtatgctagcaacacactagtaacaacctaaatatctaccagataggagttagttaaataaactaattatagcatattaatatagtagactaataggcaaatttttaaaagaatgaagcagctctatatgtatggacaggcaggtgaaaaaagcaagatacagaacagtggttatgatatgctaaccttagtatgattaaacatacacacacacacaactagaaacactggttggctccaggaaacaaacttggggactgaggaaagggagattggaggaagtgtttgaatttttttttcttttcttttttttttttttttttttttgtaaactgggttcatgaaagatttttttccgattataattgattacaaagttaaagttaaaactttaataatcagtttttagaattttcgatgaaaattaaatggttaaacaaactgtaaaaaccagtctaatgccacctaatttggggtctctttactacagtggcatctgatttctacacgagctcctgtatatttgggacaaaataactcactggaggctttggtttaccactgctggtaccagaactggttgcattttctttgatctgccctttagataaggaactccacagaggttgttccatgtcatttgctttttggaaactgtacatctgcaagctttaaagcagtaggttcagacttcctggaagaactgacacttgaagctgactagggtctacttgagttcatactcactttggctaagccacagtatgagggaagggtgtccaggaataacgcttccatttttatcttgttcattcctgaaaatccaacaggagattcttttcactccctaaaattaactgttctgtgtataaagcatatctggatatctgatcttaaatggaaatgttatctgaaaatggcaccaacttttctaaaactttaaaattggcccttttttatttttagccctgggggagaaggaagggaatgattaccaaaaaagctgactggttccgttgctgcagtgtattaattcactggtgattatctctagtggggataattttagcagaaaatattctcttctcaagtctaaaatcgcacttattaagtattgtaaatgaagtaaaaagtgagccatattatcccacggcaggtatggggagaagccacctgcaggttatgtaatggttaactcccttctaaaatcagactagcctgctctccagctctgctctccacaagctgcaagactttcggaaagtttcttcatgtataaactggagagcctgctactttttgcaggggttttggaaggctttcataaggtaaggcatggaagcacttggcatgctatctgacacatgttatgcagcaattatgaaaaaaaaaggaaaaaagggaaataaggatagggatttgagactagaattgtacctgtaggcagtcgccaggagccaaagtcacccaaagcgtgtatgtgtcctacttgcctcaggctagatgaagacaggaggcctaactgatttttctaccccaattaaggccattggagggaaggtcagaactgtagtttaaaactgaggcagcagtatcatgagttggtggtaaagagaccaagtaaagaagaaaaagccggcagaagggtaacacggtattgcagccaagaagaaggagcaaacaccgtctgggtgcatgaagagacatagaaacagccagaaccacttatgagccccgccaccccttgattgaacaccatttcttcagcttggagtcaaagcttggggctccaccaggcacagtggttcatgcctgttatcgcagcactttgggagactgaggtgttaggattgtttgagcccacgagttcaacaccagcctgggcaacaaagggagaccccaactctacaaaaaaaaaatatcttttttaattttaaaaaagcttgaggcttaccgagatttggctgggatactgccatggacctctgaggcactggtgtggaactgacggcagggtggaggttcatatgattcagaggctgattcatcgccttcctagggtcttgccatgtggtgattttttctatgtgactaaaagaaggaaaacaattaattatctttttaattgtcagcatcattatcatcatcaccaacaacagcataatagttaatgacactaattcttcccttaggatctgcttgagtggttgatagattgtgcttggtttcatccaaggacatacttgcctatttttccctgcatcctggttaggccacactggggattctgcaagcagctctctaaacacaagcccaagacatcgctgtccagacagcccttgcatgcagtgagccccagtgaacttcccctcggcccgtggagcttgtattccccagcacctcagttgcttctcagccatccaatcactggagtgccatagtgtgagctccttcctggaaggggagccatgctcaccttcccagccagtaccccatactctcctgactcatagaattgacataatgaggatccctttggctgtcatcaagcaaaagatgggcccatgaaaccagcttctgaacaccacattagtgagctctcacagtaggagtgtaaggtatttcaaggtccccaaaggtgacacataaaaccctcaagaagctcactgtcaccaagcaaggtgacaatagggtagctggaaggcagagtattagaaaataatagtaggaaagtcaactagtgccagcttatggagaaacttagatattgaggcatgaaggtttacaagggagaagacatgattacatgtttgatcacatacaacttccagtttgttactgtgacttaatcacagagaaactaacccaacatgaaacatgagcttctgctcagagtttccagtacattctaagaaaggtggacatggcctccagctttgcctaccaccttccaaatcacattgcaggtcactcctggtaccttagagactctgtcccactccatcaaactcttcctttagtgaaagtttgtgatatatatatatatatgatgagtagattcatcccgttcctctactttgttttataaacagtatcagaaatcttccttctcctccttctccttcttttttgttttttcgagacatgatcttgctctgttacccaggctggagtacagtggcataatcatggcccattgcagccccgacatcctgggctgaagcaatcttcccaccttggcctactgagtacctgggaccacaggcacctgcgaccacacctggctcattttttttaaaaaattttttttgtagaggtgggtgtctccttatgttgcccaggctggtctcgaactcctgagctcaagtgatcctcccacctcagtctcccaaagtgctgggattacaggcacaagccaccgcacccagcccagtatcagagatctttccatatccatcaaagacaacaaacatgatagaagaaactgaatgttagccctttgttttgggcctcacaaccaggtgggtctcttccagtcaggcccccaccattgaccttccttagacatacaacaaaaggagcatgattgttgtttctgttaaacacacctcacttttgaataacaatggcctcctttgaatctttaaggtaggaaaccacttttactttcgttatgtttaatcagtctagaaacttccttgcattgaagttgtatttgtcttgttttcttttcagtctgtctcctcatttttaaatgcttcctctgctaaaattgttattcagatttcttaatgcaagacttgaaggtattgccaaggggaactcatccattgccttgcgtgaaaacttgggtctaaaggtctaaggttttagaataaatgtgattaaaaaaaaaaaaaaaaaggccgggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccgggaggtggaggttgcagtgagttgggatcatgccactgcactccagcctaggcagcagagtgagactccatcccccccaaaaaaaaaagatggggaaatactgaagtaaagagatgaaaatcatttccctaagtataaagtaaataataataaaaacaatagttttagtttacactttcagtttcacaattgtagttctgtttaaagctttcataaaatccatcaacttctgggcaggtggaaactcatagccagcctcaggcttgtcacaggccttccaagtgaggaactaattgatgaggatgtcaaaattaagtaactccctttagcaaaataattagacctaagaaatgctttgattattccttcagaactcattctattaaagcagcatgttttccaaggcagacatgtgctacataaatagttttcactctggtaccagaaggaaaagaatccttctctctttcataaacctttcttagactctctgacatcatggatattgatgctgtgctagaaccaacatcagcacaggccccggtgagatgtggaaatatacatcatttgctggaagatgttcaaggacacttccgtggtcagaatttcagctaccagctctaggaataatacaggagctggaatgatgcattcctaaatgctcgtcccccactctcccctcccgttctgaacaagtgggctgtggctcctgaatgcggcaagagcaggaacatctagcataggaagcccagcatctgaagtggcagatgagctcatcttgccccaggagtgccagcacagcttgccagcctaaatcccctgggacagagtgtggggccttctgggtggacctcatcctgacagttctgaccgagcttacccatggcttgaagtcccagcactcctgcagtgcagtgggagcctccacggcccacccttcaaactccacacccagccaacacatttaaaggagttttgttcccagtggatttgttaattaaaagtgtcactcacagcattccccaaaggctggagtacaagagggagcctttcttaagtgagcagttctcattgctccaaaacaactctgagaagaaagcccaaattcctggctctgcagaccagtcgacctgacatcagctgtaaggctgcgctaacatggtgtcaagagtggctcccaggctgaatgcaacaagtaagagtgagctattgctcacaagaggcacttaatacagccttgatgatttcatctgaaaactaaattctcctattgttctaatcacttagtgcctcaggctccagctccccctacttcccaccacttcccaaacccaggatacgccattcactctttcactctgctgtctcatctctgctccctctctcaatgttactgagtcatttcctttctcgtatttcacagtgtaatctcagtgtttgccaggacccacaatttagctagattaatccccacttccccgctactcccacctccttcctggcttcactcccttgcttagtctacttcaagaaaaactctctgctgttttaaaagtataacttcccttggaaatgcacacacatatacaaatatatttaacctgcctatatatgtgtattgtataaatacatacactgtacaggtttcatatttgaaaatggaacaaaaaaggaaaaagaaacatatcaaactatttatggtgatatatgcaaataacaggctcactggtaattttttttttcttatctaaactgctttgtactttccagatttttagcagtgattatgtattgttttcacaaccagtaaaaacaaaaatactaatgaaggtacaaaaagacaaaaaagaaaattgatgcatgaatacacaggtcataaggtataagcagcactttgggaggccgaggtgggcagatcacctgaggttgggagttcgagaccagcctgaccaacatggagaagccctgtctctactaaaaatacaaaattagccggctgtggtggcacatgcctgtaatcccagctactcaggaggctgaggcaggagaattgcttgaacccaggaggcggagattgtggtgagccgagatcgcaccattgcactccagcctgggcaacaagagagaaactcagtctcaaagaacaaacaaacaaacaaacaaaaagagttcctgaagataaactacacttttggctcctatcttcgtgtggctcaaatcaggggacaaatggaatcaatcacctgatcccatgctgtttataaagaaaaagaatagcagttcctacggggaagaaaagcttttcttgacagtaaacatttttttcctcgacttaaaaaaaagaaaaatcctctacaagtgcttcccatggagagccctggtggtatgtggggttaacggtacctgtaacaaatataagcgggagtgggctttttccccttccttcaagagccccttggaccactacttcccagacagcctccttctctcagtcccagaaagaccaaccaattcctggcctccaattacattatgagtctctgcttagagaactgcccaggttggacaaaagcatggagtttgctaaggggcaagaaaggtcaccacgtctctgagaagatatttggctggaaatggtaggttatgaaaaaccatgtcgtgtgaaatcagttttccctcatggattaatattttcctccagaaagacgcaaatgtagaaagccattttatttaacaggtaaattgtgtgtttggggttaaaatgttttgaaattggtggggtggcactcccaccctccaagtcaccctcccctcagactggcctccccatcagcctgcggagggggtgttaactttgctccagtttcctcctctcaagccactgctacctccttctacctccttcatgacctttcaccttgatgagggcaatggcctctgggcttcccttctgccaatctttctggttttcctcccttcctccttccctccccccaccctctctgcctgacaatccattcactatctcacctccaggcacatatcccaaggacacctggtatccaagtccccctgggtcaccatggcccatgaaataacagcacaactcacataggcatctcccagacacagcagcctactgccagactctgtgggctctgcaaagaccacacgcagttgtggagtcacatatacctgggtgcccgggtttaatattagctctgaccctgtgtgatctaattggatatcctagtcacactacccatatgcatgagacaggggtaaaaaagctaacaatatactggttcctcactgtgaggataaagcaggtctgttctgggaatattatgaccaccaaagtcacttacagatttcatggccagttctcctggcttcccaaactcactcagcagtgagtgcagagaaggcagctctggccttccaaggttggcaacacttggttcaagttttttcaacaaccatagatcgtatacctattatgcatgatgggtgatgtactggttaggtgtaaaaatcaaaaacattgtgcaaacatagtaaaggcaaagataaaaatcttatctgtaaaaatagaataatcaggccgggcacagtggcctgtaatcccagcactttgggaggccgaggcgggtggatcacctgaggtcgggagttagagactagcctggcgaacatggagaaaccctgtctctactaaaaatacaaaattagacaggcatggtggtgctactcgggaggcagaggcaagagaaacacttgaaccggggaggcggaggttgcagtgagctgagagagcgccattattgcactccagcctgggcaacaagagtgaaactccatctcaaaaaaaataaaataaaatagaatcctccagcttcttaccacccaggaaaaggcctggtgtttttggatgaatttacccacactaactttatgatgaaggaagccgtataacaaggactttctgaaatagagaatcccatgtaatgtattttgtattgctggaagcatacaaagatataaaaataggaatgattacaagtgcttcattttgaaagaatttaaaactattagcagcatgttgcttatttctatgggcaaagattttgtcttcaaacataagtgttttgtcttttttctgcccaccatttatttaataaatgagagtttcatacagtgtcagacatcagggctcccctccatcagcagagtggttaggacgggacctggaagcagcctccaaactgcctcttcttttgccacaacctagctgagcagttaaagagaaccacaccaatgagatgagaatttaaagacagcctggggtcataaaaccaaggcagactggtttaaaactcaatcatactcactgctccctgtcttcatcccctcagtgaaattcctctgtagcctctgtccttactacctccttttttctcttccagtagaatacaagctcttccagaagaaatgttccacagataatgctagccaggtgtggtggctcacacctgtaatcttagcactctgggaggctgaggcgggaggactgcttgagccccagagttggagaccagcttgggcaacataaaaagaccctagctcttaaaaaacaaaaaagaaaaaaagctgccaagcctatgatatttacaatccccatttaagtataagcaaactgtcttatttcagaaaatcagatttttaaaacttttttgatttactaggccaattcaccatcctcttaatgttaaaacaaatgtacatactgaagacaattagcttaaaatttgctaaatgaaacagctttgcaacttgcttcttgtgactcagtccaattagacccactagtgttaaaaatggaaactgaaacagatttggatgaggttgataaattcccagatagggcctgccaagtaaatctgacccactgtcagtagacaacaaatgctatgccaatttttaatcctgtaccagatggcaaggagtcttgccgaagacttatattaaacttttaaaattttcctcaactggaattagaatacaagtatgcaaaaggtggtttactttctcgttgtatgttggggataaatactgtttgcatttaaatcaaattaaacattctattagtgtgatcttatttagatttcaagacctaggaaatgacatatatcttactcatatcttacatttcttttagtagtaccttttgttttgccaacggtacttagctctgctaaccaacaccagagatgagtcttaaccacaagaacaaagacaggggtggtatgcacacttactaattctcccaggcccagatgcacactttctccaggtagtccctctgctgtcacctaaaaccacaatgcaatgggagctgagcacagtggaagcccattgcagtgggagcccattgcaggagaaaccccagggagctcatcacagaagggaggccacatcacagagggagcccatgacagtagaagccccatcgcagtggatgctcagctcaccacccacatctaaactagcaacccgacctgatcatgtttgtaatactaagattaggttttttgtttgtttgtttgtttttgagacggagtttcgctcttgtcacccaggctggagtgcaatggtgcgatctcagctccctgcagcctctgccttccggttcaggcaattctcctcctttagcctcccaagtagctgggattataggcgtgtgccaccacacctggctaacttttgtatttttagtagagatggggtttcaccatattggccaggctgatctaaactcttgacctcaggccatccacccgcctcaggctcccaaagtgctgggattataggcgtgagccaccgcgcctggcgacaatattaagattagtagccatccagtacattgatctcctctgcttaacgttatcagtctatttgcataatgtggagtcggcttttgaacttcgatatgttgacaatcagaaataaagtaatagctcttcacatggttgaagagatacatagcttaggttttactgtatttctagaaaccctaatcaatcttcctcccacgttgtcattctttctaccaccctaattaataattctttgtcccaaggcagcttttaaaacactattattggttataatgattcttccattctgcccaaatcctaaacggcaccatctcctgctatttttaatgcatcagaatagaagatacaaagaggtaaaagtcaagctgccaatgtgcacagctgacacatctattagcaaagcattcagagtttaaaccccaaagctattaaaaaaaaaaaaagactcatgccatataataaaggtgactcttcacacagcagaaatgtgttagatgagaaagttcatccttctttgaaaccacaaagaatttatagttgaaagtttccggtcagattttcacttaagcagctcatcaaacatagctgcagtctatgacacagaaataataactgatatataaataggggatttttttaggatcctctaataaaagatgatacaagaccagagaagttatttcagtgtatggttccggtctctaccattcacttgccaattcaaaaaatttcagcattctctggaattctgaatgaatggcagggattgtatttttaactaccaggctctaatcctcgacttccctcacagacttgccaagaagtttccacttgtttaagttagcagcagtaggcacagcagccatgtgaaaggtctcctagtgcctctgccctggccagctgtggtgatccatctccctcacgtccttcccactgagcaccaccgacttttctgcagactcattctgtctgaacctactcagtcaggcagaagctgagtcaagcaaagctgctgtcagccccaaagagcagatgagccaaatcaggactgtaatacccgtggttcctgcagggattcatttaccagagttttgtccctggggtgggaaaaaaaagtggcactgtgaagtgccacttcccagagaaaaccactttggaaggctggtgactcatcaagacagccccaggtgtgactcaggagcctcacttcagaaggtgaacagttcagtcactgtgttagagacaccccgtcatatgctgcacgcaccccaacagcacccggccctggcaagcctcactttgcctctgcaaactgagcaaaattcttgcttaacctcatttttcctattttgtgaaaacataagaaggaaaaaaaaaaaaggactgggagtttctgttgcttgtttgatttgggccaagagccatattaaagaactttggctgcgttgcaaacaattttattattagtaccagcatttttttttctcctctcatgccaggatcaataatgctattaaaaaatgtatagtccagacacagtggctcacgcctgtaatcctagcactttgggaggctgaggcaggaggattgcttgagcataggagttcaaggccagcctgggcaacatagggagatcttatctctaaaaaaaaaaaaatcaaaatatgagtcgggcgtggtggtatatgcctgtggtcccagcttcttgggaggctgaagcggaagattacttcagcctgggaggtcgaggctgcagtgagccgtgatcataccactgcaccccagtgtgggcggcagagcaaaactctgtctcaaaaataataataaaataaaataaataaaagatgtataaatcaccttaagtttattgtgttggaactccacaacaatgtgagagtctatttcacgatattatttccagatgtcaagtataaaatatgtacttggtagagtctttatttcacttttctcctttctcacaaacaaaaacatgggatgagaatcagaagtagagaaaagatgagacgctttatgaatggtgaattattattactcttatttttttctgagatggagtttcactctttcaaccaggctggagtgaagtggcacaatcttggttcactgcaacctccgcccctcaggttcaagcgattctcctgcctcaacctcctgagtagctaggattataggcgtgtgccaccacacctgacgaatttttgtatttttagtagaggcagggtttcaccatgttggccaggctggtcctgaactcttgacctcatgttatccacccgcttcggcctcccaaagtgctaggatgacaggcatgagccaccacgcccagccacatgaatagtgaattctagaataattaataggaagtggaatgtattcatccattttttcattagacaagtatttacagtggggtacatcttccatagggattcagttccaaactcagttttcttttgtttgaaagagatgctgcccaggctggactccaacagttgggcttaagtgatcctcctgcctcagcctcccgaggctgggtctacacatgcgtgccaccttgctctgctccccaaaatcagttttggcaaatgtggagtgtggtaaaaattaccactgaaaaacttttgaatatacagtccactaggctttgtgtacattatattatctttcagtaagcccaatgcagccagtttcttccagggttagaatatggtgctatttctacacccaagatccagatgaagtgatgctgtacccaaatatgtatgtcgggatttgctaggcactcagtgatgaattcacgacacttcaacatgcatacggtgatgagtgcctgtaatacctaggccctcaaggagctggcagtcaaatgagcagggagaaggtggcagtgaaacaacgagcagtatggtggtaaacagcacagactctattgtttttgttattataaatggtccagagcctgacactctgtctcaacagctgtatgttagaaatgtttcccatatcaactgcatctaacatctaggaatcagcttcaatctcacaataagtcttaaaaagaagttagtattttagagtagccactaagctactctaaatgctaaaatactttgacaattgtttttccatgctctctgtgcctaacacgtttttaacatgttgttttttccagttgttcttaaatgggacactgacccagtgcttggctgctccgaagccactccaaatgtgaaatatgtcgaagctaaagctgcactgccctcctttctcttctttctaatggggccaagtgaattaaatgtcactcatcccaaaaaagaaggcaaatcctctttaaaaccaaaaattcttttgggttaggctagcttctcctctattcatgtgaagagatttaattcctttttgttggttttgtttttttcaattctgggaagaggatgagccaccctggctctggccatcagagccactttctttttgcacatgtttgaaaggcatgacacaacttgaactggaaaaagggctggcatgaaccccggcatctcaagagagactagaggtgcttttcagagtgaggttcccattttgcaagaaattatttggaggatcaaagacaaaaactgaggcatcgaaagggaccaacttaggcttcagaggaaggggagagtgctactggggaccttgaaaataattatcaggaaacacagcttatggttcacatttcaaacccagcctacaatgtttctttacgtgtatttcttggcatcttcagtcgaaaatatcacccaaatgaggcagagtggtacagtggatttgagatctgtttctgccattaactgactaagagactactgtaagtaacatctccaagccttggtctcctccaatgtaaaatgggcataagaacatccattacatgaggctgttttgagaatttcatcaaataacaaaagtaaagcacctagcacagtgccggatatgcatgacacactataaatattagttcccttcctttcccttgtgaaaatctatccaaactgtttaaagggatctgagtaattcaaatgcaaaaaaagaaaaaaaatcaataaacaccttatagtacaatgaacacaagaaaatggagagaaataatggtagacatcaatttactgcaaaaactacagatatacttgatttctttcgtgtgtgtgtgtgtgtgtgtgtgtgtgtgtgtgtttaagatggagtttcactcttgtcacccagactggagaacgatctctgctcactgcaaccttcacttcccaggttcaagtgattcttttgcctcagtctcctgagtagctggcactacaggcatgcgccactacgccaggctaatttttttgtatttttagtagagacggggtttcaccatgttggccaggctggtcttgaactcctgacctcaggtgatctgcctgcctcggcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagcaccccacaatttttttttttttgcattctaataatagcaactctcagattcagtgtgagaggcagccaaagctgcgattcctttactgcccttgttggtaatgagtgccttggtggtaatgagcatctcatgtcagcacaagattttctctcccatttaaagtagaaaggggacttcagcttgcagtaaaaagcacagtaagattgaatgcaagcaaaagaatatgtaatggatttccatttttcctaataaagaaatgctcaagaagttttaatctaatttaatttttctaataatttacaaggagataatagttccaaaatgtgaggggacataccaggtacagaaatgcaggaagccttgaaggttctatgacttcaactaatggaaaaacagatttagcctaaaaaatgctgttgtttttaaacaagtatgtttatgcaaactccaaacagtaagtatctttgtacccacaagtggatgttaataaaaaatacatgattgatttaattttttacttaacaaagtacaaaaatatgtacctgtttcaattatgacttcaaaccccatccttcttcatgaaagtagcagataaaaatcatataaaatcaacatctatttgtgcgtatataactttttgttttgatatacctttaaacttataggaaagttgcaagaatatatacggcacggccatctactgattcaccaacttttttttttttatttaagttagtagcattagaataatcacttgtttctaaatgatccctcagtgatagtaatcctttggctggtcacttttctaactttgaagagaagtgagttttattctgtaacactcgcaagataaagaaagatgaaaaaaagctaatataaaccaatttgaataaccaaatcgggaaaccatgtgtgatattgtgatatattaagaaataaatctctgtcaccattgccgatctagagttcctataacccttgtagataggggtgctaggagaatctttggttttaatatttggtctttgacttcggctcctgacacagagcttctaatcccttggaattttctgggtgataggaacttctcttgttttaatgaggtgactgttggtgggctcctacatagccttaggaaggggctggttgccagggggaaccaaccacatggctggaggattcgaactttcagtcccacaccacatcccaaccttcagggaagggaagaggggctgaaggatgagctgatcaccagtgatgaaatcaattatgcctatgtaataaagcctccataaaaatccataaggatagggttcagagagcttctggatagctgaacatgtgaaggctcctggagggtggcacatccagagagggtgtggaagctccaagtaccttgtcctatgtatctcttccacctggctgttcatctgaatcccttgtaacattctttctaataaatgggtaaaagtaagtgaagtgtctccctgagttatgtgagtcattctagcaaatggatcaaatccaaggagggagttagtcagaagcacaggtcaccacctgtagcttgcaattggcatctaaaaaggtgggctggagggggtgcagtcttgtgggactaagcccttagcctgtgagatctgatactatctctgggtaggtagtgtcagaattgaatgaaattacaggacacccagttggtgtctgctagggaatcggaagtgctgtgttggatggtgtgtgagggtaaaaagaaaaaagtttgattttttttttcccttcagacctggtgacaccaagttttttgataaaatctaaagtaataacatttcagcagtaatgatgatgaccccaatgtccttccactgaaggagaaaacagaccccacccaaaaggtgggaagcgccggcagatgattcctttatttatggagctgctgatggtcacaccacggtgtaatacaaacatttctgtctaaacactaacttgggcagagccacttttacactgtgccttgtatttaattgacaggaagtttttcaaaacaggagagagctgccttactttgattaatgtattaattcaactggcaacctccaaataagttttcttaggagtagaggaaatacgtgcgaataacattaaaatgtccttccagtgcttggaatgaatattctacttgtacagacatagattttgaagacaaaattgtaaatagtaaaatctccacctcactctttatagaatgtatgatttaataaacaaaagaaaaaatgcagcttcagaaaaatagctttaaaaatgcccataaaatgcacacaaaagaacctgaaaacttacggcgggttattctcgcatattactagacttaacttggtaccatctttctgaagagcagtatatcaatatgcaacaaaaacctgggaaaagctttgatccagtaagtccatttgcacaaagcttttattcccagaaaacaattagatgggaatgacagagatggttgttgctttggaatatctgctctccctttttaggtgctaagtattgccaagagactaagttctagacaatgaacagaagtgctgtgtgggcttctgggaaaggtttttaaacggaagcaatagacatacgtttctgcttcccacccttccatcttttctccagcctggcatatgaacgtgatggctggagctgcagcagacagctggaattatgaggaatggaagccactcagtaagaacaactaagcagaaaggtgcagcggagccagcaaaccagctcttgagttccttaattcagatttccttaatgttagagaaataaatgatctcatttcgcatccctgtaaatcacaaacatgactccaaaccaatacaagtatgcagaatgtatgcttaaggatgtccacagcggttttgtttctatctttagtgtatgatgatagaatggttaaacaaattatggtacagtcagacagtggaagactgaacagacatgataaattacatggatctgtatttgctaaaatatattgtgggagtgaacataatcccgttttggtaaatagaacacatatgaacaagggggaagtaggctttattcatatctttacatttctttgttctttttgtacaataagcattatttttctaatcagaaaaaaaatgagaaagctatcctccccccaaaatgaacccatttcctgcttaaaaaatgatgctgcattccacatttgaacctatacctgctcattacagcctctgaaaataattccacagctatagtgcaggactgaaaatcttgtctctgccttaactgtgagttggaaaaggcgccaccataatactcccatgagtgcttagcctaaaggtgctctgaactagagagaggcacaaaagggggaaaaatgcaatagaaggaagggataaagaggatcaagggaagttctataattaagcaatattttacggctgcctctggcagctgtttgagtgagcgggagaatctaaacgaggtgtcaacagacacaggagctgccctctccttgggcagatccagcagggcctagcatgtcctgtacttcacaggacaatctggggcatcttatatccagcacctgtcagcctgggagactcccagctgcaatactgttattgctgtcatctgcctaatccagaagggagcggcatttattgtatctagaaagaaagattaggctaaaatatatttgactgttcttatgaaagagaatgcatgcctcacgtaactgtgtttgttttcttcttgtccctcctgactttttctgtttttatcaaaggaagaaacctactcttgcagctgtatttttcatttttaacccccacgttaatcatatattcacaacaaataatggtttaaatttagtctgacgaccagccacaaggctccttctcatcccactatgaggcacatcctgccttcagactctttacgcaatcctcattgacttggagaggaaccccgtgcaatgagttaaacaggatatagaccatcataattaccagaggaaatggtattttctttacaggatacatttagatttttcctttccatgagttttttttttttttaatggtgttaaaatgaaaggagactttaaagcagctttcaacttctcagtagccccaactatggactaaatgcagaaggccttacacacagcagacattaaaaaactactcatagaataagtgactgaattaaaggaatgaatgaatgaatgaatgaacatatttaatgggtttacttcgacaaatcattttgcttctaggtatcaaatataacagttgaatcttattcacatcatatatgtttttatctgtaagtactcataaaactaatctaggaagatttgttccttacttgccccagaaaggaacaaattctagagaatgctgtcacattctattaaacaaattaagtcattctcaattcattcctgttgattctgcaaactgctcggctgagcctctaccaggtactatacaccatgggtcctgaaagtccaccatatctagcatacaatagacactaaataataaatgtatgttgaatgaattgctacttatattcctaataatgacaatcatggtaataatgatagttacaataataattattcatattaattattagtcataatattcacaataaccatgctgttaatgtctgataataatagttgacatttatataccattttatggcttcaaaaatgatcttaacttgatcattacataacaggcttactaatctctgtttttaagaaataaaaatgggccgggtgcggtggcttacacctgtaatcccagcactttgggaggccgaggcaggcgggtcacctgaggtcaggagtttcagacaagcctggccaacgtggtgaaaccccatctctactaaaaatacaaaaattcaccaggcatggtggcgggtgtaatcccagctactcgagaggctgaggcaggagaatcgcttgaacccgggaggtggaggttgcagcgagccgagatcatgccattgcactccagcctgggtgacaagagggagactccgtctcaaaaaaaagatacagaaacagagttgggtgaagtaaacctacttaataagttcttagtttccatgtggcagagcagagtcaaatcttgttctcataataaggtctagggctttttccatgatacaatactgccttgtgaacccaaagaggctgacgtgcataacttgggccattaggaaggaaggaaaaggggaggtggaccgtcagcactgctgatagcctgactttgtcctggaacaatatctcctgcaggcttggtcctcctcttgcttcaataacacaccaccatccctccttgtccctcctgaaacccttgagtcacacagtatgtcaacttgcctgcaaaacttagctttttttttttttttaacaccctggttttaattaggcatatcctgtcaagaaaagggactcttgtgacaataaaacaaattaggtccatgtgatcctgtagttgttagggagaaaggaaagaaagaaatacaaatactacttaaaaaaacataaatacaaagcggaacgccaactctccactatgacctaaaaggaagaggtaaaaggactctgaagatagatttggagatgcaaggcaacagctgaatatgccatgagcaatgctggaaccctaagccagagctggggatgtgattcttaaggccctgccacttggaaagccaaaacctgttccttcagaagccagtctctgatagtaactttagcctaacttgccttccatttttattaatgcttttaatatcatattgcctttagtttttattaatgttttcattattttaataactagggaaaatattcaaatagggctgttgtataaaatgtgttcagtctataataagctatgtaaccagcctttataattgactatataactgtaattacttaactaaaattcaagatgtacattcacttttcctaaattttctctaaacaaaaaaaagtagtagagataaattccaatttttctaagaaattaccttttcatgataatatcttatgttttaaaacatttacacaaaaaacatttttgcaatgtattctgaaattaaaaatagttatattagaagaaacatttcattctgggttaggaattgtagtcattttaaatgacttgagaaaaaagttcatgtttaaatactcagacccgtaataaatatattaatacaaaagtgcgggaaaatgtacaaatgttatcatatgttgccaaatgtgagaaacattgcgggagggggtaggagaaagaattagtgaatacaaagtcattgtgaattcagcaaagggagagacacttctgattctgccaactgcatctggtatttccacctaaaatctacttctccggtaacaaatgctttcaggttcaaccagactgtgaggagacacagctatggggcaaggtaacctcaatgatgttctataaaacatcagtcctagaagataatccccctcacccctgcacccaaaagggttctgttatcaaataagtatggaaaacactgaatgttatattcctctcctaatatttatacaatacatatgcatataaaagattctagttttcaattagcttaatcccacatttctgtaattcattttatgtgtaacttttttcacttaattattactatcctatagaatacattttaagaagttgcaaaatatactatttatggtatttattacaagcatgacttcagattcaacagcattgtctgaacacacactgtgcttctgacactatggcaatattttatacccaactgaccagaactaaaaaaactacaggcgttcctatccaaaggcactgaataaatgtaagtacaatgctatgaagccctgatgccaaagcatcccaacgacaaagttcattcaaagcagagctaatatagattagagagattaatcggcatatatcagaatatatatatacaggcatatatgtatgtgtataaatatatatacatatgtaaaacacacatgtaaatttccatatagcttgaaattaacttgtgtttttaaaaagtgacctgaactgtttatacccagaaagcttttaatcgtccgctgtattttaaaatcaggagcctgtatctattcttagtgtgctttcgaaataaagcttcccttggttcggggtcacagctgctgcaaagcactctgggtggctcctctccatccctttgaaacagctggtgggaacctagtataaggccttgaacccagctgttcaatcttactttctaactttagcaagtcccttctccactaatgtcactggggcatgccacattgaaaaacacaccagagatggtagattcctatccctgctaaaaaaaactccaggcacaccgagccaagttacactcatgtaccaatcacagtatcacccagataccgactgcaggatccgcgtgatctgatttaggctgggcataccaatgatttaagaaggcttccctagacaccacaaataggcatgctgccatcactcctgccagttcagtgcattagaaagttaccgactaccagtggcagagccccacaacgtagaatcgagaagaccatgaaaaccaacctcagattcaaaagacttgcacatacaatgtgctgtctggtggcttttgtctccacaatgttaatgcaccgtacactactcatgaagccctcataatgtaattacttctatttaattgattgtacatgccctcgtcttagttttctttctttttttttttttaattgcatgctcattgtaattacttgccccaaagccaggagatttcagaaatatttgactgtttattaccctttgagaattactaattaaaataatttccttcagtgaaaagggttgctcttttcctgattccacttcgacactgctcaccactgaagagaactctaagaatgccttgctaagctcccctgtaattgactgcctcctttgttaacacatgcgtggacttaaaaaacattaaacgacttatacaaatggaaacaaaatgctctttgagttctattgataacttaacctttagtgttttggatgaaatcccaattctagggaagcagggggagccattgaatgaaaccattatgtaaaacattgttgtgggaattattttgtgtgaaaatatatacagtatatcatttaaaatgtctttgaaggtgggctttcaaaatacctaattaaaatatacatattttgtatggcttctctacttcgtgcttcctttttcagggaaagagaagaaatttgcataaggcaaatgaacccatgacgctggatgttagagtaggtacccttggggaatctggaaggggcgctttttggagctgggaaaaatcctgtttcttgggtcagagacctgcttacgtgggtgtgttcaatttgtgcaaattcatcaagccgtttatttatggtttgtatactgttctacaaaaattctacttcatttcttaaagtaatcaagagaaattacctccatttttttcaagtaatttgtataaaagacaaagggatgtagtttccatatagcagaagcctaagaattactctgaggcatttacaaggaatagaaattaagactgtggtcagggggcctctctgaacttattctggtttaggagttccccctccccctcaaaaagactgtaattgatttttctatgtcgattttttttaaatggtgtacaatatttggtttgagcaagccgatgtaaaaaaacacatctgagaccattaggaatatttgaatatgtactggatattaaataatattttaagaaattattgcttctatcctgataagatacaataagaaattcacaaaatcatttatgctgtatttttgtgaaaaattttaacctaatttaatcataaagaacccatcgtgtgtgatagtggtctaaagtttttttcaaaacaggttaagacgaaaaacaaacaaaatggtcaaggggagagacactttttgaatcaggagaaacataattattactaaatgcaatatgtgaatctgattggatcctgcactggggaaaacagacacacacacaaacacacacacaccacacacacacacacagagctacaaaagacatttttggaacaactgggggaatttgaataagggctaaatattaggtcatattattgtactaaggttaattttcttgggtataataatagaatttgttatggtataaaagaatgtcttattcttaggaaatgcattctaaagtacttagggaaaatctcatattgcctataacctcttttttacttttttttttttttttttttttttttttttgagacggagtgtcgctctgttgccaggctggagtgcagtggcgcgatcttggctcactgcaacctctgcctcccaggttcaagcgattctcctgcctcagcctccctagtagctgggactacaggcatgcaccaccacgcccagctaattttagtatttacagtagagacagggtttcaccatgctgcccaggacggtctcaatctcttaacctcgtgatccactcacctcggcctcccaaagtgctgggattacaggcatgagccaccgcgcccagccttgcctataacttcttttggaaaaaggttaacaattgctgaacctagataaagagcaaactctctttcaacattttttcaggtttgaaaatgttcaaaaacaaaagaaaaaaataggttattgttgattttgtcacacatgtaaatagtaattttgttatgtaagaaaatgttcttcttttttagaggcaactatttaagtatttaggagtaaaatatcatatattttatttgcttgaaaatactactattaaataacatattaaacaaatataccaaatgttaacaattcttaaatctaggcaaggggtatatggtgggtcattaccctattactctctccttgcatgtttgacattttattacataaaatgtgatcagatttttttaacaataaaatccttcctacttggttcaagtttccaaaatgaactgcagtagaattcctcccaaattaacattcatattatggttcaaatttctccataattgggcgaggcgcggtggcccatgcctgtaatccctgcactttgggaggccgaggcaggtgaacacctgaagtcaggagctcgagaccagcctgtctaacatggtgaaaccccatctctactaaaaatacaaaaattaccccaggcatggtggcacgcacctgtaatcccagctactcgggaggctgaggcaggagaatcgcttgaacccgggaggtggaggttgcagtgagcagagatcaccacatcactgcactccagcctgggcaacatggtgagattccatctctcaaaaaaaaacaaaaacaaaaacaaaaaaccaagttctccataaactggtattgtcttgggagacattattagctcaatggactcaaaattctttgtacataaaatcaaatagcatatttccttctatcctccagttataacaaaaattacagtaaaggacagtaagtgttctaagagaagtagtgaagtctgttctgaaactgaaagttgtttggatgttttccaaagacaagccatcatattcctgccctgctctctcagacctggcactgataacacaacagccttcaggaattcatttttcttctgaatcattctccactggggaattagccctggcatttctaattcccttgctgggcacaagcaagccctggcaccacagctttcccagagaaatccctctgtaacctgttcctctgtcagtgcactgattaagttagaaaaggtgagcccacttctctgtggctcgctgacctcaggacatgaggaactgtggatttgaatacacaaggcaacagccgtagtgcagtggatcttctagtggacccgccactggtacacattttcttgactctgaggacagaggctgaagagcactcagagcagtacctggtgccatcactcagactttgaagccatgttgcataacagataatgatgtgcgcaatggcgaatcttgtttgaaggtaagatctgccgcttactagctgtgtgactttggataagctactgtgcttctatttctcagtttctacatctatacagtggagatattgcacagtggttaagacgtctggaatcagattgtgttccaatagtagctcctacactttctacttaaattaacttgggcaaattacttaatctcttggtgcctccattttctaccaatatctatgacacacaaagaccttagaacaaaacctggcagatagaaaactatcaataaatattagctaccattatgattaggacacaatgatctactccataaagttaccctgaaattaaagttaataaagcatgcaaagctcttaacatggtgcctagaacacataattgtttaataaatgttagctattgtgatttggcttcacaataactgttaggtaaacagtgccaatattagtattttattgataaggaagccaaggatcaaaaagactcagtgactttccctctgtcgtatgctgacaacaatgactttactattccatgctcatactcttcctaaaattctctatgccttaaggatccactataaagaacagagagaaactaaaataggccaggagcctgtaatcccagcactttggaatgccaagatgggtgatagattgagcctagaggttcgagaccagcctgggcaacatggtgaaaccccagctctacaaaaaaaaaaaaaaagaagaagaagaagaagaaggaaaaaaaaaagaaaaaaagaaaaattatctatctaggcgtggcagcgcacacctgaagtcccagtgcctcgagaggctggggtggaaggatcacctgagctcaagggagggtgaggctgctgtgagctgtgtgagagtgagatcctgtctcaaaaaaaaataaaataaagtaaaaaagataaactaaaatagcatttgaagatagactcattaacatcagcataagcattctgaagctaagtttaaaatataaactagtaaatgatgagactgggaaagatgcttggaagaaaagcaaggagtccaaccttggacacaagtgcactttacttcgtgccactgaaagtgtaggccgaatcctttttttgtttggtttgcttgaatcacattttaaatgcacaagagaggtcaccctttgaaaattaattctgtgcaaatctttttggaatgattattttttaaaagaaataagctccacccttttataaatgggattgtagttaaagattttctgtatctgcttcactcaaaacaagcagcatctgtactcaagtgcatgcctgcaggtgagtgttgttggttaagctcaggtgaacagtgaaggtccctgaatatgtgacagggcctaacacaggtgttggtgtttgacctacaatgtaccagaaaagccgtaaaggcaaaccccccaatagatccttcacattacctgtctcctagcagcatgtcaaaaatcagtgcaaacgtaacagaagaatgccaaagtcaagaatacaactgagaacatcttgaagctacgaattagtacttgccaccatccagctgttggttgcctatagattatcaagaattttacttgtatcattatctcatttaatactcacaataatcctggaaaaattattatccccatcttataaatgaggaaactgaggctcaaaagtttaaaagacttgcctgaagctacatagctcataagtaaaagagtaggaatttggacccaagtctgactggcactcaagccaagcactcttgaaattttctttaatcttctttctagtgtctcctagtgtctcccaaattgcttggattacaggcgtgagccactgtgcctggctggtttctgtcttttttctaatgcatgttttttccatggctgtgaccatattgtggaaaatgctgtattccatttttttttcatttaacatcataacaatattcaaatgccgttaaaaactttcatcaacatcataatttaattaacaattccttactgttagatatttatatttttctttattcattacaaataatgcttcaacaaacatccataagcataagcttttctcaatgttttgagttatttctttaggctagagccccagaatcagtaccactgggtcaaagagcatgaatgttttatcatttgcttattttttttagagtgaaaaaagtacggccttattacttgtaagtcattatatatggatttttaaattattatttgtacataagaacaattttaatgatatttgcactatcaaattatctttaattggccaaccaatttttatgacacactgacatgtttggattatatcagtccataaggtaaagattccaaaatggcaatgaccaaggtctaccataggcaccttggttagaaagtatcactctgcatagtactgacttgtagatgaatagctggatattggaaggaagatttgattcatgaaggttaatgggctggggaaagcaatgggtccaattagcaaatggattgttcttggaccttctgctagtctcaaaaggataagcttatggttcccatggcccatggcagaaaacacagaacaaataaccaggttaaacactgaagttcaaaagttggccagtaatggttgtcaagggctgtgtccaggaaatcccgccagacaggcactgtttgcaaatggctgggaaatatggtctgttgccatcaaaaacagatgaaaagcaggatttggttaaaagagtaagtctttgcgcaagcaaaacctttccaaaataaagaaacagtgtatagctgttgccaactgaccttgactgaaaagaggggccagtcctgtaccaatgctcattataaccagtctcaaactacttaaatggtgttgagtggaaataagacttaatcaagtgaagaacctgccagctttgacagtggtaatatcccaaactaaaatcctcaagagtatcattaaatcaaaaattttttaaacttaaaagtaaaatacaccaaggcaataatatctactttagtattaagagaaactacaataatatgaaggaggatccattaagttacatgttcaaaaacatcaaaattccaagagtttgagacatctttaaatagcgacaaggtatataatgggcccttcatcttcacctgtttcacatcctgggattcaaccaacattggcctgaaaatattcaaaataaataatgatagtacaacaatttgtaaaaatgaatacaaataaaaaacaatacaatgatacagtataacaactatttacattgcatttacattttatcaggtattataagtaaatctagagatgatttaaagtataagagaggatgtgtataggctttatgcaaatatgatgacattgtctataaaggacttgagcgtcgtcaaatttttgtatcttccagggtcctggaaccaatcctttccggacaccaagggacaactgtatatcacacagtgtaatcaaatggggcaagggcctattaataataatctcttcaagtaatgccattattaagaatcagtagcagtagctttaattaagattctacctgtaacacagtccccgatgggaatataattgagttaatatatgtaaagtgcctggtacatagcaaacactatgaagtattagttaagctaataaagtcacagggccaaaagggaaaagaggagcctgacagcttcctcaccctgattcttctctgtccctccaagcacctcaagctgggacctcagtcctctgtccttgacactcactccactcacctgaaggggaagaataaaataaaattgataataagcattagttgtacctcatgggcctggcaccttcctttatacattagtggaaataaagcaccttcctcaaggcaatagccaccctggggtacccatttgatacattaaatgaaatccaaataaagtctttccatgagtcataaaatttcctatttaaaattcacattatcaactgcttgaccaatagaatatggtaaatatgatgtaccagtttccggcaccaactcatggctcctactttctgtttcatggaatgctcactcttggaacccagccaccatgccataaggaagctcatgcattttgtagagagacccacttggaaagaaaatgttgcctggctgacagtcaacaccaacttgctagtcatgtgggtgagcccccttgaaaattaatcccttgtcccccagtcaagccactccaaatgacactgcatgaaacagagagaagctgtccctgtcaagcaagctctgtttaaatttgtgaccaaaattaatgactattttaaccaccctcccaagtacattatcttagcaaaacatagacctatgctcaggctctaattattcaacatttccaaattcaaaaatgtatcaatttcaagaggtagatgcatattttataattttttatagtttttctttctttttgagacagagtctcactctgttgcccaggctggagtgcaatggagccatctcagctcactgcaacctctgcctcccaggttcaagcaatactagtgcttcagcctcctgagtatctgggaccacaggtgacacaggtgagcccccatacctggctaattattgtatttttagtaaagagggggcttcactgtgttggccaggctggtctggaactcctaacctcaagtgatccacctgcctcagcctcccaaaatgctgggattataggcatgaggcaccacacccagccaagtggatgcatatttcaaacaaagcacccaaaaatgcccaggcatgaccatttctccttttcttgaaactacaaggtcaatccccttgggaacttcctaatacttctctaaaaaccaacctaaaaaacccaaaactaatacatcctccaattcttcaacatgtaaagtccttgtaaacaaagctacaatgacccagaatatgaaaaaaattattttttttttttactttttaaaatattatataattctattctttggctaccttttaaggatcctccggtctacttgagaaataaaacgtgcaggtttaaaacacccaaccgacaatgctaaaggcagtacagcaagtaagcaagccatgtaatcatatggtacagagggagtggctgcctcagaacggaagaaattcaacttgagcaaaatgtgagagatgggtacattatgcttgaagttacatttacccacagagattttgccacactagtggttgtggaaagtcttatttctatcagattttaaactccttttgagcctggactacatctaattttcacatttaccattaacaaccacaaaccaggtcctactagaaaaactaccaatatgcatttgcagacactcaaataatgctgggggaaaatgaggaaacaataaattttcccccacaggagaaaaatgtatctacgtagggctaagaggaaatgttaagaaaaccaaaggcaaagttcaggtagaattttccgtctgcagagtcatgatataagaggatattttaatatcctttatattcttgaatgagcattcacatgtatttttgctagcaactattttggaatgagctgatgatttggattaaagaataagcaaagctatgtgaacaaaggcaacccaagatgggaaggcgttattggcagcagcgttcttttcactctggaccctgagcaaccctgaaattccagcagtcacagggtcctaaatacttggggacattccgactcagtctcacagactgaaaggtagagagcacagatctcaacaggaactgaaactctagtgttgatcattgccctgacacaactttaaagtggccaccaaacccctcaaatagctattttcatccttgtttacactggccacactgacactcaattggtgagaaaaggcttcccccccaacttttttttgagacggagtctcactctgttgcccagactggagtgcagtggcacgatctcggctcactgcaacctctgctgtccagtttcaagagattctcctgcctcagcctcccgagttgctgggattacagcatcaccacacccagctaatttttgtatttacagtagagacggggtttcaccatgttggccaggctggtctcgaactcctgacctcaagtgatccgcttgcctgggcctcccaaagtgctgagatgataggcatgagccactgtgcccggccagaaaagcctaattttaaagccaaagataaataaataaataaataaataaataaccaggcttctttctactctaggtttcaactgtagaaatctatttgcaaacttcaaaaactattaactttgggcaagaatttttaagatctgataagaggagactctaaagttaataatgtcttgctttgaggaacaagggtctccacccaccctgggctcataaactgcccccctcactaccactctctggcttcccaccaagtcctcaagaaatgatttactaagttcaatcaaggaaccagattctatgaaataataaaaggaaaatggagttcatgactgaaatcaagctgggcagagacataaagggtctttgttaataactgtacaagggaatgcaaatgaagacaggcttcacaaggaattttgacatcttaatgaagatttatgaagaatttgcagcatattaacctcaaatacaaggggaattacatagtcacataaaaacactgctttatgatttctttagcttaaaaacaattcaaaagacagtttcttcatgataatgctaataatttagttacaaaggttccccaccccccccttgtactccactctaattacattctccatcccccattacatttctttctttggttaactctgaagtgatacagctcattggcatgccctaaagctgtgaactgccccactgatgaaatcatgacagtgattaaatttctctattccacacagaaagttttgtgttacacagttttctttgttcatgtccttagtaacgcagaaaatcaactgacattttctcctaataatgaggggaatataagataatgtcaatgaaaaaaaaatcctctactggtgctacataagcggcataccaaaaaaaaaaaaaaaaaaaagcatgtgaagctgtacagatctcagtcaagaacacattggccacatctaaggtcagtgatagtattttgccacggtcatagattttatgttgtattcatgatacatacagataattagaaagactgagttcattaaatatattcaaaacacagaaactttttaaactccataaatagtagtaatactataagtagtagtacatgaaaaatagtttcatattacataatatgcaaagcatttttgcttttgattctcttaatatttatttcatgctccaaccctgtaagataagtattatcccaactttataggctaaggacctgagacctagaagttaaataactggcttaaaatcacactgccaacactgccagacaatggctgaggcctcattccctgtgacagggccaccccctcacagctcactgcatgcacaccccaccacatcccgggaaggagcttgcacaggactttaagggcacatgacttggcttccatctctactcatcatccagagatgctccttagctaaaagagaagttaatctcaggaaatcaatgctagcagggccaggttttactcttagggttctatctcaaattttagctacaatttagaaaatgcaggaagtgaaggaaggaggtcaaagaaagagccctgggacttccaggagggccaggtgctccttgtgtcacagttgctgctacaagggctgccttaatccctagtcccctagcccagccccattcctcccagcccacatgctgaccagctgctcagtgtttctctgtagggtatgtgaggggcagatgcaggccagcccaaggctgctggccttccgtgtgctgcccttcctgctgaagcggtactggcccttcttcacaccctcccagtctgctcagatcagacacactggcaggccagaaggcaggtgggaggacaggtgccaggaaaaaccaggcatagagaaaggcccacacagaagctgaagccatacgttctgcattcttacccatggagcaaaggagggaaatgtcaatggaaggcttgaggtgctgaggttcatggtcaccttatcccttggatttcagggtagtgagattcatggataggcttccaagcctgtgcactgaaggagggaagggtcactaattgagaaaacaagtaatttagacagaaggagcagcactaaaggtccagaggccggagacagcacaatacacaggagaaactgtaagatcatcaatatggttggagagtggagacctggtcacagggcctctcataagctaaggcatttgaactttatcctaaatgccaaacgaggagcttcaaagcacatgcataattaagacatctgtctttttagaaaatcactttggccacagcatgagagtggatcagaggagagtaagaccagctaccaggtaggagaccagttagaagactattgcaggagcacaagcaaaggatgacctttctagtgtagtgacctacactagaaaacatagacaagggagcaggttatggaggaaatgtatgaggcgggactgagagaacttggaggactggatgtgataggtgaggaagaaataatgggtgaggcagtaatttgagcaatgtggttactgagttccataacaacggagaaggagcaagttcgagagtgagataatgaatttgctttggacatgttgcctttgaggtgactgtggcgcatgcaagtagacgtgtttaatgggcaaaagaatagggtatccagcactcaaaagaaagatttgtgctagagatttagactagggacttatcaccatacagttgctgaaacattttctctagttactaaaatgtggtcccgagttacagactccctcaagccccagccaccccatgaagctgctttcttaccactagttaacattctgaagtcctctcctgaatctaatatcctgtccaataccactgagatactggagaaacaagagaacacagctataaagacaaacaggtactgtcacaggtggcatactgctatggtgtgaatgtctgtgtccccaccaaattcatatgttgaaatataacctcccaacatggggcctttggaaggtagttagatcatgggggcagagcccacatggaatgggattaaggccctcatgaaagaggccagagagagcttgtttatcccttctaccatatgatgactcgggtagaaggcatgatctatgaggaataggccctcataagacaccacatctgctggtgtcttgatcttgtacttcctagctaccagaactgtgagaaataaatgtttgttgtttcctgagccacctagtttatggtatttttgttatagtagcctggacagactgagaaacatactaattatttcatgcatatgtattttcctgtcccattccgctttaagcgtttcaggtcaaaaatgtgtctgctatatgccctgggtttctctaaggcagtcttggtttcaaacattctggccctatgcattcttttatcattaaaatttctaagaaatcccagcatttcctcaaatagtaactgaccaaatctagtcagtaaacattataatatataggtcatgaaacactgaggtctacaaaagatacacaaaactatggggtgaggaaacatcagtatttctcactaaattacacgaataatagcttatattgatatagcttcttttgtgaggggtgggtaaaataccacttataggctcattcaaaccaagtgctgagaatagagtgatgggcaatacacactccgccttcatccagcttcttgtcagataatgacataaacaattacagttgctcagaagaagtaaggatgctaacaggggaaacttcagtccacataaaactcagggaaagcttccataaagagaagacctttcaagttgagacttaccaggaattaactagatgataaaggcagagaaggaagagattccaaagggcggcaaatgtgtgtgtgaaagacctgaagtcagatttaactttattcaaaaagaactgcgaggcatccactctgactagaagcagagcaaagccggggtggcctggaggggagtgatacacagtgaatgctttcgctattgttggactattggttacggttataatactactattacaatggtatttttttatttgtaaagcccaaaaatgccaccctcataaaagcagacaaaactcatgatatcaaggcaaagccatgacgcagttttaacagatattactattttcagttgcttttactttttgaaatattcatcttttttagtattcattgaataaatgcatgtgaaatctttttttatgaggagaaatgtgtaacataaatataaatccactaatgctgcttagaagactgataacacgggttaacttcagtgacctttgagaatttgacatagttcttttctttttttgagacagagtttcactctgttgcccaggttggagtgcagtagcgtgatattggctcactgcaacctccacctcctggattcacgccattctcctgcctcagcctcctgagtagctgggactacaggcacacgccgcaatgcccgggtaaatttttgtatttttagtagagacagggtttcaccatgttagccaggatggtctcgatctcctcacctcgtgatccgcccgcctcggcctcccaaagtgctgggattacaggtgtgagccactgcacccagccttgacgtagtgattttctaaagaacttactgaattgatcttccctaaagttttaaattgattgaagtactttccaaattaactaatataactaaaacgatagaattcattctttgtcagtgaggaatcagagttctcttcaatgattaacaactttaggcgactgcaaaagtcaacaaagacctgtgtgactgtaaaatttcctctggtaattcaaaaacattactcagagatttcccaagagataactgaaacaaaaaaagaaaaataagtaatgaataagtacacctcctctgaaaagtacgaataaaaccatctacctagcatcttcaacaggagattccattagaatgcaagtttcgtgagggcaaatagtttagtcttcaaggcctaagccagtgccttgaagtacatggtaggtactcaagaactatttgttacatgaatgaataaataaatgaataactaaagtaactgcaaaaatcaatatctgatattgttgaattctgagtataattattcatatacatttattatttttaataaaaatagtgtaaatgcctaattgcccattatattgtttttataacttcaagaaagactgcacaaaatagaaaaaaaatttatttagaatactaatatgtacatttttgtattgtaactaccctaccatctgtttcacacacatgcacacacacaaatgtgcacacacacacaaccaccatcaccagagcctgcacagttagcacatattagtttctcaacaaatatctaaatttttttttttttttgagatggagtcttgctctgtcacccaggatggagtgcagtggcatgatcttggctcactgcaacctccatctcctgggttcaagccattttcctgcctcagcctcccaagtagctaggactacaggcatgtgccaccacgcctggctaatttttttgtatttttagtagagatgggggtttcaccatactggccaggctggtttcgaactcctgacctcaagtggtccgcctgccttggcctcccaaagtgctaggattacaggtgtgagtcaccacgccaggcctaaataattttttaaaaggtaaattgcaataattatcagaagaagaaccaaaacacaagtgataaagggtctaaaacgttaagatcagtcaagtggctcacgcgctataatctcagcactttgggaggccaaagcaggaggactgcttgagcccaggagtttgagaccagcctgggcaacatggcaaaaccctgtctttacaaaagaaaaaaaatagaaataatacaaaaattagtgagctgtggtggcatgtgcctgtagtcccagccactcaggaggctgaggtgggaagattgctggagccttggaggtagaggtagcagtgagccctgatcacaccattgccctcctgcctgggtagcaaagtgagaccttgtctcaaaaaaaacctaattaattaattaaaataaaatgttaagctctacacgaagccctagaagtcatctagtccaacttcatcatgtaccagatgggcagccaaggtccaaagtgccattcagctttacactaacagggcagggacaagaacactggactcctcaaagccatccaactccaccaggaaattttcttcacaagtttgggttagctaatcataatcggattacctactaaaaggtacagaatgtgtaatgtgttatccactacacctccccacctaagaaattattgcgctagttcaccaggatagggtcagcaaactatgccctgcacccaaatcctacccactacctgtttttgtacaacagggaatctaagaatggtttttacatttttaaataattgtaacaaattaaaataatactattttgtgacatatgaaaattcaaatttttgtgtccataaatacagttgtattggaacacagctactctcatttgtttctaaaactgtctatggctgctctcataccacaacagcagagctgaaaatttacaacagggactttatggcccatgaagtctaaactatttacctctagccctttacagaaaatgtttctcgacctttgcactaggagatagctaatgtggctttagtaagtttcaccttcaaaagagccagggttgtccccaccaacttgcagtcactcacatgctatttcctcttctttgattactgaaactccacagcaaactattgtttttaccagtcacccagaaaacgaagataaacgtttccacagaggaaataataaccttccttttccaaggtcctcctctgcctcacgtccagtgaaattaaaagcaattcttcattcacaggggttctgtgtcattttccccaacagaattcagaggacaacattaattcacttttacaatgaagggctcaggcagaagaaaagtagctagtagtgagtttatcctaagaaaaaaaggaatgtttaacattttctggaacggaaagcatttttgttttcccttgagatgctattctttctaacatcaaatgcaaactgccattatatactatacatcttctaaaaattgaaaatcataatatccatacttaaattttcaactttccagttttccaattacaagcaaagtaccaaattcatacctgctcagtgttgcaaaatgattttaaaatgtaatgatgtttttgtttgattttgtttcatagtattttcctctaccaatgtacaaaacactcccttgtaacaaataaactaagaaaatcgcattcccagggccttgggaaataactttaagggtgtctctgttcacttacatcatgaacccagctcttatgctcctaaagttacaaatggccactcttcgttttaatagcagatttaaagaaacctaatgttagttcaacacgggtaaacagtctctcacacagtataaataaagaattctttgagttgtaaatagtagttgctcaaagaagtggaagggtggctgaggaagacagagaaaagatgccttctctcctctctttctagcagggcaggccagggaaaggaggcaggacgccagaaggctggaagagctcagccatccagaaggacagcagggttgccaacttctgaaagcagccaccattcattcactgttcactcatttgtcaaacatcaactgaacactctcctatttatacaacatccgggggactcaaaagaagaaaacagcctggacactgctgttcataagaagccttactgtccaggcacagtggctcacacctgtaatcccaacactttgggaggccaaggtgggaggatcgcttgaagtcaggagtttgagaccagcttgggcagtgaaccaagaccccatctgtacaaaaaaaaaaaattttttttaaattagctgggcatggtggttcatatgcctgtgatcccagctactcaggaggctgaggtgggaagatagattgaccccaggaattcaaggctgcagtaagctatgattgcaccactgctccagcctgggtgacagcaagacctcatctttaaaaataagaataatagtaaaagtttttaaaaactttttttttaaaaagaaggccactaacatgcaggttaaggcaaaatgtacgcagaaccaagaaagctgcgtagcaagacaatgacccatgccaggggtcagctaactacagcctgcaggccaagtctagctggcagcttgtttctgtgaataaagttttattggaatatggccacactcacttatctatgtattgtctacagatgctttcacattacaatggcacagttgagtggaagcaacagagaccatgtgtctggcaaagccaaaaaacaatctggactctttcagaaagtttgcctatccctgacataggccagagagggatcaatccaactggagtaatcagagaagactatatgaaagaactgacatttgatctaagttttgattactcaacgtttcaaaaggcagaaatgggaaaatcatattgtgaggggcagaatggccaaggcgagatgagtctgagcaatgaaaggactgaatttgaatggggtacaggatatgaggtggggagttgtggcaaagtggctaatgatacctacccagactacatggtttaacagttaataacatagctccagagtgtttgctagcttactggaaatgtcattccccttttctctagcttccttcacatttatggctaattccatagctcacaaatatgtttgttcactgattgattactgtgatcaatcaaaagtttgcatgtcagtttaatttcaaaaacacttctatttacattattgcctagacttacatttaatcctcaatcacatcagacattactattcctacttgacaaatgataaaaactgggcaactcacctcatgtcccatatggcgtcaggggcaagagactggcttagaaccctggattctccaacccatctcatgacccaccttaggaagacactcatattggaaaggttaccacctggactgtattctagaccagaaattctgataatcaaacaccaaataatcaaacaggaatgcttttttggggcatatccttgctatacctgaactgtggcctgatagtagctcaaaatccacatcaaagaccaagttcgaggtacattcattttatacttaatgaaatctggtcaattcacataattttgttacaatgggcattgggtaaacgttctcacagattaacttaatccattataggaggggaaaagaaaaaaaaaaaaactccacctaccagtatatactttggcagttggatcatcattattttgcactggaaacctagaacccttaagagaaaggtatcatttgtaattaattttcctgtcctttgtacttgtaagtaaacaggtggtgttcggatgagtcccttaaaagcccctgttgcctgccaattaagtaataatattttcttttcagggaagtgccataaaagagactctaacatcttgggtcactgagtacttcctatgcaggaggatatgaggctgcaacactgaatttttccaccagcaggatattcaatgtgatgagtaaattagcaattagcatggaaaataggagttattctcagcatttgtcatatgagagatcagaattcctgcactcgtcacgtctgtataaatggtttctttaaccatgaacatcgtctcctcttaactccctccccatgtcactccactcacaatccacctacactgatacctcaaaacatctcttcctacacaatttttaatgttttattcctttacctgcttgctttacacaagcctgtctagagtcctctacaactaaattatttccatcatcgttaactttagaacacggttccaatgccagtctgaaaaccattctgaaatatccaacagctcttcttccaaagtgcaggtgggtaggctggcagcagagcagagatggctttttatactttcaggatcataaggggagagactacactctgctagtgttttgtcttccagcatccaccatctcctagcctttcccaacacccacctcttaaaacctgggcagtctcagaaggcaagaccaggaaatgtaaaggcacaggaccagacagaatcatatatgaaagcctaacacagcttaggggactggcctaggaactatggccaattatcctctctcttggcctaatgagattatgtcatgaagatgagtaccactccctaccatcagtaatgagaatgcagaggcaagacccagggaccaaggaaagggttaaagacaagcagcaagatgaagggtaaaagcttgctggttcagaaacattatctatctgcccctgacatactcatctcaatacagccaatctccactcccggcatctcttctttgatttactaacttatattcttttgttacttttttatttttatttttggcagggtctcactctgttgcccagggtggagtgcactggcacaatcttggctcactgcagcctcgaccctccctgagttcaagtgatcctcccacctcagcctcccaaatagttgaaactacaggcacataccaccatacccagctaattttttaattttttgtagaaatgaggtctcactgttgcccaggctggtctcgaaatcttggactcaagcgacctgcctgcctccacctttcaaagtgctggtattagtggtgtgagccactacacccagctgggcttttgttatttttcaacaatcaaataatccatgttcatggtgaaagaaaatccacactcacggtgaaaaaaaaaattgtaaaatgcagataaacaaaaatgagagagagagaaagatgaatggaaaaaagaaagaagagaaaatacataacttccctatccattactaacacttcagtactggcttccaaatgtgttcttgcttaaatgtcttttgaggggtcttgcttgaactgctttcaaacatcagattttacttatatttcatctgggaaaatcagttcctctgagagctattactgacacacagtcatgtgcagcatgacttttgggtcaacaacagatggtacattcaacagtgggcccataagatcatgatggagctaaataactcctactgcctggcaacatcgtagctgtggaaatgtcgtggcacaacacattacctttctctatgtttagatacacaaatacttaccattgtatttgtaccactgtaccattgaatacctacagtattcagtacagtaacatactgtacagtttttgtagcttaggagcaataggctatgcatatagcctatatgtgtagtagactatactttctatgatgttcacaaaatgatgaaaacatctaatgatgcccttctcagaacatacccacatcaagcagtactgactgtacttttcaaaggcaatagcactgatgaataagaatttcttttcatgtagtgtaatataaatgtttgattctacatcttcctccaaaatcattaaggctcttttgacctaagaagtctcttacaaacaatatgaacatctttcaaaaggagacatcagaacgatagcttagggtgagcatggtggctcacgcctgtaatcccagtactttgggaagccgaggtgagtggatcacttgaggtcaggagttcgagaccagcctggccaacatggtgaaaccctgtctctactaataatacaaaaattagccgggtatggtggcatgcacctgtagtcccagctactcgggaggctgaggcaggagaatcacttgaaccagggaggtggagtttacagtgagctgagatggcgccattgtactccagcctgggagacaagagcaaaactctgtctcaaaaaaaaaaagatagcttaggtgatggttacaggggggtacattatactagtctactagtattgaggtatgttttaaatcttccattagaaaaaagtgttttgcatatgcacctaagtgctaatctatgtgcagaccagcatgtggcatgctccttaaatgaaataaacaatactgaactttcaaaatgccactcttaaagatttgcagacatgtcctaatttggttgcagaaatacctataattcagctctgaaaattgcattcaaaacactggtttcaaccatttttttataaggatttcttctttggtcactgatttatcagactcttaaaaactctctatacacaaaattatatgctctccagaatttgctttaaaataatttaggtagcagttaaccattacaaatttaaaacatttctaaaagaggaaggggatcaatgaataagaatggcagaatgtggacgattgctgaagtggagggatggtaggtacgtgggaaattatcatactgttctcttatggatatttgaatatttccataatacaaagttttaaaaaaatcattgtgaatatatattgctccaattacgaatcagtatttcgtacccagtgcacaaataattaagctctattggaatggctacttactacgtgcccagcactatttctagcacttgatactcatcaattccttgagacatgcctgttcagttggtattattggtctcatttgatatctgaggaaacagatcgaaagaaacaacccacttggccaaggactcaaggcaagtgagatggaggaggggtagcggccacaccacagaggtgtctgctacatatattgtttggtccctttataaatattattgtacgtgagcatgtctgtttcattgtcacttgcagtattttagtgcatcctgtttttctagaaaaatgaatcagcctctctctgtttatccaagataacaaaacaaaaaaatggcctgagaacaatattggtctgatggaggccatcctgactgaaagaggaaacgtccctgagtcaatatcctcagtgagagacatcccttcataaaacaaaccaggaatattccaacaaggttcaaataagcataaacatccacagagttcagtggaagctacactgcactcagccaccggcattttttactgcctgtgggcttttcctgtctcatcgcagactcaattctcaaattctgttccctcaaatgtctcaggctttaaagcttccataagatctcatttttccccttaattgagaatgtccgcttcccaccctttctttctgcctatgaaaatttgaccctatctttaaaaattcagttcagggaacacccttctctgtaatcccatgtaatgaaatcccctggctagaactacgtatttcttcctctgtactttcctaataaaatggctgtcctctctctctctctctttttttttttttccgaggtggagtttcactcttgttgcccaggctggagtgcaatggcatgatctcggctcaccgcaacctctgcctcccaggttcaagcaattctcctgcctcagcctcctgagtagctgggattacagggacgtgccaccacacctggctaattttgtatttttagtagagacaaggtttctccatgttggtcaggctggtctccaactcccaacctcaggtgatctgcccgcctcagcctcccaaagtgctgggattacaggcatgagccattgcacctggcctgctgtcctctcttttaataaatttctttcattctgccaggtattatgagaagtcattttcagatttctttctaaaactgaacctaagttatttaggacaaaggccatgtacttattcattactacatcccgcagtcccagcacaaactagaagcttaaagtggaagaaaaagtaagaaggagggagggagggagtaaatgttgctttatgtgcataggccagagagtctaataagggggttagtttctaaagtcaccaagaaaatgcgaaactaatgtagaaaaaaaatgtccctgaaaatctcctaactgcatattaagtttatgtgccatttttagacatgctatctcttaattaaaaccagcacacccagttttacctcccgctttggaacagatagctgagaagatagctggtttccatttaggagccaccttgtgccatgacaaggtggtcacaatttgagggtctcctggggaccatgatgagcagaaggaaaaacgaactttcatctcatctcactctcactccagggcaattggattggagcagtgtgcaatccgtcttctctttccttctgtccccatctctctccaggcttatgtagtagcatgtggataagtcaatgcacacacagtgtgtgtgctttgctgtgcttcttcaagttcaaaaccactagaggcttatggctttccacggattagccacttttcattatttctaactggcctcattctaacaaaggatttggaaccttttaaaattccataaatcaggccaggcgcagtggctcatgcctataatcccagcactttgggatgccaaggcagggggattacctgaggtcacaagttcgagaccagtctggccaacatggtgaaatcctgtcttcactaaaaatatgaaaattagctgggcatggtggtacatgcctgtagtcccagctacttgggaggctgaggcaggagaatcacttgaacccgggaggtggaggttaacagtgagcagggattgcatcactgcaccccagcctgggaaacagagcaaaactctgtctcaaaataaagtaaaataaaataaagttccataaatcataccaatattcagagtccaatattattcatggactctgaaaaatccctcctatggatacaaaaataaaatgcagaatattccaccattggctaaaagaaaacaacgttattatagtacatgcacatagaaaaatctggaaggatgtataccaaagcaaacagtagatatacaaatgatagactatgggagatttttcccccttaattaacaaagaactataattacttttgaaataacttttaagggttactttttaaaggctactgtcaatttcttagggatggactgaaacaagagattccaaagataaagcctgtgctctttgcaggcatgtcctctcagaagagcgtctgagaataagacattcgaaggactgaagaacagtacgaaggactccttgagccaacaagctgcctgcccaggctggctacaagcctgggtctacaatgtcttgcagccaacagatacatccgggcatgctggtggggtcagcagacactgaggcgctggtaccaagcttgaggtaaggagaacaacatctctcgagcatccatctgtgctggtcttggtgccagcgatacaacatgtatttatctctaatcctgacaacaccacccaaggcaggcaagaggctagagagcttacccaatgtcacacagccagcgtttgaagctcagtaagccaagctccagaaactgtttaacaatctaatagctatgaaaaagatgtggtccccacatatctaaagcttacagacaaatgcagaaaaagagagagagaaagatgtaatgtcagatgtgaaaaaatatcatcgaagaataagtacaggggttttgaggagtatataggagaaaaaccttaaaataggcagagtcgagacttgaacacagctctatttagacataaagtctctgtgccttgcattatactaggctgcctctccacgctgtaggagcctggaaaggtaaaggaagctccaactgagagggcagtgacacgacaagtacaatcctgtcccctcttctcctcccccctccccaccacctcctgggcttctgaaagaatcagtgcaagagccaacatctccttcaacccattgacgtctgtgagatacccagagacgttcaacccagagatatccaggctgcttgccaaacaaggaaatccaagataaacgtgccattctgtcatgaccttatcctgctgagagacagacagaaacaatggcagagaggaatagccttgcatgttttcatggcacctttcagaaagagatgaaattcaccatcagtcacacctcttggaggttgtaccatttagctgataagaaacagccagagaggcagggagtatggacactcctgaaggcaatcctatgaggagccccctgaaacttcttgaagaagaaaaatagcactgttcccctccccttccaactcttcacgctgacaggagtttctacgaggcagtgtttgtcagtagtattattaaaaaaggaaccaggccagattagtgactcacacctgtaatcacaacactttgagacgccaaggtgagaggattgcttgaggccaggagttcaagaccagcctgggcaacatagtgaaatcctatctctaccaaaagaatttaaaaattagccaggcatagtggcatgctcctgcagtcccagctactcaggaggctgaggcgggagtatcacttgagcctaggagttccaggttacagtaagctatgatcacaccactgtattccagcctgggtgacagagtaagatcctgtcaccaaaaacaaacaaacaaacaggtatatagcactggttgatgatttcttcaatctccacactctgtttatttttattagagcacaacaaaggtaattttgttcaagcctactactttaggtttaggcttgaactgactgccaagggacacagtttacctttcttgcccaaaaatgtggtggccccagtaatattgccttcttgggttgctggttaatcctcgcacaggctgaaactggagatcatattatatcaatggtctcgttctctcaggatctcacagatcgatttctaaattttgttttccaaattggtggtccattagaagcacccaggattccatcattacaccttcctttagtcacccaatttgggacttagctccatttaacatctacacgctttgatgtattttggtcctgggctccatcttatagcactcttatagaaaaacgctttcttaaatcctagaaacagctttgttgggtaggtgttttcgtatcatctcagtttagagatgttgcaaaacccaaacattctgactacagaatccatattcttaaccactacaccagattgcctcctccaaagagggtttcagacaactcagtttctttattttttagataaagaacccataaagggaagcgtggcacacagagcataaacagaggtcatggacaccccaacctccatgatatgagacctgaggatctaactggatctttttggaacctctttggtcagccattaaattgaggcaaccacagaattcatcttctaagatgacagtaggtgtgaccacagagcttagctggattgacaagtcttgatgaaggagagaatttgtgggcagtgccttcaaacttagttccaagtgccttaaggaagatcctctggggagctggatctcatatgttcttctgcacccctcctccaccgctcccccccacacacacacactcatcttctttgtaaaagacttctttaaaacaacatagagtatcttatctactccacatgacagaggatgtttttatagcagccaacacaaatgcctagatcatttttatctaggtcctatttatctatctaggtcctcaagttccagctcacatcccatctgtctggaaactaacagcatttccattgcaaaaagttacaattgcatctgccccacatgggggaataaaccacacctctaggatgcagagctaggagaccacacacatcagcctttacacaagaatctcaagcttttcaactgtagtgtcctatgactattctcttttctcagaatgacacaagtggagagaatgcaaacaaactaccagaaatctggagcatcataaaagaatccatgtcacccttgataggaacaattctgtattggaattaattttgctgaatgaaccacaggttcctgaaaacaaatgtgctgccgttcttactttagggtcctgaaaatgtcacagaataacatgctttttctacctcagcttttgctttgcttaaactgttttgaagtatactaaatatggcatttaaaagggcaaaaaatatgaacccaacagtttttaggcctcccttataaagaaacagtccttgtttttaaacttttcaagtttcttaaatttgcttctttgctgtctgcttttaaaaattccagacagtaattctaatcacagaagtctttgtgaaactacatttctgtaattttttttttaactcaagtaatgttattggaaggaagcagaaaaccacagtgcccaaacagaagtgactaatgctagcagcaagtgctgtaataaataaggccccgagagcaagagaccgctgcaccacagtagcttgttgtatattcccatggtcaggactatttggagaccagcaaccagattttccagagctcttgatgtgttaatcaaggtaaccaggtgcaactcctttcactagcaatcttttgctaaagatgatagaaagaaaaaatacaggaagagcaaaaatctaaagagaggaagaagtccaaataaaacattcactcagaagacagaaatcatactaatatggtctatgcccagttatattacagatcagtttttaaataactacatatgttttaatgtctgatgtaatgcattacaggtgttctcaaagttgtacatggacgatggaccagtgacctaacattaaactttgaatttctctactactgtttcaacatgttgttggcacaatttccgaattagttacgtggtttttctttgccaccataaggatgtctgctctgggacccaaagagtcaaaatgccttaatcaatcattgaactttccttatctttatttcaactctcactcactcacctttatctaaaaaatattttggtagagattatgaatccatatcccacaccctcctcctgcacaacctatctgcttctgctcactgcatgccccccagtcttatgacatgattggtaataactatttttttattatgataaatttgatcacctcaaaatcagcaagaggcttgttttaacccagacttatgagttgtttctctgacaatgacatttcaggtataaccttaaagcaaatttgggatgttgttattattctcccaggtgcaatgatcttttctatcaagttgttgttatttgaaagatacactttgttttcaaaaaccatgaaaatatgaatgaccaattgtcaaagtaatttattagagacattaaatttataccaataatataatacaaataacatataacaatgataattatctttttgtacttacaaccaaaccatattttcccagaaagaaagaaaggaaggaaggaaggaaggaaggaaggaaggaaggaaggaaggaaggaaggaagaaagaaagaaagaaagaaagaaagaaagaaagaaagaaaaagaaagcaagcaagtgagcgtgcgtccaggcgcagtggctcacgcctgtaatcccaacattttgagaggctgagctgggcagatctcttgagctcaggagttcaagaccagcctggacaacatggcgaaaaccaaaaccaaaccaaaccaaaaccaaaaccaaaccaaaactatctccaccaaaaatacagaaaatcagccaggcacagtggtgcatgcctgtagtcccagctactcgggaggctgagggagaaggatcacttgagcccgagaggcagaggctgcagtaagctcacatcacaccactgcgctccagtctgggtgacagagtgagaccttgtctcaaaataataataataatgtgctcgattcagtaacccactaaagtgggtctgagtttatcattattctttccttactatccccatcgaaatttatggcaataatagccttggattcagtaattccattgctaagaacaaattctaatgaagcactcaggatgcatcttaaaaatctttgagaatgtttatcagctgggcacggtggcttatgcctgtaatcccagcactttgggaggccgaggtgggtggatcacttgaggtcaagagtttgagaccagcctgaccaacatggtgaaaccctgtctctaccaaaaaaatacaaaattatttgagtgttgtggtgcacgcctgtaatcccagctactcaggaggctgaggcaggagaatcacttgaacctgggaagtggaggttgcagtgagccgagattgtgccactgcactccagcctgggcaacaagagcaaaactacatctcaaaaaaaagaatgtttatcatatggccatttaaagtgtgaaaatgggaaagaacctaaatgctcagtaagaggggctagatgaacaaagtagggtacagctataaaatggaattctgggcagtcccaaaggccatgctatgatgccattagctgtgaaaggcatcccacatcatttaagtttgcaatatatgttgtctttctttctgatgaattaatccattttttgtccattgaatgacatcacttctacgaacttgcattctgacatccttatttgaataggagagaaatactttctatgggtaaatgtaaatctgtataagtggaaattatgtaattgctttcagggctaatcatccactatgtgaccgtgtagagaagatacaatcctgataagcaaactagagggctactatttatggcaaatgggaatttatatacaatgccagaacctcacagtcctttctgaagggccatgcttcatggctgcacttaattctgcatctcctcgttaccttcatgtagttttggcaatgttgtgctctcttgcatatatgcttagctctccagccaggctacagggttaaggctagggtccctatctcccatgtggcttgcatcactctctgtggagaaagtatgtggttatcgtctgcccagaatcacttcccttcgtccggccacatccctccccaccactaccatgaccacttccattgaggaactaaatctttctccattctaactctgtgattcctgaatgatgaacaatccagtacccttctctgctgagctcacaggaggtcaaatgaacagatactggcatacattgaagtgggcgggtgagggcgggtagagggaagccctcttgtccctttagaggctgctcgtttgggatgtggatgcccaaccttcctgaggccatattcctgccaatggagaaggcaatatggccaagaggcagagagatgagaagtctaaatgatactaatgaagtccctggatctggagccaaccttggcctcacttggttcatgcaccagctagtgtgagctagacctctgtcatcttcagctggaacagtcctgactagtccaccctccatcacacaagccagagacaggaatctatattctgtgctgcattcatggccaaacagcccagtctctgttcttcaagctgtccaggctggctaccaccttggagatgggagccacacttgggactatataagatcaagtttgctgcatccttctaaaataacattgcttctgctaaggggaatgaactgatacgtactgtttcttaataaacttagaaaaagaaatcataatcatttttaacctttttttttagatggagtttgactctgtcacccaggctggagtgcagtggcgtgacctcggctcaccacaatctccacctcccaggttcaagcaattctcctgcctcagcctcccaagtagctggcattacaggcatgtgccaccatgcccagctaattcattttatttattttattttatttatttatttttttatttttagtagaggtggggtttcaccatgttggccaggctggtctcaaactcctgacctcaagtgatccacacacctcagcctcccaaagcgctgggattatatgtgtgagccaccatgcccgtaccattcttaatctttacagaaagtcctttttcaggaaaagttggttgttagtgaaatagacaactctacccttttttttttttttttttttggtttttttggttttttttgtgacggagtctcgctctgttgcccaggctggagtgcagtggtgcgatctcagctcactgcaagctctgcctcccgggttcatgccattctcctgcctcagcctcccaagtagctgggactataggcgcccaccacgcccggctaattttttgtatttttagtagagcttgggtttcatcatgttagccaggatggtctcgatctcctgacctcgtgatccacccgcctaagcctcccaaaatgctgggattacaggcttgagccactgcgcccggccaactctaccctttttcatccctgccttctgtgacagaattatagtgactcaaattttgtttttgttttaataaagcaaaaattaggggctgagcatggtatggtggctcatgcctgtaatcccagcactttggaaggccaaggtgggtgaatcatccaaggtcaggagttcaagaacagcctggctaacatggtgaaaccccatctctactaaaaatacaaaaactagctgggcatggtggcacatgcctgtaatcccagctacttggaaggctgaggcaggagaatcacttgaacccacgaggcagaggttgcagtgaactgagactgcaccactgtactccagcctgggcgacacagcgagattccaaataaaaaaaaaaaaagcggaaattagcatcacatgcaaacaattatattctcaaaaggaaacaagttgttctatgcatagcactaaaagccctgactcaaaccaaatgccacctccttaatcacctccatgcagcaccctgagtttaccatttaagtacctaccaagtccctcccttcctagacgtctgacacccagttgagctcatggattaaggtgacactcataaaccattcttagcaatgagtgtgctacaaccacatagcaatgactgcaaggtaattgtaactcatgacaaatgagttttcctgcaggcgccaggaaacaaaaacatcacagatggctttctgaatcaaatcaaggtacaagggaccaagtcttaaattgggaaaaccgtgcatttgatttcagtaggaaacaattgcaaataagttaatcccactctgtcagtcctctatattcattactggagcctaccaactaataacagagccttgagaaagagtaccaaaaacccagcatacagtaatgcaacatgcagcagcagaccacgtcctataaccatcctcggtgcctcaggatcatatttcctatgggttttcctcccttaaaatccatccagttgaaatcagtcaatatataaaaccaagctaataatatcttgtttgagctagaatttaaagagaatgtttgcattcaagtatatacatattctatagtatgtaaaaaaaaaaaaaatggccagaactgatgtgatgttcagtatagaaaaataatttttactttactaaagtaattagcattgaaaatcccaaagcaggctgagcgtttttggttagaggtaaaattctactcctttttttccatactccaagggaagataccagaggtatcttcccacgaggactacaaaagagcatcaattggaaaaccacccatattgaatgtgtaggcacatggggtgatgaaatacacacagcataaaggtgcatctaagaatagtatcaaaaacaaggtgttgcccaaccttggcacacagcgcacaggttgttgaacacctactccgtcctgaggccaccaagcagctgcttggccaatactttatttatgccctgccctctcttaattcacacaagtgtaatatcctgcccaccgtgccactccccagcacctctccaaagcaaagaaatcttaggccaggtaagctaacaaaaaacataaaatgagacatgagaagtttcttagggacctagggtcatcagatttagcaaataaaaatgcaagatgcccagctaaatatgaattccagataaataataaataatttgtttagtacaaatacgtcccatgcaatatctgggatatacttaaaactaaaaatttacctattgtttatttgaaattcaaatttaactgaatacctgtattttatccaacaacccttcttagggtaaacatattgttaaggtaaacccatgatctattccccttctctcctgaccacaatcctaatttcctttgggaaacatccaccccattttcagccatgtagggtgtcatgtggggtaatcaaccctgaatttatgctgaacaatgaaatgcaatgagcagaggaacacgaaattttgatgggaagaaactatggtatacagtcctaggagtgaggaagcctgagagaaaggaaggtatgccagctgccttaaaccagccctttcctgcaccccctggaaatgccagagaagccaggaagaaaggaataggtggtgataactgaagagtgtgtgctatggctacaggaggcccccaaatcaagctggtcaaagtttgtattaaaccaaacagagatatccatgttgtccatgaaatcacagcggggttcacctccaaaactctccagggtgggtctccttcccttctccttatatttgtagcctgagagggtcctattatttttaaagaaagttgacgctttctaaaaaattctgaagacattaaaaacttattggccgggcgcggtggctcacgcctgtaatcccagcactttgggaggccgagaaggggcagatcaccagaggtcgggagctcgcgactagcctgatcaacatggagaaaccccgtctctactaaaaaagcaaaattagccagccatggtagcacatgtctgtaatcccagctactcgggaggctgaggcagaaaaatcgcttgaacctgggaggtgggggttgcggtgagccgagatggcgccattgcgctgtagcctgggcaacaagagcgaaactccgtctcgaaaaaaaaaaaaaaagccaggcgaggtggctcacgcctgtaatcccaacactttgggaggtcgaggtgggcataccactaggtcaggcaatcgagaccatcttggctaacacggtgaaaccccgtccctattaaaaatacaaaaaattagctgggcgtggtggcgggcgcctgtagtcccagctactcgggaggctgaggcaggagaatggtgtggacccgggaggcagagcttgcggtggccgagatcacgccactgcactccagcctgggcaacagagcgagactccgtctcaaaacaaataaacaaacaaacaaaacttattaagccagtttggggcactttgtgagctgcatgctttgcaacaaggaaactcaaacaaatactgctctaggaaacagctgccactgaagtcaaattttggctcttggtattgtttattgctttgtatgacaggctaattcttgccccagcagtatctttttcggtatcgtggagcacatatatccttgtccgcaggatagactaggtgagcttttgaaggttagggaaaatggatggttaacctagctcaagtccagctctttcagactttagtaccaagaaagattctaatccaatggtacaagtctctcaagtctcacaaatgattctttttattttttttattttattttattttattttattttattttattttatttttgagacagagttgctctagcctctgttgcccaggctagatagagtacagtggcatgataacagctcactacagcctcgacctcccaggctcatgtgatcttcccacctcagcctcctgagtagctgggaccacagacacataccaccctgcctggctttaaaaaaaaaaattgtagagatgggtctccctatgctgcccaggctagtctcgaactcctgggctcaagcaatcttaccatcgtgtcctcccaaagtgatgggattaccaggcatcagccactgtgcccatctcattcttctggcagtaatctctgccaagtatttgaaggaaaggttcagagaaaaaacatttttctttaattgtgcagcatgagtttaagaggaaaaaaagttatttcccaactcctactggaaagacctcagactccctattaaaataaatactgttgtttatttaaaaagtttcactcctttctcagtcaaactaaaatatttgtctttgatcttacagaagagtccctcaggctcacaaaagtacttatattgtattttccacctattcatttaggatacttatatacccttacagagaaactcctcagagattatctaagaactaggtcagtatttcctacgctggggaatctgctaagcgaagctaaccccaaccaggacttgagtgtggcctgtaaaagactttcccgctagaccctgtggtttctccaacctcactcctatgctttgccatttcgaaatctgaggaaaatagtctctcctgttctccaaataccagtaacttgttacccaagtgaagaccaaaacaaaaccatgaagatattcttctctgtcacaacaatctttgataaaaatattgtttcaaagacaactggcactaaatgagtattaaaaatccctgtaagttttaaactgttgatgacacatattaaaggaataaaacaaaacaaaaaatcctttcatatcagccaacccatctactatggagtatctgatcatgaaagtgtataacaatatgaaaaccatatatgcaaacatatagggaaaaacttgaagggtattattactgagacagggtcatgctctgtcacccaggctggagtgcagtggagcaatcatggctcactgcaacctcgacttccatgactcaagcgatcctcccacctcagcctccccggtagctgggactacagacacacaccctgtgcctagctaactttttcattttttgtacagatgagttctcactatgttgcccagagtggtctcaaactcctgggctcaagcaatcctcgtgccccagcttcccaaagtgctgggattacaggtgtgagccaccacaccgggctaacttcaaggatattagaataataaaatcttcggtgcgtttttttcttctgtaaaaaaattccaattccctataaattgcttttgcaataagtaatattataatatttaagtgaaccataattataagagtgttagtcccaaaataactcatataaaattacagtctgtcattttgctttggcctccagctctagcaatgaataggtagggatgaagaaaaggttttctaccaaggataaaagaagaacagcaacttctctcggaccagtagccaaagacaaagatctaaactgtttccactctcctagctggccacctcatagacaggatatggctctatttgggacagataatcagaatttcttcttgcctttcctgcagaccagctcagtcccgctcagctcccgtaccttctaggcagaaatagtcttgtcacttcatgtgaggccccagtcacctgcttaagcccttttgcacttattgggcaggtaaacaagagtttgcatataaatcggggcaccttagctctaggatcaataggaagcagagtcacaatgcctaaggtaatgagaacggttaataactcagatgattaaatcctccttttccaggatcatggtgtagaccaagagtacctgcagtcacgccaggaatgacgtccattcttacctcacccatctgtttttgcacaatttgcatttagatgtagcaaactaaatttcctttactcattccttccttgtttttaagctctacttaattctgacaaggttcacaatctaatgatggaaaggacaggcttaatggacaaaaggggatgtcagcctcccagaaacaaatattcttttgttgagatctcccacacaaaatgtggtcagtatgtcagcctggaaatgttgaccttttcacagttgccattaatgggtcaagccagtgggagaaatgccaggcaagagctgtccccactcacctggggtcagaatagaggaagaggaataaagattcacataattctcacagtcaaatttctcgacctcctaccaatatcatgggggcagaagctaagtttagatgaggaaaatgacttactttccattctctcaaaagatccactattataagagtttatgtttctaaaacctccttactttaaaataatttttttaagttgttactctgggtgtagagagaggccttgcctaaaatccaaaattgtcgggttccttgattcttaatgacattagcaaaatcagttctgaaacaccactctccaagcaaagtttggatcaaattaacatttcatctctccttcagccagttactaaaaaaggcattttcagtcttcacgtacaaaccccaaatataagtgccaatggatattcaataaccataagcaagctcagaatcaccacctaccctctggcataactactttcaggtaaagcttaccaaaaaacagcaatgcatcctccttgcctatcccacaaagaatgaaattacactcccgctgtatcttctcagagagggaaaaacatttcactccctatagccattcttgtcaaatgacctgatggggtagtgactggagcacaaatccagatccaagatcaagagaggccattaacacacacgaagggagacatgaattatcccaacaaaattaagtaggtccactctgggtactgcaactagggtggtgatcctgggctccatgcttggtagggaagagctgtgaggcatgataccttaataaaattgagaactttaagcactttatttatttattcatttagagacaggatctcactctgtcacccaagctggagtacagcggctcactgcagcctcaacttcccaggctcaagtgatcctcccaccttagctcccctgagtagctgggactacaggcgcccaccactatccacagctaattttttgcatgttttgtagagacagagtctcactatgttgcccaggttggtctcaaactcctgggttcaagcgatctgcctggattcagcctcgcaaagtactgggattacgggcgtgagagtactttttaaaaaataatttttactttttaaaatttatttacttatttatttttatagccttgaggtccctctgcattggttgagttgccccaaggccacgtagtttctagcatagctctgactctaaggaaacaggcaaggtagttcccactttaccaacgaggaaacgtgcttcctgaagttatgtaagctcattatgtggcagatccatgattcaaaccagtacgtctgattacaaagctcatgagtactctctatgactgctctctgacattgatgaccaagcatccaacctgtccatccacacaacgcaaacaaagccattaagcccagatccctacctttaaagcagtagagggaaactgctgttggcaactgtagaagccactaaaggaagatcattttccactcaaaaatggatgtaattttcaaaaaggtggagacaacccaaaagtccaccaacaaatgaatggataaacaaaatgtggtatatccatacaatgcaatactattaagccataaaaaggatgaagttctgatgtatgctacaacatagaggagccttgaaaacattatgccaagtgcaataagccactcataaaagactacatatcatatgattcaatttacatacaatttccagaataaacaaagctacagagacataaagtggattagtaatttcttaagactggtgaagatgagaatgtggaggagaggggcatggctaatagctatctagttagttggggcttctctttttggtgatgaaaatgttctaaacctgactgtgatgatggttgtacatacctgaatctattaaaaactattgaattacacacttaaaatgagtgaattatgtgctgtgtaaattatatatcaatgaagctgttaaaaaataagtatggccaggcacagtggctcacgtctgtaatcccagcactttgggaggctgaggtgggaccatggcttgaggccaagagttcaaggacagcctgggcaacataggaagaccccatcgctacaaaaataaaataagccagccaggcatggtgacgcacacctgtagtcctagctacttaggaggctgaggtgggaggatctcttgagcccacgagtttgaggttatagtgagctatgattgtgccaatgcattacactctgggtgacaagtgagaacttgtctctaaaaaataaaatatatatgcaagtgtaattggttaagcaaattaaaaggaaacttggccattatctcctttaagttcttcatttaagggtgaggaaaccaagtaaaaagtccaatattaggcaagcgtcctacctactaatcccagtactcaacaatgtcctttgggacccagctcagtgctaggtataatggtagacccccaaagagtttaaacctaatcaggctttttgaagccaggaacaatgaaatccaacagcctgtagactgggttcaggggtggagcggacactaagagctgtgtagtcaggcaggaggtgagacctagaaggaaatccatggcagaatgaactgatggagggtcagggaagaggtgagtgagggtgctccagggaaggggtacaagcactgccaggagctgtgggtggcagcaaatgggttgcaagggaagtgaggctcgatgagcagggtcacactgtcagattctagaggtttaggaaccaggcaggagatcagccctgacaggacaggacaccaagaagagttctgtagcaggaaaagggtgatgagagccatcatgaaggaagattagcctggctgtggtgtgcaaaggactgaagtcagaggctagtgtgctgcagtctacaaataaatgatcacatcacacagtagggtggaggcaacaggaatggagaaagaggaaggaaagatgagaggtccagaaagggaaaaataatgaagacccaaccatgtcaagaccggtgagagggaaaaggagagccagggtggctctgggcccagactgcccaagtttaagtccttactagtgtgcggctttggtcaagttccttaaatgccctgtacatcagttttctgagcaaagtggggataaaaatagtgtttctgtcagagttcttggcataattaaatgtgaacagtgtgagaacaatgcctggcacaaagtaagtgctaggtacacgtttgttaaataaatacacgtaaatgcatattaagatgtctgtgacccagcttctaaagataagagcagtaaggaaaagcctcattatctcccaccaaagtttcctttttcactcattttttcccgtttatttatcctaaggttctgggaagaataaaacatgttccctgcccttgagaatgggctttcaaggagaaataaatcagaaaacagagcaatgcctattccctaccaaggtccatgcacaataaatggttgaatgacatgcttggtgaggatcccaaagaagcaagtgaaagaccctggatctgtcaggctgctgttgtgcaagtccacctctcctgtggagctcctgtttgcaaggcagccagtgacccaaggccatgctcagctggcattcgccctttcacacggatgtgctttccagacactacctcagcaccagcaaccactgagcctcttccctgccctgattctcagtagctcaccctccagacccggccacggtatatcctcaccatgtctgtcccctcacaacttaaatcaaagactctgaggccaaaccttgaattgacaatgctagccaaaaagctctgagcagggatggaagactaaagaggagaggaggaatccctgcctttcttgcatgggagggagaaacacattctgtgatcttgaccaaagagccctgtataatcagaaatcagcagaagggggccctgctctaccctcttcttcatgtggttgtgacaatgttcctcttctcctggctagctcacaggagtgctggggatacagtgctctgggtctccatatttaaaagaagtttaaattatcatacaaatgcattgtatttttagtaattggacttgtttgatctcatatcttttgataattactaaaaatctcccttcaaagtgatgaaagattcaaatgaagctagaatttaatttatattaggtctttgagatgaggtttaagtaacattacagtcccattactaggaaaacgggtaaataaactgtgtatagccatgaaatggagtaacgtattaagatctctagctgctgtcatagaacaaaatactttaaagtggtgggtaaaaacgaagttaaggtacaatatatagaaggagaagaagaagaagaaggaggagaaggagaaggagaaggagaaagagaaggagaagaagaagaggaaggaggacgaagaggaagagtaggaggagaagaggaagcggaagagggaggaggaggaaggagaaaggaggaagaaggaagaaggagaagaagaaaaacttgaatcattggtttctacatgcataagtctgaaggacagtccctgaactgagaaatgggctctccttctggggagatgagcaggattggggatagagggtcaagaaagtctattgctttagctgaatttcttaaagcaagaatgcatttatttatgacttgggcagttttttaaaataaaaaaaaggcaatgttgaatatatgaccatctatgagtaaagtaaacctggtttataattttaaattcttcttccctttattctggtcaaaagggaattcattttcccacttttctgagatctgaaaagatgataaccttatcaaatcttgggtctgtgtgatcttaaaggacaagtaaagaataaaaaagttcaagtcaaaattttaaatgaagatattaacaatgaataagtaatttagaatgtgatgttcccaggagaatgaattttcctggattaatctggctaaactttctttgaagtttgtggatgatggcaacaccactgaaaatgaacttgaggctgtgtttaaatacttgctacaactagcttttctgacatctctgtactcactactgacacagtcaatccacttaattagttttgttgatatctccaattcccctatttactttgtgtcctgaaaagtcctttgaaacccaaacagcctactctacctcttcagctccattgggaaaggttacgatcttaggatcatttgaaaggcaaggagggggtagtaaatttccaccatcaagtggaatgtggaaataatctgggaatagatgaatatattgaattaataccaggaaattttcctttcttggatcttcattgtttttgcttgaaaaactgattttttagaatttatagtcgggctaagaattaaatacaaagaatagaatatattctaaagtaaaatatacattatatgtatcctttatgctaagcacagtaccagtatgtggcacacagtatgtgctccataaatatgtattggcttattgcataggaaagagtcaccagaaaatctaaataatgtagaaatttaaaagaaaaaaatcatttatatttctttcagcaaaagttaaatgaatccctactatgcatgccatgctttgggccaggcattagagaagtattatgcacaaaaaattagctgggtgtggtggcaggtgcctgtaaccccagctactcgggaggctgaggcagaatcacttgaacccagggggcagaggttgcagtgagctgggatcatgccactgcactccagcctgggcgacagagcaagactgtctcaagtgaaaaaaaaaaaaaaaaaaaaaaaagagagaagtattatgcaaggcaggtaagatttggttcttgtcactatgagttcatagcatatagaataaaaataaaggacaagtactctctatcacagcaaataatcaaaggttgtctattatttctaaactcaatttcacatcaaacttgctatattattacatctaatctaaaagcatcaatttctgcctgtgaccacccagtcacattttgattattttaacagcatattgagtatgtttttttttttttgagacagagtctcgctctgttggccaggctggagtgcagtggcatgatctcgactcactgcaacctctacctcccaggctgaagcaattctcctgcctcagcctccccagtagctgggattacaggggtgtgccaccatgcccagctaattttttttttgtatttttagtagagacggggtttcaccatgttggccaggctggtcttgaactcctaacctcaggtaatccacccacctcggcctcccaaagtgctgggattatcagcatgagccaccgtgcccggcccatattcagtattaacattaatctcaataaatattccctagtaccaatatgtgctaggcatgaaggacaatacaacaccagttccatattctaagaattggcaagttggagaaatgaaataaacccattcatttacaaacaaaccttacacgacactctgatggacagtagaaaagattaagtggcaaattaccccaatagatcaaattactatggggatctggagtaggaggagatcccttctagttggttggtgtaataaggcattagacaggagatggggctggctaagtcttaatagaccaagcatagggatgtaggacattctaggcaagtgagaaatgacacactactcctaatcaaaagtgcaaagatgagctactctgtatgacatatgcagtggcaaccaggcacggtggctcacgcctgtaatcccagcactttgggaggctgaggtggtggatcacctgaggtcaggagttcaagaccagcctgaccaatatggtgaaaccccgtctctactaaatacaaaaaaattagccaggcgtggtgctgtatgcctgtaatcacagctacttgggaggctgaggcaggagaatgacttgaacccaggaggcagaggttgcaggaagccaagattgcaccattgcactccagcctgggcaacaagagcgaaactttgtcaaaaaaagaaagaaaagaaaagaaaagaggcatgcagtggccgtgagcataaaaggagagaaaactagggaaagaagcactttaatcgtttacggagcttccttcaggcctgtttattaacatattccaaaaaaaatcactgctgtatgtacatatatgccttaagataaagaggagcaactggaaagagatacaagccccaagtacagtatacttccctgacatttgtgtttttaaagagttcatttaaagggcaatggcataatactagtataattcacataatgctagctctgggctttggacttttaaccaaatgttaaaaatgactccttttctcttgtctctgcgtgtgcttctctgactcgcttggcctgtttccattctctttcttttttctctctccatccttcttagtgtaagttaaaaaaaaaaaatcaatgccgcaagttatgtttaaattcagcccacatgacatttccttcgcatttaattgcttccatacaatttatatccgctagtcacgctagaccccagagtattaaacatgctcttttacaaagaagctcttgtcctgtaataacccccataatcaaagttcaggaattatgggtaaggctcagccggccgatggggaaacaaacaggtttttaaattcatccaaagcaggcttcaggcaggaagcaaatcaaagccgtcactctaccaccaggtttgagagcaaaaacaccgcagaggctagctcaaacgagagatactggcatctctgcacatccagcaaatctgatgccagatactttctctttgggctgccgtgaagaaccactaaacaatgccacttaaagacacatggttacattctctctgctttcaaggcagcccattccaaaaagatctagcaatggtctacaaagactgctcttaaaatgcctctaaatgaataaatcattcttctttgttattcagagtagactaagactaaaattatcttggaaaaaaatatatatatacagggtctctttctgttgcccaggccagagtacggtggtgcaatcatagttcactgcaaccctgaattcataggctgaagtgatcccccttgcctcagcctcccaagtagctgggactatagcagtgtgcaccaccacattctgttaatttttaaaacttttttatagagatggggtcttgctctgttgctcaggccggtctcaaactcctggcctcaagccattctcctgcctcagcctcccaaagttctgggattataagtgtgagccacgacaacctaaagttacctcttctattttcctatagacagcttggacaacatgtctggtcttctttcatactaatggacagctacattagtatgtagctctcaaggtctcttataaactcatatttctgggcacttttacaacttatcccattatcttccccacttctcaagaaatcacctccccaaaagttcacctttgaaaaagtacagaagttggctgggtgcagtggctcacgcctgtaatcccagcactttgggaggccgaggtgggtggatcacgaggtcaggagatcgagaccatcctggctaacacggtgaaatcccatctctactaaaaaatacaaaaaaatacccaggcgtggtggtgggcacttgtagtcccagctacttgggaggctgaggcaagagaacgttgtgaacctgggaggtggagcttgcagtgagccgagattgtgccactgcactccagcctgggctacacagcgagactccgtctcaaaaaaaaaaaaaaaaaaaagaaagaaagaaagaaagaaagaaagaaaaagtacagaagtcatacaactacacaggggcactaacatgatttcttggattgcccttattcacgtagcccacttttcacaagaattgtgcctacttttcttacaaaatctctttaagcaacatctctggtcttccccactgtattcagataaatgcctctctaccagtgtcaacaattttaagaaacctttaatttcacccaatctcctctgctcaaaacccatccagatcaagagcaaaacaattgaaactatttatcagatccagacagttgcatcttaaagaactttttgaaagtttctatggcttgcatctctgatggttttcataaaccaatgcttttgtctatagataaaggttagaaccaatatagattggttttgtttttgtttttttgaaacagagtttcgctctgcccccaaagctgaaatgcagtgccccaatcttggctcactgcaacctctgcctccctggttctagtgaatctcctgcctcagcctcctgagtagctgggataacaagcatgtgccaccacacccagctaatttttgtatttttagtagagacagggtttcaccatgttggccaggctggtctcaaactcctggcctcaagtaatccacccacctcggcctcccaaagtgctggtattacaggcatgagccaccgagcccgaccagaatcaatacagtttggatcagagatatcatgctactcttagaaactggcagataataaatatattatttatagccaataaactacttttggtctatcataataaaaaaaacaattcctaagctatcactaaaacatgatgtcatttgtggttgctttattttgtatttactatacagatgtattctttattgtgatggcctagatctggacatattcagagccaaaattattttacgtatcaagtcactggcaaatcaaagaaaaaccaaattatttaaacattcatttaggagctcatatttatattttggaaatgaaacctcatattttaaggcattcgatattatttattatgcagggtccttttatcttgttccacaatataactttttgttttactcttggcagactttactgtcactgtacaaaacagacattgttttaaaaacccatttgtaataagtgtcagtaaatatgatctttcgcttcagctgaagcaactctatggcatcagtttacacctccacacttacttggaagtttataatgcttgttttcagcagctttcacacctagactccatacgatatgtaccagccaccaagatgtttaccagtcctcagaagggcctttcgagaactcttaaaacttaatttgttactgacgctttgcttaaaggacaatgcactttaattagccacaccactggccctttattcacacacatgaggtaagctggacattccaatgcatgtgcaactgggaaatttgagtcctttaatggttttcaacaattaactagggccggccaattgttaggttaaacaaaaagcactgtggcaaaacttgactcacttcactacggctaataattacaaaaggttgtgctggtccatccctcactctacttacctgccaaagtttcaggcaaagtctcaacaattgggatctaacctttaaaatcatttctttaatgttgacactccaaattgtccataatgaccctacattctgctcctactgttaataatcaccaactacttaatagtttattaaaaagttagcaacagacaaatacaaagaacaatgtttccactgtgtaccatacggattacagctcttggacctttgcttgagaacacagctttccaaggcccaaagcacagcccctgtcatcttcatacttcaaatgcagacatgcaagatcaataactcaaggttaacttttcttagatgatagataagatagctaaacttttttaaaagcctaggtaaaaaagagatgttttaaacatacccttggctacagctcaacttttaggtagctgatcctttctccattcctgccttctttccttcaagcttttctacaatatagccttatggttggattttatgttaaaatgtacgaatgtggccgggcgtggtggctcacacctgtaatcccagcactttgggaggccgaggcaggcagatcacctgaggttgggagttcaagaccagcctgatcaacagggagaaaccccgtctctactaaaaatacaaaattagccaggcgtggtggcccatgcctgtaatcccagctaactgggaggctgaggcaggagaattgcttgaacccaggaggcagaggttgcggtgaactgagatcgcatcaatgcactccagcctaggcgacaagcaaaactctgtcacacacacacacacacacacacgaaagtacgaatacccaaatataagttggatgatataattttgtaagagaaatccggccgggcacggtggctcacgcctgtaatcccagcactttgggaggccgaggcgggtggatcacgaggtcaggagatcgagaccatcctggctaacatggtgaaaccccgtctctactaaaaatacaaaaaattagccaggcgtggttgcaagcgcctgtagtaccagctattcgggaggctgaggcaggagaatggccggaacccgggaggcggagcttgcagtgagccgagatcgggccactgcactccagcctgggcgacagagtgagactccgtctcaaaaaaaaaaaaaaaagaaatccttatttgccaaaagttgcatatgcatagggttatatttcacataatacctaaaacaaagacccaaaaagtggggacggttgcactagagaatgcatctgcagaaaacctaagtaattttatgagcagcactcaagtttactgcttcttttatgattcttaatcccgcctactaaattcacatgtctttacaaatcccaaatctgtaacaaggccaccaaatgctcccaaattagcaaaatacagaatagccttttaactacaatacaagctttaactacaaaatgcagccaaactcaaaccagtttgatataattaaacatgttttatttaccttatattgtgaaagggcaaactggcctggcgaacttacttgcattaatctgagtcccctttgccaggtatcaaaatcagttccagtgaatggagaaacaaagataggaaagataaacatttatctgaaactacagttacataatatttggaaccataaattttttactgatactctccaaacataatctgctatttttatggctgtaatttagttatgacgtgtgccagcaataacagtcctgtgcactacaaattgtgacgaagattttaccaagctaggattgcagactgtaattttcctcacagcaagtaatgatcatatcaattagagtcatgtttttacccgagtcttataacttagctcagttagttataaaacactgatttcggaccccattttaataggatgcttaaacaagcaaacgtgtggtatacggcaataaagtgagagacactataggttatatggaaacttgtgggactatgtgggagtgtattcacaccttatctaattgagatctttattttccttatttttctgtctctcaaaactaaattatctgaattatcataagaattagtacctcaggccctgttatgacctatcctgggaaagaaagtgtcctcgtggaaaagtcattcactggacatttttcagtccttatcttccttgacctctgagaaacacaccacagagctaaccattctttcttcttgaaagactttcttccctggcttccacgcaccactctctggatttcctcctacctctctttctcttctctctccatctctttacagggtccatcagtacttcttgtttcttctcattctatctgtaacctctctaagaaatctcaaccacaccaggatttgaataattatacacattccactacaccccattttcctcccttgggcatcttaaagtcacttcaaactcaatatgttaaataatttctccacttcttccaaggctcccagtacggcttgctacaattagaggcgccaccagccctgacattatacagccagcaatctgcaaatcttcctttcctcctgctttactcgctgcctttatccaatccatcaccaaatcctgtcaaatttacctgctaatatcccttcagtgattaaaatgatctcacttcttctcttttccagcaccactaaagcaacttttcagcaattaaatcactcttatgaataccttcattccagagtggcagaatattccagtcactacctgtgcttctggaactgtaatgaaaatttctatccctgtttctccccagtatggctcacatcagacagtcctcgaaaacctgaccagttttgggccagcagagacgtcactttcttgaaccaaaaagtcaaatcccagtctctagatcatggttaccccgataaggcttttcaccctgagacatcccatcaggcattgcatccagttctccagaatttaatccatgtctgtactctacccggtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcagggtggtggtggcagggaggtgggcagtacttttactgttcacttctttttttacttatttttttgagacagagtcttgctctgtggcccagcctggaatgcagtggcctgatctcagctcactccaacttccacctcccaggttcaagcaattctcgtgtctcagcctcccaggtaactgggattacaggtacacgccaccatgcccaactaatttttgtatttttagtagatacggggtttcaccatgttggccaggctgctcttttattttatttatttttttttttttgagacggagtctcgatctgtcgcccaggctggagtgcagtggcgcgatctcagctcactacaagctctgcctcccaggttcgcgccattctcctgcctcggcctcccgagtcactgggactacaggtgcccgccaccacgcctggctaattttttgtatttttagtagagatggggtttcaccgtgttagccaggatggtcttgatctcctgacctcgtgatctgcccgcctcggcctcccaaagtgctgggattacaggtgtgagccaccacgcctggccccaggctgctcttaaactcctgacctcaagtgatccacctgccttggcctcctaaaatgctgggattacaggtatgagccactgctcagcccctacttttcactttataactttcagttctgtttggactttttggtaagagtatgtattatttttataacaaaagccagctttttaaaaacaaaccccaaaataaatgaagtcagtaaaagttacgtttgttcattatagtcacatttaccatttgcttgggttttctcctttctgatgggttatcacacacagttgcagcctcaactatgataggtgcccaggtgcccctttgaaaacctaggctaagaagtgctttgcaagtgcaaactaggagaaagatattcagtattttaatatctgcagaaaagccatcacaaatgaatattttttttttaaataaacaacctagcatgtgtatttttctccagtcaccatgttttgactcctgagtctgtcactggcaatgcttaccagcagactagtcacaaaaaagaacagaaattggatttttgtacagtgttcagaattgagatgtgccacagcaaaattttaaaacaatgagttactgtagaagccacaaagacataaaatatattatgtactagaaaacagattatatacaacctttgtgccatagatttccattttaagactgaacctcttagaatgattattaagttaatgaaaggtatgattaattggttgatgcaaaaattatagctagaaggatggatggaaaaataaaacgataggtaagtaaatagatgaattgattaagagatggatgacagacacattagataggtcgttaagagagataaacagattactgcttctcaaactatctgtggtgaaggaccggggttttatttccaatctgtcaagaccagtatgtagtcctatggtggatggcttatacatagctcacaccacatgtgactcaccacacaagagtgacacacccaaactaccctgttccacaagataattgcattggtcacctacttggatgtcatagcaatgccattttgccataaagtttctaaatactctcaacttctctatctagctcttcataggccagttataattcaactgtacactggcatcagtccatggaccatactttgagtagcactaagctatataatcagttacttcccagcagtatgccatcagttcttattggttgggcatccactctaactggttattgaatttggtagaccatgcatcagccttgtataagaaggataagcagactgattgacagatagaacagtggatgacagataaattagataaccgactagctagctaacaaattagatgggaaccggagagctgttctttgggcaaagaatatttctgaataaagtgttaacaatggtactttctaaatgggggattcagagaagatcagaagaatttcttttccactttcctccctccaacagtgtttgagcatataaaattttaattaaaaagagaaagaaacaattaaatgtccatcagtaggggacatgatgtacatttaaattcctaagcaatggaatactatgtggtccttaaaaaaaacagaggtttatgtacagaagagaaatgaactccaagatatattatactaagtgaaaaaaaaagaaggtgcagaagagtgtgtacagtacactaccattgtgttgtgttgacatggtctaggtggatatctacattgatacatgcatgcttgtactcacaaagagtttctctgaaaaaacaaaaaaactagtgctctggggagggggacaagaggactggaggagagtgaaagaaagactcttcccagtaaatgcctttgtacttattttaggttcttggtatttaaatgtatttattacctctttaaaaacttttttttttaatttaaagaagtcacctgaaaacatgaactttcgagtttagaaaatgcgttcctgagagggaggccactggctgcccaggcagggcatcctcagggaactgggcctaggtgggccctggtgggatgactatggttccagaatctcagttttgtctgtgtctagttgatcagcctcagaggaactgagaaagtaccgaaaaccacaagagagtattctgggaacaagcagactcaaaagctattcatttacaagcagaaatgatagatccagcaggggcggtcccaagtcaagggtagcctggtatcccacttacttgggaagtaaagaccacccacaattttggaactgtacttgctaaattgaatataggatggagctatgaatggaaagataaaaagaccataatttccagactcttttaagtcagcataaaatgcttagttctctaaacaaccaggaagatctcaacataggtgacaatggtggggtcttacgctacagtcacaaaaagctaggactcgtgtatctcaaaactaaggagtgagaaagttgacatttactagcaaaaggtcaatgagcccaccctagctgaggctccagaacctcaatgggatgcataatcatctaccaaccaacacctatcttttaatacaagtcagtacaagctcctcttagtctcaaaaacacaccctcagcatttctgcctctatacctctcttcccatcctgtttttcctggaaggcttgtctgcacacctacctatatctttgccactttttgaaggttccatttatgtctaagcacctttatgagacttctctgaacacccagccttcattcatctccctctccactgcatttagtatctggagctctgacattaatcttgcagtcaaaggggcacagatacaatggaatgccatttccaagcatggaagactcctacgaattccagggtgcaagtttacaatgaaaatggctaaaaataaataatacaggattcctttcgaacacctactatgtgccaggcactgtgctcaagttaagcaatgccaagcaagacaaacatcgttcttcccctgatggaggttacagtgcagtaaaaaaaggaaaaccaaaactaaacaaaacaaaaaaaaaacagtaatatgagagtggagcaatgactgaggaaacagaagggcctatgggaggaggagcagcagcatctaatccagagtgggagctgcaagttggggaaaagttcctgcaggatgtggcatctaagctgatatctgaaggtaatggaggagttaagcaggcaaaaagcagggaaataatgttccaggcaaaggaaacagcttgtgccaagttcctgaggccagaaggagtacagccaatgggagaaactgacagacattctgtacagctgcaaatttcagacctttagtcatattataaatgactgacttaggacacaccttacaaaggcttccggcaaaccaaggtggaaggcagctgatccaggctctaggaccacaggtcgaaaccagctctttggcctggtttgtctgtgttccccttctctctccagattctgtcagctgcctgcggtgataaagccagccacacatttcttcttttaggacatactcacgatgctaacacaaacaggagttcaatgcttttttttaattttttttattttttatttttttgaggcagagttttgctcttgttgcccagtctggagtgcaatggcatgatctcggctcactgcaacctctgcctcccggattcaagcgattctcctgcctcggcctcctgagtagctggaattacaggcaagcgccaccatgcccggctaattttgtatttttaatagagacagggtttctccatgttggtcaggctggtttcgaactcctgacctcaggtgatctgcctgcctcagcctcccaaagtgctgggattacaggcgtgagccaccgcgcccagccaagttcaaatgatttctagttgtaaattagctgaactggctaaagatcttttagatggcacaaaggcaaggccctggaagatcatcgcccctttcaccgtctaaatcccgaacaataacaggaatgaacttgcaaaggtggtgtttgtgccaggcactgcgctcagcactttataaatgtttcttcatttcacttcttctcctaatagcactgagcaagtgaacatcatcttttcctttcttatttattttctgctatgcctagacggaacattaaataaaagctagaagtccaggaaagagagcatgcaagtaaagaataagctgaaagaaatccatatgaccgccgggtgcagtggctcacgcctgtaatcccaacactttgggatgccatggtgggcagatcacctgaggtcaggagtttgagaccagcctggccaacatggtgaaactctgtctctattaaaaatacaaaaattagccaggcgaggtggcagatgcctataatcccagctagtcgggaggctgaggcaggagaatcagctgaacctgggagcaggaggctgccgtgagctgagatggcgccattgcactccagcctaggcgacaagagtgaaacgctatctcaaaaaaaaaaaaaaaaaaaaattctgtagagacagaatctcgctatgttgcccaggcttgtctcaaactcttggcctcaagcaatcctcccacctcggccccccaaagtgataagattagtggtgtgagtcaccttggtggaaatcttgatgagaataaaatataaatagacaatggaggtgtactacccatttctggtatatttgggttttcttccatcatctctatctcaccatcaatgacagttccaaatagcataacccagactcagttcagaagcaaactctaaaaatccatccaccactccaccaccacagttatgcgatcatcaaggatacataattacaagacctaattatgggccacacaattggcatgagacagcatggcataaggacaggaacacaggttttggaatcacagagttctaatcccatctctgccactcacctgttatatgaccccaggacatttatttaacctcactgagcctcagtttacttaacagtaaaatgaggtaataatatatacctgttcatgggatcactgtgagggttaaaagaaataatatacgtaaaagcatctagggttatgaaaaagttccatatgcatataattctgttgctatctctctgggatgtgctgactctcactctctgccttgtctggcatacagcaggtaatcaacaaatgtcaattacctttcctgctcatctcccccttctccatttcctcttcctcccctatcccacacacaaaaacagctcaatttgtagtgacaatctagattccaaacaataaaaactagacacttctcagatggagttgggtatcctctgcccaaaatgctgaagcaaaagggcacttacagtgagcattcctatttaggtttctcttaaccaggaaagttgactctaactccttattttaaacttaaaactgactttcaactccagatccaggttgtccctcaaagctacagctgtaatccagagtcaaaaatcacctgacccctattgccaaggtttctgcttctgattttggctgggtaaataggctatgtgtgttgggagagagagaagagaaagcaagaactaacttgtactgaacatctcctgtgcgccagatgctttaaatatgctcatctttcaaaccacaatgcaacaggtatcactctcttcacattacagacaactgagttagcagacagtattttttgaatgacaaagggcccttatgaaaacagctacattatactgtcattcaaagataaacagaaaaaacaagccagagtcagaacaatttttaagtaaatacgttcagataaaaaaggacttgaaaaacttacctcctacaaaccacttcttaagaagttactcaagcatgtactgcagcaaaatgagggataaaccaaaaaaataggaagacacgggaaaaggaaacagcacttccagccatggaaagaagttccaggatgacagctctgtagtgggcttagtgaataaccagttcagaacggcacagaacgagaaaggaatctcggcatacagcttagacaaagaagactcgataggttagacaagattgagagcctagaaaacttttgagatcataataatggcaaataatgcatgaacacattaaaaggcaatcagaaatactagggaaaaaatttaagaaagtcatggtccaaatatgaaaaaactaaaaggtaacacaaatttaaacaactgatgaagagtgagaaaacaaaaaatcccatttgactttggggctagatatctcatcctttgattggcccaggaatcctaaaaccagacccacagtgcaagtctaaaatccaatcctgacacacaaggcaatgaatcatttcacagaattgtagtcatgtaaatgttgcctatggattttcttttttttttttttttttgagatggagtctggctctgttgcccaggctggagtgcagtggcgcgatctcggctcactgcaagctccgcctccggggttcacaccattctcctgcctcagcctcctgagtaggactacaggcgcccgctgccacgcccggctaatttttttttttttttttttttttgtattttttagtagagacggggtttcacggtgttagccaggatgatctccatctcctgacctcgtgatccgcccgcctcggcctcccaaagtgctgggattacaggcatgagccactgcgcccggccttatggattttcaactttaagaatcatatacgaataagatggtcaactttggggcaaagcacaaatacaggttatgggttcagggctttggcaatgtggaaagcaacattgtcaaaaagtgaacagtagaactggtagcaatccaaacattactgacatacagcataaggaatcaagaaatactatccaaagttgaaaaagccaggtgtggtggctcacacctgtaatcctagtgctttaggaagccggtgggaggattgcttgaggccaggagtttgagaccagcctgggcagcataggaaaccctgtctctacaaaaaagttaaataaattagccaaatatggtggtgcaaacctatagtcgtagttactcaggaagctgaggtgggaggatcacttgagcccaggaatttgaggcttcagtgagctatgattcccactgcactctagcctgggtgacagagacagaccccatctcaaaaaaaaaaaaaaaaaaaaaaaaaaaaaaaaaaaaaaaaaaaaaaagatgattatttaaaaaaggtgacctaacagacaaatttaaaatattataaacatcaaacctgggagagaaaaaagaaaactagcttaaagagctacattctcactttcatatcaggtgctaaaagttgataaatcaaaacatggtggtaaaagcacattacttaagcttaagaaggtaacaatctaagaattaaatatgggtacagttgaaaaaaattaaaagttgccctctgtgagccttgaggaggtgaaggaaaccattgtttttcaacaaatgtcctcctgtatattggatttgttaccaagtgcatggatcacttggacaaaaataattttctgtcacacatttgagaaaaggcaaaacactaaaattgtcactaaaaatgagacgtggcagccaaatgttatagtctgaattgtatttaagaggaggataaaatcttttttcttataaaatcacgttactcaaatgaaagatttttacaagaatgtttgcgaaagagtaaagatgggaaattctactgaagctagataactttcttctttataattccccattttctggtttatgtatagaaagcatgtattctatttataatcagagaccttttaaaaatttaatgtgatcagtattcagtcagtgtgccaggttgcccaacaccccagcctgattcatgagattgagaggacagcaggaataatgaatgaacacagtggttttcagaggctaggtgttttaacattcaatctgcttcactgttactctaatttttaaaaactttttatttagagatggggtgggggtggtagtggctgcaggtgggcaccaccatgccctagtcattgttactctaaaggaatatctgaataccacaggacacctgaacaccacaggaaagctgtgaatgctcaggaaaggtgccttcaggaggttgcagaaagtgattacatcatatacctaggaataatcttacctgagaaaatgacaaaaggcttttttaaagcttcttagatgtccaggctctgtttcccattaagttcattgtttagctaaggaagtgacatgggggaaaggtgtcggtggggaaaaaggaaaactgttgcctaagtagacagcaacagattagaggtccagtccagggtccaccattaaataaccacatgactttcccaaattcctatcatcacccttccgtggcctcaattttctagtcaaaaactaaactaaacaaaattgacccttgtcattctaaaatcctttgatttccaacttataaagctctcaactcccaacagagtcaagaaaaagattcttcttctggctgggcatggtagctcatgcctgtaatccaagcactttgggaggccaaggcaggagaatcacttgagtacaggagtttgagactagcctaggcaacatagtgaaaccccatctctaccccagccaaaaataaaaaaattaaaaaaaaaaatgtatctgctagcctcagccctatttcatagatggcaagtaaagtaataaacagacataatgaaaagtaactccaagtgagtcaccatcatttttcaagcttctacttaatccactgaaatacactgccttttgaggctgtgtaacaaagtgtatgacatttacctaattccaactttaaacaaaactctacaagaaattcagagaactcttggcagattgcttatccttaaagacaatagtcactgacaaattcttaacctctcttagtcacttggccaaaatacttccagggatagcatcagagcaggccagcctactacttacacatttttttcagctgtcattttcattgactacccaaagtgaaatgaagatgcactctgctttggattggagagtggttgtggttggggggatgggcagagagatcacagcaactttctctaaatccaaggctaacttccacttttgcccttgttcacaggcagttctgagctactccaatcattcaaaacacaatgtataaaggaatttttttgttttgcttttgtttcagggtctttttcgtctagttttcctcagatattaggcaagcctagctcctatttcatatttttaataatcacagttatactgatcatataccatacgtatgtgtgtatatattcataaacacagtttagaaatcatgtagggctggggccaggcgtggtggctcacacctgtaattccagcactttgggaggccgaggcgggcagatcacgaggtcaggagatagagaccatcctggctaacatgttgaaaccccgtctctactaaaaaaaatacaaaaaagtagccgggcttggtggcgggtgcctgtagtcccagctactcgggaggctgaggcaggagaatggcgtgaacccggtaggcggagcttgcagtgagcctagatcgcgccactgcactccagcctgggcgacagagcgagactccatctaaaaaagaaagaaagaaagaaagaaagaaatcatgtagggctgggcatggtggctcaagcctgtaatcccagcactttaggaggccgaggcaggcagatcacttgaggtcaggagttcaagaccagcctggccaacatggtgaaacctcgtctctactaaaaatacaaaaattagccaggcgtggtggtgggtgcctgtaatcccagctactcaggaggctgaggcagaagaattgcttgaacccagggggcggaggttgcagtgagccgagattgtgccactgcactccagcgtgggcgacagagtgagactttgtctcaaaaacaaaaacaaacaacaaacaacaacaacaaaagtcatgttattacatcatattcttgactccaccagctacttagaagtcaaaggactgagcacatgtccaaactatcactcaataacccagagaagaccagctgtggcataaatgaccatcaagtctgtttcagaatctcagcattacaccaatctcagaaacaacaaaagaactccttggacaagatatcaacagccttgagatggggaagtaataagaattggtcactggtatgaatcaatgggctcactatagtaaacttcatccatcactgtgtattcattcttagggctctctcatagcaatcagagcatcaaatattagtgccaaagaaaggcttgattaaacttttaaaattgtacatagtgtcttcacttttgcactaaggctactctactaaagaaatatgggctttaaaatgaagtctaagtcaagttcttaggagaggagtttccctcactggcagtgcaggcaatcctgaaacaagtggttaggctggcacaacctccatctttgatagcctgaccctatgacctcaatggaacatttcaagttccagcctggtttctcctgaggaatgtagttatcttagggtaccacaattgaaacaacctcctctagtgtttgagaatatattttcctgtggggtgtaatttgaaaatttcaactaatgtaaaattcatgacatcaaaaagctggaacaatgtgaaaggaagaagagtgacaaagcaggcttgtgatttgatggtattttaggttaacaagtttaatgtaataaaactcctaacaatttccacacgattgatttgtccagcccacaactactccaccacacagttgctaataacatcactgtgctgtgtggtcattatgtcacccagctgggagcactatggcctaccaaccactgttcacttttccagcttgcttttcccaagaagatagaaactgcagaccacctacttcaccaaaagtccctctgttccccaagcttcacagcttttctctgatttatctcggtgtcacatcccaaagggcctggctctggactatctgacttagagtggccaaggaagggactaagggtctgtgcccaagagttggcttcagtcctgcagattcaaggcaaagtcacctgtgtgttttatggtggatgaacttcaccactgcttctgatccctgcttctgatcccttacaattccaacactcagagactcactccctgcttccagctctccatatctgtgaaataaccgtggaaggacacgcaccatctctctctttctctctctctctctctctctctctctcacacacacacacacacacacacgaacacacgcgcgcgttgggcactgtgacttggtgccttcttcggctccaggctgacttacttgaggaagtacctctggccagtggccgtgaaggtcatctcccagcccgggggcagtggcagctcgtcggtcacgtcgtaggactgctggcggaggtgcgcgtgctgctgcgcggggctacccgcagcacccgcgccggtgcccagctgcagggacgcgggcgacgagtgcgagcggacatgctgggcacccccagccagtcgaggccccgggtggccgcccgacgagtcggtgctggactggcgcgagtgcgagcccgaatcaggctccttaaagaaagactccggcaggatcttcttccgccacgagctaggcttcggattcatgacagagttgaagagggcttcgaggtctgtgtctaggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaaggaaaggtcgcacgattccaggacaggcagccccccgaaagaagttcagcccgagccaactccaccacgtctcgactccggaagcccgaggagcctggagccctggagtggtgccggatgagcgcgcgagctccagcgggcactacctgggcgggcagcgaagctgagcctgagcgcgcggcggccgccgtcccgcccgaacttgccgtcgggcctgggtcgctcgggtgagtcccgagattgcggagctggagccgaggcttggctgacaaatcccgacccgactctgtgcctggcagtctaagggcttcggctctcacatcccccgagctggcctaaggcgctagtgctgggcgaaaaggaggcgcaggagaagcagacagcgcggccgcagcagctcccggactgtcccataaacaaagtttggagcaaactcccacccccaggaaagaggcgggcccgaaagttgagctgttgaattatgtatgacctcctagtccctagccggccagcccccgctcgcccctcctcttcctcctcctcctcctcccacctcggctccagaaaaccctgggcgtgatgggtactttactgggtaagaggagacgggtgccccccacccactcctcccggccgcgcggacctctcccgctcagacctgcatctgcattcctttgagtttaccacggacttggggcgggatcaaagggaaagtggcctgagcctgtttcatcaaggggttgtggaccgaaaccaaggccgggggtggcggagggcacgcggatgaggggctcaggcctaggaagggccggtcctggacaccgcgccctcccctgcagccaggcgccgaggcctgcagcacccggagcgccgcactgacccgcgattctgcccgaaggccggcccgggtgcgccccggcgcggggagacaccaacaaggccagcttttccacgagaggctgcttagctcttgtgaccatatttggtctggcgaggaggcatcttggctgcctggctctcaattgtctgctagagcacagacggtgcccagaaagtgcctctgtcactggagatgcggcttcgccaacgggtgggttgtaaacaaacaactttcaaaccattcatcaatccttaatttcctctacgggggtgactcaggccactagagattgagaagaaaaagctgggtgttggaagagaagagcaattgcacccccctcccccgcaacatccgtgagggttgtgggaggattggaatgtccctgccgccctccggggagcctggagccgggatggaacccgagcaggtggctggaagtagagagggtgcgccagtgacccgaaaaaagccacccaccttcccaccaactagatctgggcgagggatggagaccccctgcctctagctaagggaagaaggtcaagtctggcgaaacagctgcgggaagtaggaggaggccttgcccttcagagcagctcaatttcttttctctctggttgcctctccactgaggggaaagggtggggggagatggcgaggtaagccaaattccaggaagcccctactccaccccatttgattcaaataggagtttattaagtaaatcaaacgagacaatgtaaagcacttcgcacagcaccgggctggttacgtaagtgtttgttaaataaaagagaactgtatgttcttcaagttcacgtattgtgccttaatttttttttttttttttttgagtgacgtctccctcttgtcccccaggcttgagtgcaatagctccatctcagctcactgcaacctccgcctcccgggttcaaacgattctcctgcctctgcctcccaagtagctaggattaagacgcctgccaccacgcccagctaatttttgtattttttaaaagcaaaaatggggtttcaccatgttggccaggctggtctcaaatcctgacttcaggtgatccgcccgcctcaggctcccaaagtgctgggattacaggcatgagccaccgcgcccagcctgccttaatatttttacagggtaaaataaagtcgaagttaaaatctggagctgccttggaggagaaaagtttaaggaaaagacaaggccactcatagttttgcctcggaaaaggtagaattttggggccactccctgaatggctgcatccatatccaaaacagaaccaccaaagtgagccacttcccctgttatctgtacttggaggtggctccaattccagactcctcatagactggaagaaattagggccatcttagactaaggcaggcatacacgtatcatccttttttttttttttttgagatggagtctcactctattgcccaggatggagtgcagtggcatgatcgcggctcactgcaacctctgcctccctggttcaagcaattatcctgcctcagcctcccgagtagctgggattctgtgcagcaagtcctctgcccataggactggcaaaaggaaaggggaaactagcacaggtcactccttggaaagtagaatctttgcaagctactctcagaagccatcacagttgcaacaacaggggaaataagctatcgaacaagaggaagtgactggaacctaatgatactaattcagaagtcacaaggctgacttgatgattaaaagatgaaaacttgaggccagccctactctaggaaagtcctcactcccgaagaaaggtgagaatcagggttggaattagatgggcagtgagaatctgggttggaactggatgggcaaggatgcagtcttcgtttctttccaagcttcaagaaatagatagtgcaacagataaagtagatgtatgaaacggaaattgcccttaacacaggataactgaaaaactcccagttcccaaatagcatataagatgtaatagtgaataattcaaaagatttgctgttgtcccagccattccaacaacagcttcagattaaataacatttacagatgtcttgtatgtatcaggtactgcccgtaagaggcagcacagtggataagtgtataatttctggaacaaaacagctgagtcacttcagacaagacatttaagctctctattcttgggtttcctcctttgtaaattagggacaataacagtacccaccccacaggattctaggtgaaaacacatacacattttatttgttgatatttgatttagaacacaatatttgaagctggctctatctgctacattatgcaagtagcttagcattcctaagtcacagtttactcatttacaaattggaaataatattgtggtagtctctctgctgcgttgctgcctttcaatggcccagcctcatgttatttatacctttacgtagccccttccacttaatctggactgggccagtgatttgccttaaccaggaaaatgtggcagtgaagttgtgccacttccctgcctttcccatcccatcccctaggaaggtatggaagcttccactttgtacttttaggagacctgagccactaagtaagaagtccagttaccctgttggataaaccacatggagaaggaaaggccctgagatacttggagagagggaaaagtccagctgcccagcacctgagctgagcccagcctcagccaaccccaccggctgactgcaaacacatcagtgaccaccagtaagaccagcagagctgcacagccaagcccagcccagattgcagaattgtgagcaaataaaatggatattgctttaagccacaaaatattgaaatgttttttaaatgtagaatgtgcattctaagaataaaaagttgcaaataaagtctttttttttttctcagacagggtttcactttgttgcccaggctagagtgcaatggcttgatctcagctcactgcacccttcacctcccaggttcaagtgattcttgtgcctcagcctcccgagtagttgggactacagacgtgcaccaccacgcctggctaatttttgtatttttttagtagaggcaggatttcatcatgttggccaggctgatcttgaactcctggtctcaagtgatccgcccaccttggcctcccaaagtgctaggattataggcttgagccaccatgcccggccacaaataaagtttttttttttttttttgagacggagtcttactctgtcacctaggctggagtgcagtggcacaatatcagctcaccacaacctccacctcccgggttcaagcgattctcctgcctcagcctcctgagtagctgggattacaggcacccaccaccacacctggctaatttttgtatatttagtagagacggggtttcaccatttgggccaggctggtcttgaactcctgaccttgtgatccacccgcctccacctcccaaagtgctgggattacaggcgtgagccacctcgcccggccaaataaagctcttaacacaaagcctgcttaacataataaagcactcaacaaatatggctgttttgtttcatggagacctaaagataaggaaactggatcgatgagttagaaagtattttgtccaaatatatacaatgaaaccatgttaaaaaaaaacaaaaaaccctgagattcagcccagggttgtaactctagagcagagtgcattctccagactgcatcctgtgtgagccaggagttgctccctggtattgccattttaaatcgtgtgatactttttgtctgactatctcataaagaaactccacagcttttataagataatcagttgagagcacactcctgctgatagatatgtaaatctttccatttgcaaacactttccaacaaagtccatgcctgcttctaaatcctccccacaacacacttcctactgaagcttctcctgagtcatccctttctcttccctctgttcacatccaatcagcggcaaatgctattgattctttcttctagtgtcccccaaaatccatgcttcccttcccactctcacgacaggaccttatctcaaaatgcttgaagtggtctcctaactggtttctctgcctccagtctctgttttctggtctccttcttttatgatgtcattacccagctcagaagttttttttaacaactgttcacaagtatatgagtcaaagctatcaatctggcactaaaggtttcccaacacactgccatcttcatagctttctgaccctggttcttacatgatccagtaataaagtatctttctcccacttcagccaggctctgacccaagcatatttggcctaattcgttaatacacctacctgaactttgctatttgaattctgctcaaaattgtcctccaaactccattgccaggcgttcagtaatctctcccttcttcctaaattctccttgttcttgtctttttcactctttccacatgtaatcaaacataacactgccttacattgttttgtcttgttttttcagacagagtcttactctgtcacccaggctggagtgcaatggcgcaatctcagctcactgcaacatccgcctcccgggttcaagcgattctcctgtcttagcctctcaagtagctgggattacaggtgcccgccatcacgccagctaatttttgtatttttagtagagatggggtttcaccatgttggccaggctgatctcaggtgatccacccacctcagcctcccaaagtgctgggattacagatgtgagccaccaggcccggcatatattgtattgtaaaattcgcctcagaaatctcttgcctccccaactggactgtaaatagctgcagggctagaagcagcttaaatttctttatgaggtcaggcgcagtggctcacgtctgtaatcctagcactttgggaggccaaggcaggcagatcacctgaggtcaggagtttgagacaagcctggccaacatggtgaaaccccgtttctactaaaaatacaaaaattagccatgcgtggtggcgcgtgcctgtaatcccagctactcgggaggctgaggcaggagaattgcttgaacccaggaggcggaggctgcagtgagccgagatcatgccattgcactccagcctgtgcaacagagcgagactccatcttaaaaaaaaattttcttatgaaaccgctcctaagaaggccacaattccttgttgagagcatagtgacctttagatgattttgcccattcctctttcagcacccattagtgtactgtgcagtttgttagataatttctcaccattcactacgatttcagctacttctggactcaactctttaacaagattgcaagctctctgagaacaagtctaagagaacttcactttctttttgtttctcccatgcctaacaaagtgttctccatgcaggagtgttctgtacatgcctaacccagtggattttgcccctgctattcatctgccatttttgcctcaggaaagcttcagctgcttctcagccctacctccgggttgctgacttggtctgaatgactgatttcagcaaaggtgtatggttagaaacttggtggggtggctaagttagaggactgtggtcccagaagcccttggggcagaacctgccctgacttgctgaaccagtatggagaaaattcccagagccagggttgggtcaccattagcaactgaagaggagcaaaacagacaaggaccttgaatagataaaggtttgaataatgaagagtccagaaaactattgaataaggttcaacatgaggataagagttgaccagttccttgacaaatcaaacgtgatacttgtgttttcagaatttaccatatcccaagtgtttaacacagtgtccagcatatagcaaatatgcaaatacctaaataaaaaataattggtgctgccactcatttttgcatttactcttttgttgccgtgtttcactttggtgttcttaataaatgcatcactggcatgatgataaggaagataattttgatgataatgatgatggaaggcactatcttttttttttttttttgagacggagtttcgctcctgttgcccaggctgtagtgcaatggcgccatctcggctcaccgcaacctccacctcccgggttcaaacgattctcctgcctcagcctcccgagtagctgggattacaggcatgcgccatcatgcctggctgattttgtattttagtagagatggggtttctctatgttggtcaggctggtctcgaactcctgatctcaggtgtgatccacccaccttggcttctcaaagtgctgggattataggagtgaaccaccgcgcccggccagaaggcactatcttttgtctgatgttatctgttgctttagtaatgcatttgggctagagaaaaaaggaatttttgatatttaatcttaacttcagtaccttatgtaagttatttatcctttagtatttttgctatcattttggggcaagggactggaggaaatatttttaaatgggaaatattaagtaatagatattttcctagaaaataaaaatacacttttgaaaaggctcaacaatatacagtatggtttagaagttaatgatcagggcatattgcagagttgctcattgcaccatgatctataataacgggaaattagaaatttcctttctttctttttttttttttttttgagacagagtcttgctctgtcaccaggctggagtgcagtggcgtcatcttggctcactgcaaactccgcctcccgggttcaagccattctcctgcctcagcctcccaagtagctgggattacaggagcccaccatcatgcccagttaatttttgtatttttggtagagatgggggtttcaccattttggccaggatgttctcgatctcctgacctcatgatctgcccgcctcagcctcccaaagtgctgggattacaggcatgagttactgcgcccggctcagaaatttcctaaatatttaagaagagaatggttaagtatatctaacagcttaacatatgcaatgaagattctgatagttatttgaaagtgtttatgaagacaatgtgacaacctgaaaaatgtttttaagaatttttataattttaatgagaaaaattacgaaacaaagatctgtgaatactatcattataactttgttcaaaaacatggaaaaatgaataaaaagatgctaaaattatattaaaaactatgtagaaataaaaagataaatatttctctttgtgtgcttatatctgtatatatgtgtaacatgataacactgaatcatcactctcagaagtacaaaccatattattagtattattttgggtgtgatgagagaactaattagcagtgtttggggtggggggaatttcaaggtgctcaatattatccatccattcaacaaatacggtacatatttttttaatatccattgtgttcaagggcagaagtgatctttcaagctgagcttggaagagtttgccacctgattaaaacatttattgtttgacaatttcactcaactcctccctttacccaaataagtcacagatctggttacactagctgttcaagccactgctcttccttgtcttatttttcttggtgacaagagtcaagtatatatgggctctactattatctctctgtctcagcattgtccagacacaagttaggacacttttcatgcctggtcaaaaaagttaatttgtggtttggagccaaggagaagagagccctccaaaccaaaacaaggtggagagaggacctgagtataagaaagccagtgcctgtgggcaccagttcaattcacacatgcttaaaaatggctaaattttctttaaaaatatatatttctagataatcttagataagagagtagattaattctcatacagcatctgccacacaatacatcctaatttgaccatatgattgaagacatctcaatctagttatgatcattaaaagctgttagtatttcaactatggcaataataataaatcatatttatataatattttacagactacaaaacaacttcacatgtacagtcacacacgaatctcatagtaaccctgtgagaatgggcagatacaccttactagaactattttacagataagaaaaccaaggtttagaaaagtttatgtcttgccaaaggccattgatttataacaagagcaccaggactcaacccctccagtatctctccggctttcaaattatatttcttctgtagtttcctaacagaatcagactcttaattacttcctcctctgtgagcatacactattttgtcttttcctttaaagagagggaaagagaggctgtttttaaaggcatttttcctccactgacttacagtatcatttcacaaatgttttgtcatctaatggccatacgatgtacagaggctcctaaaatgtatatcgaagcttagttgtctcctccctctcattaaataaataaaaacttaaatgtgttggaggtactgaaaattcaatcaaaccctgattattggagcgcttgtgtgtattaaagaatccttctgtgatgtgaatcattatttctaattaatatgaaacattgggtctctactttttaagagttgtattcctaaaattattttgtaaattgtttagttggaacttgatgcattttgttataggaaaaaacaaatcttactaatggggccgggcgcagtggctcacgcctgtaatcccagcactttgggaggctgagggggggtggatcatgaggtcaggagattgagatcatcctggctaacatggtgaaatcccgtctctactaaaaaatacaaaaaattagcaggacgtggtggtgggcacctgtagtcccagctacttgggaggctgaggcaggagaatggcgtgaacccaggaggtggagcttgcagtgagctcagatcgtgccactgcattccagcctgggcgacagagcaagactccatctcaaaaaaaaaaaaaaaaattatgaaaaaaatcttactaatgatgtctaggcaacccagcatcccactatgctccaaattcgtggaagccccaagtctcaatctgtcctgatactctggttgagtccttctagacttggaggtatcacatgaagctcttaacagccaaacaatgttaggactacatgggcactaacccagtggctgcacgttgtagttctactgagtcatcatctcccattttttgtgaatgattttagacaagagaaatttcacagttcattctgtatatttcctcctacctgccatctgtttcaccagagggaaaagaatctgaagatatttgaaaagagaattaaaacatcttgataagataccaaagaaaaagtgaatgagaagacccttgagatctacctgtcaccttcctaaaaaattctgtaactgctgtctgtgaaagtgtcagtcaaggcttatccctcgtatagattgtacagcctggagttcaacactagagatgataataattcagagtctggttagttggcattaaatctataaaaataatactggttaatggcttttagggaaagaagcctctagatttttaggtatccacttctctcataagtgtaaaagactgcctttttccaattaaatatgacaacttgtatctttcagcaaggaaggatgaagttctttgtctaatcctgatttaaatacattatcatgtgaaaaatctctctcttctatctgccctaaggatagatttttggggctgtcaagagctgactcttggccaggcgtgtaatctgagcactttgggaggctaaggcgggcagatcacctgaggtcaggagtttgagaccagcctggccgacatggtgaaaccccgtctctactaaaaatacaaaaaattagccgggcatggtggcgggcgcctgtaatcccagctgcttaggaggttgaggcaggagaatcacttgggcctgggaggcagtggttgcagtaagccgagatggcgccactgcactccaggcagggcaacagagcaagattgtgtctcaaaaaaaacaacaaaaaactgagtcttcattgcttcacatcacaactcaaggtctaaaatttgaagtgttggatcccattcttagaaaaaaataagtagttaccaatggggaacgggggatcccttttaataaattctctgacaacactgaggcaatagttacattgatttctccacataagctccctcagacactccactcaccaaaaagtcaccttggtttcaaattttttttcattagtgtttgaacaccccacaaaaagactgccatgaagtctcattctgtttggctggaaagacaagcataatctagtggtaaatttcaaccttgctaatgaatcctccctttgactttctggtcagctttgctaaatgagtaactttacagcctccaacacaagccattggcgtgggagagacttggccttttttacccaaaatcaccaaaggcctttgtacagagtccaagtttttacctttagtcagtcttttctatttcaccactgccaggggttttgtttttgtggaacaagaaataagaaccccacatatacaaggttatacacatatacaagaacccccacatatacaagaacaatacacatatacaatatacccccacatatacaagaaccccacatcttacaagggaacctcctttgtgaccacataatcttaccaaggaaaatcccaaatgagttcctgcaccagtcccattactctgcagcctgggcagcagtgggtagctagtctgggaacaagagtgctcttctctttctgttatcacatacccatctgaactcaaaagggcttcacttaaataaggaatttccattcttctagaaatgtcatttcacttgaacttgcacttctatcgtttaaagaagacaaacaaggtccccagtactagagtccagtgggagggaaaaggaaaggaaacattaaaagtaatccagggaaactctgaaggtaaacttgcccttctgaaaacagacaaaggtagacctctgcttccctgctacaatttctagaaaaagcaaaaccatcctgaaacccctctggagagttcaattacagcaaactggccaacaatgatatctatatttatacagtaaatgtgtttaatatcatgttcaaactaccaatcaagaaaaaaaaatgaataaaaatagatgattacctggaaaatcactagtaagcgtggcttatgggtcagttcagatccaccaggaagcagatgccaagataagagtcagatgagcagagatgtattggggaaaatgcctgcaaaagttaaagaggagaaagaaggtgagtaagctaggagagtattcagattgcaatgcacgtctgtcaatagtgaaggaggagggtaggaaggagggctggccaggaaaagtctcagccccgaccaggccagtgcttccaaggcaacagctgacccttaggggcgtcccgcgatgggcagcaatggctcagctctagcacccagctgggctcaacccttggtagacaagaaaccacggccttcagtgtgaacagtgcaagcaattttacaggtgtggctggtgaagatgtcagctcactgctgtcctcacagtgactctattgaagaaagtcctaagcatttacccacatggtttttatcacagtgcgtacagactgcatcacacaggctgacttctccatttttcagggcgcagttcatccaaggttgctgtgggcctttcctcctcaggggaatcttagaagagggcgattaatgagacaaaccacagcccctaccgctgtagttggtcttgaggccataactgctatttatcctcttcctccttcactatctactctaagttttccatatccagtgctatcccctctacaggtgctgatgtccaacctggtggcggacccctgtagtcccagctactcgggaggatgaggcaggagaatggcgtgaacccgggaggcggagcttgcagtgagccgagatcatgccaccgcactccagcctgggcgacagagcgagactccgtctcaaaaaaaaaaaaaaagaaaagaaaagaaaagaaaatgaggcaagaggtgaagtgacttgtccagggcctgatgagtagacagaaacagataaaaaaaagaagtcaattctctttttttactcactgcccaagagcttcctctctccagtcaccggactcctgctgcaacaggaccagctaaggaatatcgatccagtctgggaaaaaagttatcacactgcttaggcagatacacattctgaagaaaaggagaaagtgcaaatcctcttgcaggagtcctttcaactcagtttgtggctggttatgtaaatgaggaggccgtgcaagagaatggggtcatgagctgcctggggattaagcatgacaacgccgtctgtcctgggaagaaatgatactttgcacttgtataatacctttcatccatccagcaataataaataagacttcgtactttcagccaaatattgcaaaaacttaacaaatatttaactcatgaatcctcagaaccaccaagaagggaacacttttgaaaggaagaaagaaaacagcttcatcctcatgatccactggggaatctaaggtcagaagaaacgggtctacacctggcctctcaacaccgctggcaggactcctgacaagcaaggacattcctgtgtatgaacactgtctaaggtgacctagacacaggatttcgaaaagagcagaggcaaaccagaaaaacccctgcttgtacattcagcccagggaatctacgaagctttcaaaagaggtttggttctgagtctataagggttctttgaagcctcttcaaaagtttctgctggcatatcccctaacagaatgttttaaaaccatgtactccttcacaaaattttcagttgacatctaaaatattacatcgtatgtttgaataattgcaaaggttgtaattttcatgatgttattaatatagatattttaaaataaactattgcaatttgctttgaaatatccaattgaatctaaatccaagcgatttgatgcccaccacatccattttaaaagtctacaaatgagctcttttttaacagtcagatgttttttccctaagctcctatttttattctacttctacatatttatcttaatgtactatattattatgcttaaaggtcttattattcattttttatattatacttctctgcattaaaaatgtttgtaatttttttatttcctgtgttattatgaagctgatttgtaataacaaataggtccagcatgtaactgctcaacacaatcaaagcctatttctttctcacagaatagtcctgggtgaggtccccaggtaagcaaagtgctccccaccacatagtgatgaggggaacctaattcctttcatcttatggcttccctgtctcctagaaaaagggtttagcttgtgggcctatttttgtgtgctctgggagctaagaatagatttacatctttaaaaggctacaaaaaaacaaaaaacaaacaaacaaacaaacaaaaaaacaaccagtagaatgtgcatcagaggctttatgtggccgcaaagcccaaaatagttactgtctggctttttaccaaagttcgccaaccgctttcctagagcctcattctcaattcgtgtagctggtagaaggagaaaaagcaaagaaaagcacagaagatatttcatgggaccaggcctggaagtgacatacatgatttccactcacaagttgttgccagaacaattacatgactacatgttacagcaaggatgatggggaaaagtaggctacctacgtacccgaaggagggtggaacaaattgtgggagccaggtaatagtttctaccatggccaagcctctaaagagtcaaaaacttattattattacaattattattggtgtaaaaatatcaaagtgacccacatacatgttaaattaatataaataacttaaaaagaaacattttattagagatatagttcttaataagatgaatgggactattttcaattagttcatgtatctcaacttagagtactaattttatgcctactttttatttttataaatgtttatataaaaaatctttctataaaaagatatataagaggatggatggtaatggaagaagttttttcctttttttttttttttttaagaaatagggtctcacttggtcacccaaactggagtacagtgataccatcacagctcattccagccttggactcctgggctcaagcgatcctcccgcctcagcctctgaggagctgggactacaggcgcatgctaccacatccagctgtttttagaacttttattgttaacttttcctatctacttaatgaaaaagaaaaagtatgaattgctaaaaatgaagtctggcagctggcatataatgttactttgtgttaataggagtaaaaataaatgttttaaaagaagaaataggccaggtacagtggctcacgcctgtaatcccagcactttgggaggctgaggtaggatgattacttgagcccaggagtttgaggccagtctgggcaatatagtgagaccctgtctctgttttttaaaaaaaataaaaattaaaaatcagttaaaagaagaaataagttgagaattgactatcactggaaaaatattcaatgacgtaatttcatagaagtaggttttaattactttattcaatgatgtgtacgttatgtaaaaaaatcaggtgaatttttaatccatgaattctatcttgtgtagtagagaatgtagtaacctcagaaaacattccatttaaatttaaaactatttttatgttacccccaattttagagggatcattcacactgcattctacaaaaggtgaatgacactcggaaaggcatgtgaaaatttggtatgtgcttggtatggatgcatcactcagccctgaatcagcatcagtatctggcactgcatctgctgctcagagacattttttccagctaatggcccctcctaggttttgagaattttgttttgaaaataagtgaaaacaaaaagcagactccatttttagcatttgaagtgttctttactttgctgtcatgggtctctctctccagagttatgcattctttgacaataaccagagaggccagggatgggaggagccaatacttcaaatggtccctttgtttccccctcccctattccccagaggtctcaagattttggaggtaccaaggtaagagtcaagacaggtaaggagaagataggctgttttgcaatggaaggtgaaaataaagaatttggctggatatgatggctcatgtttataatcccagcgcactttggaaggctgaggtgagaatattgcttaagcctaggcaacatagtagaagaccggcctaggcaacatagtaagacctcgtctctacaaaaaaaaaaaaattagctgggcatggtaggcgcaggcctgtagtcccagctactggggaggctgaggtggaaggattgcttgagctgaggaagccaaggcagcagtgagccatgatcatgccactgcacttgagcctgggtgacagagcaagacactgtctctctctctctgtctctgtctctctctctctctctgtctgtctttctctatctctttctctctcacacacacacacgtaaaaattgtaggcccaggcatggtggctcatgcctgtaatctcagaactttgggaggccgaggcaggcggatcacgaggtccggagttcgagaccagcctggccaatatggtgaaaccccatctctactaaacatacaaaaattagccaggcatggtggtgcgtgcctgtagtcccagctacttgggaagctggggaagaagaatcacttgaacctgggaggcggaggttgcagtgagccgtgatcataccactgcactccatcttgggtgacagagagagattccatctaaaaaaaaaaaagaatttgtatgaaacttaaggctagccttcagagagaacaagccaaaattgattctcttaagaatctgtactgatacacctccttagaaagttacttaacttagcttgaagattgttcttttagggagatttctgtatactgttcctttggttaagcaaaagaggtgtttagctaagaccacacgtccatgttttctagtctagctcttggtgctagttttgacattcaaagctcgctgggccttctaactcttatattctatggtttaaacattctatggtatgtttgaatgtttttctgaaggttagagagaaccaatggcatttttaaacaaaagggctaagtggaaaagcagtgtttctggaagataaatccaacaaaattgtgatggaaaaaatgtggggagaccagttggtaaactatcacagctgtccttgagacgctagtccggggtttggactaagatggtagaaggaaaccagaatcatatatcttacttcttttgattttccccttttttcttgttagaagaactccagttttatttgggtatctacacatcagggaagatgacactatccctggctcagggccatatcttgattaatctaagccaatcatgacaaccctatactccttaccagtgactgattgtttttaaaatgagcatgttttggccaatgagatgtgagacgtctgctgaaggactttagggaaatatttctttattcatattacacatacaagagaaactactgtctgcttcatctgaacattggagtatctagggtgatgcctagatctctggcagccattttgtaaccaagagggcagctggcctgaagatgaagatgagtgaacagagagacaggaatgatcagggtctttgatcatgtttttcagccacccagcctcctgatttttgaacttgtatcaccaggagaataatggtaccgaagaaatttggacagccagaagaaagagcttagaggaagacaatgaaactaccagtgttaaaagtgtctagtgtgaggagcagtggtgtttctaggtaaaatggccagaacctaattaaaaacatggaagtggagtgaaggagtaatattagaactcaaaatttctttctttttttttttgagatggagtcttgctctgttgcccaggctggagtgcagtggcacgatctcggctcactgcaagctctgcctcccaggggtcacgccattctcctgcctcagcctcccgagtagctgagactacaggcgtccaccaccatgcccagctaattttttgtgtttttagtagagatgaggtttcaccatggtctcgatctcctgacctcgtgatcggcccgtctcagcttcccaaagtgctgggattacaggcgtgagccaccgcgcccagcctagaactcaaaatttcaatgcagaagttatttgcagaaactggtatctactggtaaggaattatggtggaacattgaccatgtcctaatgtccacacctaatacctccaggcggaatccagcaccagggggaaaaaatcacaaattaccatctgcttaaagaaaaaggagagagatgtccttgtcaacctatttttaagataaagatctacttacatttcagaacaggaattctgatttccccaaaaagagaagggaaagagacaaaaaaaatcttcagtattgattctttatcagcaaaatttagtaagaatctttccagataatttaaggattttagcatctctggttttaaaggggagtcctcatcatctcttcaacaatatgaaaatccagtctcatttttattgaatcagggcaaaatccttgtcagactagattctttgtgttttttttgcggaaagaaggaacaagaaaaaaaatcctttagggtagatgacctgtctgatgatggtaagcacagcttcagtacatcaggttttttgcagggtgcttttacatactgtttccagtccttacagcaaccctgcctggcagatattgttagttcagatttatgatgagaaaaacagaggattagagagactaagtaatttgcccatgcgcacagttagctgggattctaaaccgggtctgcctattttcaaggtacatgccctgcttgccacacaccactgactttttaagggagacaataaagggagagcagggaaagcaatgggattggcagtgtgcatgcttttcaatagtgaaagtcagcaaaagagtcagagaaggagcaaccagaaagattatgttaaatcctgaagtctgtcaccaccatccaccctcctcagtcaactagataaccttgagactcttttttttttttttagacggagtttccctcttgttactcaggctggagcaatggggcgatcttggctcactgcaacgtctgcctcccaggttcaagcaattctcctgcctcagcctctggagtagctggcattacaggcatgcgccaccacgcccagctaattttgtatttttaggagagacggggtgtcaccatgttggtcaggctgatcttgaactccttacctcaggtcatccgcccatctcagcctcccaaagtgctgggattacaggagtgagccaccgcacccggctgagactcttaaatggagagggcacagtccctaggcaacttgatactcccctacaggagcaatttcatatttgctaaaaatgctttcctcccaaatacatttatgaaagaaaccactgtatatacaaacagctctggcacgtaatattaaagtagtgatcccaaaattctgttgttggctctattgtcttcccattatccagtgtcttggtcaaactcatccattcccatgacttggactacctttcatacactgacaagctccaaatgtatatctacagagcactttccagtattagacaccacttaatgtctcctacggtgttcccacaggaacctaaaactcaatctatctaatgtatcacgcctgtaatcccagcactttgggaggccgagacgggtggatcaactgaggtcagcagtttgagaccagccaggccaacatggtgaaaccccatctctactaaaaatacaaaatcaacgcggtgtcgtgacgcgtgcctataatcccagttactcgggaggctgaggcaggagaatcgcttgaatctgggaagcagaggttgcagtgagacaagattgcaccactgctctccagcctgggtgacacagcgatctcagctcactgctacctctgcctcccaagttgaagcaattctcctgcctcagcctcctagtagttggtactacaggtgcctgccaccacacccagctaatttttgtatttttttttttttagtggagacggggtttcaccatgttggccaggctgatctcgaactcctgatctcagctgatccacctgttttggcctctcaaagtgcggggattacaggcgggggccaccacacccagccagttgatgttatattcacagttgatgttatattcaacctaacatcattggcaaatgtaatggtgcatttcttgagataatgagatggatttctaatctagtctaacttttcatctcaactatttcaaaattatcttgaagctctaattcacagaacacttatacacagtgattataattactgtgcagctagagtggatgctaataggagggtacctaagcaacaaatagacagaagtggccaacttatgtaaagacaggtttgaggccatcccttagaactgtggagtcccaagtcagcctcccttcatctggaacacaaactcccctggcagttctgcaggccctttttccataatggccagtagtacattctgcttaattgtcatgttctgttaatcacaggaagcagtgagtggcagacattactcaccatgctcactacctactctgcagggaccacagtctatgccattagatcccacactctggagccctttgatccacagcctgaggcaagtcgccaagccctaccctgccactgtgaaggcttacagtatcaatttctttatgtaccagctgccagtgacacacaagtttggaatttctccctcatctaccaaattctatctccgttatcagaaatggatttacagatttttcatgaaactaataaatcttaaacatcaggaccctcaattcatgggaactttccaaggtcctggaggaattatattaacgtgttcacaagtatttttttttttttttttttgatggagtttcgctcttgttgcccaagctggagtgcaatggtgcagtggcgtgatctcggctcactgcaacctccgcctcccagttcaaatgattttcctgcctctgcctccctagtatctgggattacaggcatgcatcaccatgcccggctaattttttgtatttttagtagaaacggggtttcaccatgttagccaggctggtcttgaactcctgacctccggtgatctgcccgccttggcctcccaaagtgctgggattacaggcatgagccactgcgcctggcccaaggccatatgtttttgtaaaatttataaaagtagaatatttcaactgcaatcagtaaaggttgttgttttcctctctgacttctgttgggttggcgatgagcattttggaataccaagttaaggaagagttaagaatggatacatatgtttgaatttagtgagatatatttatgtgctttataatttccacatcagaaaattaggacaatactgcctaccttttagggttattttgagcatgatataacaatatggcagccaacatattcaccaatgaatatgtcctaacttcctgaaattctagcctcttttctctgtactgttcagcctttccagataagttggctcccagtaaaatagtaaacacaagaggaatttacctagtttagctggactgatcctagcacagtatagataagttagataaatatcattatgcccatgattatccctgccctcaaagcatcacctctgttgggagttcagggaaagagaacagatggaatggtgggaaaaaaaaaaaaagtaaaatgccaacacagaaaggtaaaaccaggccttaattcctgagagggagccaaaggttggcaaagaaaagtgatgagctcctagggatgatgataaaaacctctcaggtggaataatgatatacttttatgaggaaatggacagacttaactgtcctacactgccttccatctgcaagcctgccactagcatttcccaattttccagggctgatttctcaagctttgattggaagccgatggcgtcctagagagacaggcaacatttctttgccccaagaaattcagaactgtattctgacatcatggtaaatctctgctggtctctccttctacttgtgtgaatgtgggaaagttacttaacacttccctttcctcagctattcaataaggtgatgacaataacctcctcatagataaggtgaccacacaatttactgtccaagagaggtacttttgagaatgaagggggcactactaatcattatattgtgacaggtataaatggagactgttctggcaaatcaagatgtatgattaccttacatgtagagctgttgtgaatatcaaatgagggtatatatgtaaaatacttatctggggccgggcacagtggctcatgcctgtaatcccagcactttgggaggccgaggcaggcagatcacctgaggtcaggagttcaagaccagcctggccaacatggcgaaaccctgtctctactcaaaatacaaaaattagcccagtgtggtggcaggcacctgtaatctcagctacttgggaggctgaggcagaagaattgcttgaacccaggaggcggaggttgcagtgagccaacgttgtgccactgcactccagcctgggtgacaaagtgagaccctgtctcaaaaaaaaccaaccaaccaaacaaacaaacaaacaaaaaaacgtatttgggaggctgagatgggaggatcacttgaggccaggagtttgagaccagcctaggcaacatagagagacaccatttctaaaaaaaaaaaaatgaaaaaagaattaaccaggcttaatgccatgcacctgtagtcccagctactcaggaggctggggtaggaggattgcttgagcccaggagtttggggctgcagtgagctatgaccatgccacttcactccagcctgaatgacagagcaaggccctgtctctgaaataaaaattgactcttatttttctttttaacatatgtattatgtaatattggtggctgtattatataaaaccagttacatacttacaaacattttggttgctttcagttttatttttagtgaaagatggatacatttatcaaacaatgctgcaaagaacatacatctgtagtaccttgtacatacatcttgtacttacagctttcaatacaagaagtagaattgctgggtcaaaacaatttgatacatctaaataaactgccatccaaagagactgaatgtgtggtgtaagagttttcccacattttctctaacttcgggttgtcaatcaagatcaactttttaaataaatactcagaagtagatggctgattatatgttatatttttcactttttgaagaacctccatgctgttttccacagtggctgtaccattttacatttccaccaacagtgaacaagtgttccaattttaccacatcctcactaacacctcttatcttttgtctttttggtaacagtcatttcaacaggagtgaggtgatacctcattgtggttttgatttatattttcctgatgattagtggaattgaacattttttaatatacctattggccatctgtatgtctttatttggagaaatgtatattcaaatccttagtccattttaaaatcaggtgttagtttttttgctgttgagttgtgggagttctttatttcagaaattttatccaatagaattgacatcaggatctcaaagaaatatttgcactcctatgttcattgcagcactattcataatagccaagatgtggaaacaatttaaatgttcatcaatagatgaatggataagaaaatgtggtgtatatacacaatagaatattattcagctttaaaacagaaggaaatcctgaatatgtgacaacatagatgaaacttaaggacattatgctaagtaaaataagccagccacagaaggacaaatattgcatgattccacttacaggaaaaacctaaaatagtcaaatttatagaagcagaaggaggggaagagaaaacagggagttgctaaagtttcagttatgtgagatgaataagttctagaaagctgctgtacaacattgtgcctatagttgacaatatggtattgcatacttaaaaatctgttaagagggtagctctcatgttaaatgttcttactacagtaaaataaaaattaaatttaaatgtaaaaaaagatcaactttctgacttgctgtcaggaagtaagtaccgtagactgatccaccatcttccaccctaacatttaagacccctgggagtcaggtctcttagtgattagtggttaaacaaagaccaaccatcattggtatctgcagacttcagtctggctttgtaactttggctgcaccatagagacacttattagttttaaggttaattccccaggatagtgaaaactgtcatccctaaagtcagatgtttttgaaggcagataataatagtaagtgaatgtattaaattgataaaagcaaaaaaaatgtattgaggtcttttgactttaaaattggccatgggaaccaaggactgcaaagaatttctttgttaagaggctggtttttctactttggtgaagttggagttggttgctttgagtgctccagaatgaacaaacctctctggtctagaagagaagcatactcctctacaaaagcctattttccccagcttggactgcatcattcaacatacaatatcgaatagactgtaaataagcctaaatttcaaatgattgcaatcttaaccctgttattagtgtttctgtctctcttctcttcactaccaaggtttcaaaaagtatagtctacttttacattatctgcctccttacttagtccttatccttcaagctattgtattaaactgcagggagacagagatctccccaccctaggtagaaagaggataatttagtataaaagtggattgaagtagatttatttgtctgcagaaaccgccatggaaagctgtaagaagccaccttcagtcttcccaacttgactttggccttgaacctcctgtggctctggcaggatgaagcatggaccctgggggatgtgcaatagggtaaaatagaaaagacaaaaagacaaagatggggaaaggaattcccaggtgcccatctggggatagctctatattagctgaaatgcaatgagctgttactatgaaatgcttttcattatcttctgcaaagagtgcgactgccaagtattatttctgagtgcttacatacatcttttcatttcatcctcacaaccaccctatgaaagggatactattattcttttgattttacaagtgaggaaagtaaggctcagaaaggtcaatgagtttgtccaaggtcacatggctagtaaatattgaggaatgatattaatgtatccctattagtgagattgttagttttcataatgggtttacacttaaaggcctttctagattccagaggtgtaaccacagaataacttcttgcagttgccctgcctcacttaggatatttaggctgggtacaggggctcatgcctgtaatcccagcactttgggaggtcaaagcggatggatcacttgaggtcaggaattctataccagcctggccaacatggtgaaaccccgtctctactaaaaatacaaaaattagctgggcatggtggcatgcgcctgtaatcccagctactcaggaggctgaggcaggagaatctctggaacctgggaggtggaggttgcagtgagctgagattgcaccactgcacttcagcctgggcaatagaacaagattctgcctttaaaaaaaaagaaaaagaaaaagaacaggatagatttagacaagagccaggggtctggcaaagagtagataagcgagtggaaaaccaatgggaagggggtgtgacagccaagggagaagcatgacagcatgcaatgtccaagagagacgagctggggtggagattatggatggctcctgttactgtagtttgagtggcactgtgggagcaagagccattgacgacctcctcaaggctcttcattagtttatcttcttcacccatttctttaaaaaaaattgcactccagttattcattgttgttttgttcataatagcaaaagttgaaaacactttaaacatccatcactaaggaattgtttaaataagttaagtaaatggtatattactatttgtgtttgaaaaatatggggggtgtagaaataataaaggtatttactggtacatgcatagattatcattttttaacattttttatttagaaaatatatatatatataatcacataagtagagacagggtctcgctatgttgcccagggtggtcttgagttcctgggttcaaatgcccttccgcctcagcctcccaaagtgttaggattacaggcgtcagccaccacgcccagctgatctttgaaaagatataaatgatgatatcgcctacagggaagggaaatgtatggctgggacacgggtgggaaggaaactctttataaataccatttcaagattctaaaaattgaactattcattactttaaaagtagataaaataaaaacaaatcagtgtgtctggtagcacaaaccttgactctcctcttctcagtctatgtgatccttctgataggtctgtctcatatctcattattctttttttttttttcctttttgagacagtgtctcactctgtcacccaggctggagtgccatggggcgatcctggctcactgcaggcccaacctcctggggtcaagaaatcctcccacctcagccactcgagtagctgggactatagttgtgtgctatcacacccagctaatttttgtattttttgtagagacggggtttcaccatgttgctcaggctgctttcgaactcctgggctcgagcaatcctcccacctctgcctttcaaattgttgggattacaggtgtgctccactgtacccagccttctttctttttttattcccacctacattctgatggtgtcacctttccaacttcagttcagatctctgcttaaaagacattttccactgatggtcccttgagctccacaaaattaatatattcaaattttaatttatcatttgctcccatccctatctgtttcatcatttgtagccactaatatacttgaaatgtaatcatctcctccatcaatttactgtttcgctattcccatatccccttttagaggacatgctctcttataatcctgggaggaattgccttacaaaccactaatttagctgttcaaccagaactctcaggacaaagaatgggcacctgatcgaagatggactatttagagtctctctcccgagagtttggaactgaaacatagaagacctgagttagtctctgctgggtccaagaaagctggggctgggataactataagatcaccacgcccaacagagaaaaccagtctggagaaaatgaggctgatgtgctgagagaagcagaaatgacagaccatatgccatcacccagaacaggtagaatccagttccctagggttcagtctactctggctgaggcccagtgaaacttcttgctctgggctctgagagatactcctgtatccttccttagctagcttgattaggtttctggtcactgcaaccaaaaccttcttcaggctcttctcctggtaaatagagccctggaaatccaagcccaacattttggaatcattttgtaatcctccccttttaccaccagtcatcactaagtccagatgatattgcttcttgattcatcaattcctcctcattaaagttctcattacttctcatggacttaactgatcatttttcttcactctcacttcctctagtacatactcaacatcattagcagagtagacgttatcattttaaattccagtttgtaaatttacttcaaactaaatggcatatgtaatataacatatggtatttgttatatcatgggacaaaatcaacttggggtacatttaaatgttaaaattatagtgaatttatttgacagactgcttagtccacaatgcaaaaaaatgctattgtcacttcttgcttaaagatctttttttgatctcatgttccctacatgataaggctaagtttctttgcatgttgtttcaattaccatgccttcagccacaaataacagaaagccctatctcagattggcttaaacaataggaaacatttattatctcaaatagcaagaggttaccaagtagagcacctttatgtttggctgatgcagtgccccacaatgacataaatgactccagtttgttctatctctgctctaccattcttggagtattcgagcttggttttcaggctagatccattcatggtcacaacatagtagccctatttccaggcatcacatctcagacatcaacatcagtggaagaaaagagactgactattccttaggtatcctttaagagtgaagaaaccagctagggatggtggccagtagctgaagtccaaggctataaggaggctgaggctggaggatcccttgaggccaggagttcaaggctatggtcataccaatgaatacctatgaatagccactgcactccagcctgggcaatacatacagcaagacaccatctctctctatatatatataaataatagagtgaagaaatctttcccaaagacctcctaggcaacttttctctatgtctcattgactacactgggttacacacacacacctaaaccaatgctaggaaatgaaatagattattatgattggtgtagactatcaggatttacccctgagctaggaatagggtcatattccctgagggatagataaatactaagcaggcactaaaaagaggctgccatgcatagcatacaagacagcataatctagccccttctccattctcctggggtctcttctctcattgctatccaccccgcttctgaactatgggagttctgagtacatctgttgcacattttatggctttgcaaatgctgtgtgtagctctacaatgcctttctttgctttacctatatactctgtcgtccaactacctcaccctaaggtcagttaccttttgccctcaggaatatgtttgaaggagccacagactgcaggaactgaaaataagcattacttttattgttgcctctaggccccaggttcactactgacagtctcccccaggccttccctctcattgagttctaccagcagcaattatcttacccatattaccttttacctactgcaattttagagcttacctacttcaactgcaattttagagcctgggttcccctagcaacttgccccgcgtgcttatctgtaagatagctgcatcatagcctctagaactaactggaactcactactgagttgctctcctggtgaatcctgccctgactctgatcatttcttcatcctgtagccagagcaatctctcatttcttctttaataatgtttttagtttaaatctatttgaaaagagatggcatgcctgacattcaacctgtaatattagaggcaaaaagattttttaaaaagtgtaccattaggtatatccagacttttacaaccaattacagtagctaataatataccaggttcacatgttaactcatttaatccttataacaatcatatgagaaaggtactatttactatcatttccattttgcagatgatgatattgagtaattcgctcaagatcacacagctaggtagtgctgcttttaggtgtgacccagtacgttctcacctatggtggccatgggaaagacagcttccgctagaagaaaggagagggaaaagtaaaaaggactttgtcttgcaatttgggtaccagctcagccatggtaaaataaagtaccacacagacccctaaggtccccaattccaggccttagctcctggatggcatttgtagatctgccctaggtctgaaggaaacccactgtcctgaagggagatacaaagacctgacaggattcacctgcttactaaagggtccttgtgccttgaataaacatcagcagtagccaggcagttgttgccatggacctggggctcatggtggtggtggacatggggagagacttctgcttgaggaaaagagagacttctgcttgaggaaaggagagggaagaataaaaaggtcattttcttgcaatgtgggtaccagcttagccacagtaaaataaagtactaaatagattcctaaagttcccaattccaggtcctagcttccagacagcatatctagacccaccctgggccagaagggaacccactgccctgaagggaaagacgcaagcctggcaggattcatcacctcttgactaatgagcccttaggccttgagtaaacataagcaatagccaggcaataattgacacaggccttgggcgagacccagtactttactggctttaggtgtgatccagcacagtcccagcaatggtggccacaagagtgcttgtgtcacccctcccccaactccaggcagctcagaatggagagagagattctatttgagggaaagtagggaagagaatagaagactgcctggtaatccagggaatcctcccagttcttatctaagactaccaaggcagtacttctacaagtctgcaagagtcatggcattactgggattggggtgcctcctaatgcatatatggcttcagtgaccaaagacttagatcacaacactcaatttcctttgagtacttggaaaacattctcgagaaatgtgagtgcaaacaagcccacattgtgaagattagaataaatacctaactcctcagtacccagacattgatgaatattcacaagcatcaagaccatccagaaaaacaggacctcaccaaatgaactaaataagaaaccagtaaccaatcccagagtgaccgagacatgcgaccttttagagacagaattcaaaatagctgttttgaggaagctcaatgaacttcaaggtaacacagaaaaggaattcaaaatcctattagataagtttaacagaaattgaaataaattttaaaaatcaaggagaaattctggagctgaaaaattcagttgagaaactgaagaatgcatcagagtctctctacagcagaatggcttaaacagaagaaagtattagtgagcttcaagacaggctatttgaaaatacatgggcatgcttggagtggtggctcatgcctataatcctagctctttgagaggctgaggtgggtggatcacttgagctcaggagttcaagactagcctcggcaacatggtgaaaccccatctctccaaaaccacaaaaattagtggggcatggtggtttgcacctgtagtcccagctacttgggaggctgaggcaggaagattgcttgagcccaggaggtggaggttgcagtgagctgagatcatgccactgcactccaacctgggtgacagagtgagaacctatctcaaaaaaaaaaaaaaaaaaaaagcaaagaagacagaaaaaaaaaaagaataacccaaataagaccatatcaagacatttaataatcaaactcccagaggtcaaggataaagaaaggatcctaaaagcagcaaaagaaaagaaacaagtaacacataaaggagttccagtgggaaccttgcaggccgggaaacaatggcatgacatatttaaagtactgaaagaaaaaaatgtttatcttagaaaactatatcctgtggaaatatccttcaaacatgaaggagaaataaagactttcccagataaatgaaagctgagggattttgtcaataacagatctgtcctataagaaatgctaaagggaattaatgagcaataagaaatcatctgaacatacaaaactcactggtaatagtgagtacacagacaaatacagaatactataacactacaattgtggtgtataaactactcatatcttgagtaggaatactaaagagatgaacctatcaaaaataacaactacaataacttttaagatatagatagtataataagatagaaacagaaaccacaaggagttaaaagtaagaggcagggacgaagtaaaagtatagtttttattagttttcccttggcttgttagtttctttgtttttgcaatcagagttaagttaccagttttaaataacgggttataagacattatttgcaagcctcatggtaaccttgaattaaaaaacccacaacagatatgcaaaaaataaaaagcaagaaattaaaacatactaccagagaaaatcattttcacaaaaaggaagacagaaaagaaggaaggaagggagataaaaccaaaaaacaacaaactggcaggagtaagtccccacttaccaacgataacattgactgtaaatgaactaaactctccaatcaaaagacatagagtggctgaatggatataaaaacaagacccaattatctgttacctacacaaaacacactttacctataaagacacacatagactaaaaataaagggatggaaaaagacattccatgaaaatggaaatgaaaaaaagcaggagtagctatacttagacaaaatagatttcaagtcaaaaactataaaaataggcaaagaaggtcattatataatgataaaggcatcaattcagcaagataatacaacaattataaatatatacatgcactcaacaatggagcatccagatatataaagcaaatattattagagctaaagatagagatagatcctaatataataatagctagagactttagcaccctgcttttagcattgcacagatcatccagacagcaaatcaacaaagaaacatcagacttaatctgcactatacaccaaatggacctagtagatgtttacaaaacatttcatccaatggctacagaattaacattcttctcctcaagacatggatcattctcaagaacagaccatttattaggctatgaaaacactgcaatcattttaagtattttctctgttcacaatggaataaaacgagaaatcaataacataaggaactttgaaaactatataaacacatggaaattaaacaatgctcctgaatgaccagtgaatcaatgaagaaatcaagaaacaactttaaagatttcttgaaattctggcatggcattgattgagaaaaaatttaaaatttaaaaatttttttttaaaagaaaaaatttcttgaaacaaataaaaataaaaacacaacataccaaaacctatgggatacagcaaaagcagtagtaagaggaaagtttatagcaataaatgcctacatcaagaaagaggaaaaacttcaaataaacaacttaatgatgcatcttaaaaaaccagaaaggcaagagcaaaccaaacccaaaattagtagaataaataataaagatcagagcagaaataaacaaaaatgaaatttaaaaaacaatacaaaggaacaataaaatgaaaatttcttttttttttgaaaagataaaatcaacaaacctttagccagactaggaaaaaaagaaagaagactcagataaataaaatcagagatgaaaaaggagacattataactgataccacagaagttcaaaagatcattagagactactatgagcaactatatgccaataaattggaaaacctagaagaaatgaataaattcctagaaacacacaacctaccaagatggaaccacaaagagattcaaaacctgaagagaccaaaacaatgagatcaaagctataataaaaagtatgccagcaaaaaaaaacctgggactctatggcttcgctgctaatttttacaaaacatttaaaaagaaggccgggcgcggtggctcatgtctgtaatcccagcactttgggaggccgaggtgggtggatcacgaggtcaggagatcgagaccatcctggccaacacggtgaaaccccgtctctactaaaaatacaaaaaattagccgggcgtggtggcaggcgcctgtagtcccagctcctcgggaggctgaggcaggagaatggcgtgaacctgggaggcagagcttgcagtgagccgagatcacgccactgcactccagcctgggtgacagagcgagactccgtctcaaaaaaaaaaatcatttaaaaagaaaagctaatactaatgctactcacactattccaaaaaatagaggaggagtgaattcttccaaactcattctatgaagtcagtattaccctgataccaacaccagacaaagacacattaaaaaaaaaaagagagaaagaaaaggaaaaaggaacaaaaagaaaaaagaacactataggccaatatctctgatgaacattgatgcaaaaatccttaacaaaatactagcaaactgaattcaacaacacattaaaaaataattcaccatgaccaagtggaatttatctcaaggatgcaagaatgattcaacatatgcaaatcaaagaatgtgatacatcatatcaacagaagataaaaaccatctgatcatttcaattaatcttgaaatactatttgataaaattcaatatcccttcatgatgaaaaccctcaacaaactgggtaatgtgttgaggaatatacctcaacacgataaaagccatatatgacagacccacagttagtgtcacacttaatgggaaaaaactgaaagcctttcctctaagattgggaatacaacaaggatgcccactttcaccactgtttgtttgtttgtttgtttgtttgtttgtttgagacggagtttcattcttgtcgcccaggctggagtgcaatggtgcgatctcagctcactgcaacctctgcctctcaggttcaagcgattttcctgcctcagcctcccaagtagctgggattacaggtgccggccactgcacacagctaatttttgtattttttagtagagatgggtttttaccatgttggccaggctggtcgtgaactcctgacctcaggtaatccacccacctagtcctcccaaagtgctgggattacaggtgtaagccaccgtgcatggctccactttcaccactgttattcaacatactactggaagttctagctagagcaatcataaaagagaaaaacataaagggcatacaaattggaaaagaagaagtcaaattatccttgtttgcagatgatatgatcttatatttggaaaaacctaaagactcccccaaaaaacaattagaactaataaacaaatttcataaagttgcaggatacaaagccaacatacaaaaatcagtagcatttctatatgccaacagcaaacaatctgaaaaagaaatcaagataatatcccatgtacaataactataaataaaattagatacctggaaataagcttaacgaaagaagtggtgatctataccatgacaactataaaacattgatgaaaaaagttgaaaaggacacaaataaatggaaatatattccatgttcatggattggaagaatcagtattgttaatatgcctacactacgcaaagcaatctacagatttaatgaaagctttatcaaaataccaatgacattcttcacataaacagaaaaaaaaatcctaaaatgtatatggaaccaccaaagacctagaatagtcatagccattttgagcaaaaagaacaaaactggaggaatcacattacttgacttcaaattatatcacagagctatagtaactgaaacagcaaggtactggcataaaacagaaacacagaccaatgggacagaatagagaacccagaatagagaacccagaaatcaatctatacatctacagtgaattcattttcaacaaaggtaccaagaacatacactggggaaaggacagtctcttcaacaaataatgatgggaaaactggatatccatctgtggaataataaaactagattactatctcttgatatacaaaatatcttgtattttgtatatcttgatatataaaaatcaaatataaatggattaaagacttaaatataagacctgaaactataaaacaactaaaagaaaacataggagaaactctccagaacattggtctgggccaagcaaccaaagcaaaaatggacaaattgaatcaaatcaagttaaaaagcttttggacagcaaaggatattatcaatgaagtgaaaagacaaagcgaagtgggagaaaatatttgcacaccatccatctaacaagggattaataggctgggcgcggtggctcacgcctataatcccagcactttgggaggccgaggcaggtggatcacgaggtcaggggttcgagaccagcctgaccaacatggggaaaccccgtctctactaaaaatacaaaaaaattagctgggcatggtggcaggcgcctgtaatctcagctactcaggaggctgaggaaggagaattgcttgaacccgggaggcagaggttgcagtgagccgagatcgcatcactgcactccagcctgggcgacagagcaagagcaagagcaagactctgtctcaaaaacaaaacaaacaaacaacaacaaaaaaacaagggattaataaatagaagatacataactcaatggggaaaaataaaataataatccaattgaaatgggcaaaatatctaaacagacatttctcaaaagaagacatacaaatggcaagcaggtgcctgaaaaggtgttcaacattattgatcatcagagaaatgcaaaccaaaacaaaatgggatatcatctgaccccagttaaagtggcttgtatccaaaagacaggcaataatgcaaggatgcagagaaacgagaaccctcatacactgttggtgagaatgtaaattaatacagcaattatgcagaacagtatggtggtgtctcaaaaaactaaaaaactaccatatgatccagcaatcccactgctaggtatacacgcaaaataaagaaaatcattatatcgaagagatgtctgcactccatgttcactgcagcactattcataatagccaagatttggaatcaacctaagtgttcatcagtagatgaatggatagagaaaatatggtacacatacacaatagagtactgttcagccataaaaagaataagatcctgtcatttgcaacacagatggaattggaacacattatggtaagtgaagtaagccaggcacagaaggacaaactttgcatgttctcaatcatttgtgaaaggtaaaaattaaaacacttgaatgcatggagatagagtgtagaatgatgattaccagaggctgggaaagatagtgaaggtggatgcaagtggggatggttaatacatacaaaaatataggtagatagaaagaataagatctagtatttgacagcacaacagggtgactacagccaacaataatttattgtacattttaaaataagaatataatctgaatgtttatatcacagagaaatgataaaagcttgaggtgatgataccccatttaccctgatgggattattgttcattgtatgcctgtatgaaaatatttcacccacttcataaatatatgtacctactatgtactcataaaaattaaaaataaaaaaattattaaagggatgggcgcagtggcttacacctgtaatcacagcactttgggaggccaaggcaggcgaatcacttgaggtcaggagtttgagatcagcctggccaacatggtgaaaccccatctctactaaaaatacaaaaattctctgggcatgatggcaggcgcctgtaatcccaggtacctgggaggctggggcaggagaattgcttgaactcaggaggcagaggctgcagtgagccgagatcataccactgcactccagcctgggcgacagagcaaggctccatctcaaaaaaaaaaaaaacaagaaaagaaaagaaaaaaatatatatatatatatttaaaaaagatcacacaggaggccggacgcagtggctcatgcctgtaatcccagcactttgggaggccgaggcgggtggatcatgaggtcaggagattgagactatcctggctaacatggtgaaatcccgtctctaccaaaaaatacaaaaaattagccgggtgtggtggtgggcgcctgtagtcccagctactcgggaggctgaggcaggagaatggcgtgaacccaggaggtggagcttgcagtgagccgagatcacgccactgcactccagcctgggcgacagagcgagactctgtctcaaaaaaaaaaaaaaaaaaaaaaatcacacagataggaagtggcagtgtctttaaggaaactggtgtagtgaagagatttgggctttggactcaaacaaatgcaggccgaatttatcaccttcctccaaatctgtcccttttctgtgttcctcaacacagagactggcaacaccaagcacttagatgcccaaggttgtacctggaaagacatgcttggctcctccctttgctttgagatttcctaaatgcttaatatatgtgggaactacactacaaccaacctttacaggaattctcttttagttcttatgatgaccttacaaggtaagtactaatagtatccccattttgaccccatttttactcccatcttgcaaattagaaaagtgatatttaaaaaggttataacaatgccctgtacaatatcacaaacaattcaatgtccaatggttctgctatcaggaaacaacagagcaaagattcctggtggttacagaatctattctcatgatcattgctgcataccagtccctgaaggtcttttgcttctgcttcccaaatacctcagcattgaccttgactcaggctgctatgggttctcccctgtggcagcctctcaacgagcatggcgtttttgaattcattctccatcccatagttagaatgtgatcacatcactcccctactaaatcctcacaggctttacaatatctgaactactcagtcttcagtttacccctccccagtcaccttgggcacactcccacaacagttccagtcaccctgaaagcctcccaaaacatcaggcttaagattactcttctgtccatcctctaacattttccccttcacctggctaactcctagctcattcctgatgtcttagcacggaggtcactttttctaacagctttcctcagtgctacaagttgagttgatggtgctccagtaagaaccacagcacatgatagatgttttagtttatttttatattgctataaaggaatacctaaggctggggaatttataaataaaagaggtttaattggctcacaattcaacaggctgtacaagcatggcaccaacatctgctcagcttctggtgagggcctcaggaagcttataatcatagcagaaggtaagtgggagcaggcatgtcatgtggcaagagtgggagcaagagagaggggaaaggtgccacagtcttttaaacaaacagatctcatgtaaaataccagagtgagaactcactcatcacccaggggatgatgctaagccattcacgagggatcatgacaactataaaacattgatgaaaaaaattgaaaaggacacaaataaatggaaatatattccatgttcatggactggaagaatcaatattgttaatatgtccacactacccaaagccccatgatccaacctcctcccaccaggtcccaccaccaacaccggagattacattacaacataagatttggaagggacaaacatccaaactatactattctgccactgcacccccaaatctcatgtccttctcacatttcaaaatacaatcatgcctttgtaatagtcccctaaagtcttaacttgttccagccttaactcaaaagtccaaaagtccaaagtctcatctgaaactcaaggccaagttccttctatctataaacctgtaaaataaaaaaacaagttattgaattcaaagatacagtggtagtacaggcattgggtaaacattcctattccaaaagggaggagttggccaaaggaaaggggtaataggcccatgcaggtctggaacccaggagggcaggcattaaatcttaaagttccaacataatccttgattccaagtcctgcatcctgatgtgaaggataggcttccaaggccttgagcagccttgcccacatggctttgcaggatgcagcccatgtgattgctctcacaggttggagttgagtacttgcatgttttccaggaagaaggtgcaagctgccagtgaatctatcattctggaatatggaggatggtgggtgatgtggtttggctctgtgtccccacccaaatctcatcttgaattgtaataatccccatgtgtcaagggcaggcctaggtgaagataattgaatcatgagggcagttccccccatactgttctcgtgatagtgagtgagttctcacgagatctgatagttttctaaggggcttcctccttcacttggttttcacttctctcacctgccaccatgtaagacgtgcctgtttcacttctgccatgattgtaagtttcctgaggactccccagccatgttgaactgtgagtcaattaaacctctttcctttataaattacccattttcaggcatgtctttattagcagtgtgagaacagactaatacagtgggcccccaccaacagctccatgaggcagtgccctggtggggacactgtggtggggactggaatccacatctcccctaggcattgccttagtagagtttctctctaggggctccacccctgtggcaggcttctgcctggacacccaggcttttccatatatccagaatctaggaggaaaccatcaagccttcttcacacttgcattctgagcacctgcagaattaacaccacatggaaactgccaagacttatggattataccctctagaactgcagcacaagttgtacctgggcccctttgagccaaggctggagccagaacagccaggatgtggggagcagtgttcctgaggttccacagagcagtgatgtcctggatctggcccctgaaactattatttcctcctaagcctctgagcctgtgatgggagggacttcctagaagatccctgaaacacctttgaggcctttttcccattgtcttggctgttagcacttggctcccatttagtcatgctaatctctctagcaagtggttattctgcagcctgcttgtgtttctctcctgaaagtgtttttctttctctgccacatggcaaggctacaaattttccaaacttttacagtctgcttcccttttaaatgtaagttccaactttaagtcatttctttgctcctgcatctgattgtgggtgattagaagcagccagggcacatcttgaatgctttgttgcttagaaatttcttctgccagatattctaggtcatcattcttttttttttttttttttgagatggagtttcgctcttgttgcccaggctggagtgcaatggtgtgatcttggttcaccgcaacctctgcctccccagttcaagtgattctcctgcctcagcttcccaagtagctgggattataggcatgtgtcaccatgcccggctaattttgtatttttagtagagatggggtttctccatgttggtcaggctggtcttgaactcccaacctcaggttatctgcctgccttgacctcccaaagtgctgggattacaggcatgagccaccgtgctcagccagtcatcactcttaagttcaaactcccacagacccctagggcatgaacacaataaagccaagctctttgttagggcataacatgagtaacctgtactgcagttcccaacagtttccccatttccatctgagacctgatcagcctggactttactgtcaatatctctatcagcattttggtcacaaccatttaaccagccttgaagcagttccaaaccttctctcatcttcctgtcttcttctgagccctccaaactcttccaacctctgcctgtgacccagttccaaagccatttctacatcttcaaatatctttatagctacaccccactcatcagtaccaattttctgtatcagtccactttcgcattactataaaggtataccagagactgggcaatttataaagaacagaggtttaactggctcacggttctgctgactatacaagcgtagcaccaacatctattcagcttctggtgagggcttcaggaacttttggttatggcagaaggcaaagtgggagcaggcacatcacatggtgacagtggaagcagtagcttatctatttactttttaaaacttcttcacttggctgagcaaggtggcttaggcctgtaatcccagcactttgggaggctgaggtgggaagactgcttgagcccaggagttcaagaccagccttgggcaacacagtgagatcctatccctaattaaagaaaaaaaattaataaaaaaaagaaaacccctccactagactgacaggaaggatctatgtgcctcatgatcccatcctcaaagcctagcatggtaccattatagttattcagtgagtacagaaagggtgaattaatcttagctccactactaattagttatttgcaagtagctactaagctcaatttcagaaactgtaaaatagggttataaattggagcaaatatgcagactgagtacatacactagcctgcctttcctgccctaaatcctgaaaaagacaaaaaaattaaattaaattaaattaaattaaattggagcaataaccaggaaacttaactgacataatatatttaaagttcctggtactctagaagtattatgcaaaattggtaacaatagataacactgggaatgggatcacaggctgggggccatgggtggaagagtctaactttagcatccttcataacccttggacacgtatgggcttctaaagaaaaccacataaattaaaaaagaaagccgtgcccaatacacactgggcatttaacaaaggtgagttttcttcgtaggtaacaagcccaatacaactggttagcaccaacaccaggactgaaacacaggactccaagtctttgcagtctttctacggagcagtgattgttttggataaaatgacagcccaaggtgccattgcaagctgcagctgcaatcggtgcggtaggcccagagtttttgttcttaatttcatttcatttggagctaagaggactaatttgatgattttcaatctcttctcccctgtcctgattttaaaagcctttctttttttttcttttctttttttaggcatatgtagtaacattataatttaaatctaatttaatttgggaaacgatgattcttaaaagagaaagtaaagcatgtgaataaactttgaagtgttcaccttagtttgggaccaaactgcctggatctttgtgaaaatcggttttgtatgtcaaggaggagtttaaggcctttccgatcacctgtgttccccttttctgtgcagccatgtatcacgtggagttgctcctaaccacacctcacgtgcccctgagccctatttcctaatttcttctgggctggacttcccattctccaccggcagctccagtatcccaaactttctagtcctgctgatcctcccagcaatggggtggaaactggagggcagtgtctggtctgttttctaagaaacgtatgaattctattatctttacaaatataacatgataaaatatttttttcaatgttttttatttatctttttataaaatgaaactcctatgatcgattaaggaaggcagttatggctgggtggttcatggggttttttggagtttctttggttagttttgctttcttttttgtctttttaaccgtaagctgtttaagttgaagcgctctcagatgtttggggggaaacatcctcttaaaatgggcccttgtgcttgccttctggggaggcggtcctgagcaggggaatcataaggcatttgtgcatatgttatacgcagactgcacccaccccttccccccagcctttgcctcttgggttgttgtgctgctttccccttactttgctacatttctatagttaagttggttttacttgaatgattcatgtttagggggaaaatgaaaatctcccttaaaattggtttcaactcctcctgcaaataaaataaatgaagtggcagatgtaacaaaaaaaaaaaaaagacagcccaggcaagcagcaccttcagctgactccttccgtactctgtatttgtcatctgtgtacctgtgatgaaaggtgatttgctgggctgatgacagcagtcatcagtcatatttgtattatagaatggaaaagtttgccatatactagcaagaataagcatatgattcctcttggtatgtatgaaatgtgccctacattaaacaatgaacactgtacaaacaatatgcaagtgttatgaatgttgtctgtctcagaatggcaggctggctcaatgcagagattctgggttttggagaaaaattctacaaatcttgcttttaaatcccagttcagtctttactaatttggtaaccttaggtaagttactcaacctctctaagccttattattattattattattattattattttcagattcaacatggttgtaataatattatggcaaaattgtttgggaagattaaatgagaccacgtatgtgaagcatgtagcaaatagtaagcactaagaaataacaactactgtgattctttgactttcaaaaagcagcttttcttgactttactcttgaaaccaaaaaaaaaaggagtatcagacacatcctgattggcaaatggatttttccatctatgaaataacaagtaggatcagttctcctttgaccatagaggcaaaaaatcagtttaagaaattttagttttgactattgcttaccagaatgaccactgcatttctgagactgcaaggctgttgattctgttttgttgtgagactggccacaggcccacacagtctaggcctactcgaatatctgcctgagttgcctttcctgaagtcagttctgccaggaaggtatcagttgtggggattctttctttggcacataaaattggggttaaagatgtagaaagtgttaacatttactatggagttaattccttgcttatcttgttactctccaccccacatacagcccaccctaagtccaaatctccacgtcttactctacagaaagaaggctgaatataaagtctcctaccaaaatagatactgaatgtacatgtcttctcattatggagattttagtcactctgaggtttctctcttgagagtcgccaggatgtgagctgaaatgagtcaatataaggccttgtgtttgggagtctctggtgttgtagaggagtgtgtc

SEQ ID NO: 136 - DNA, 140792 bp, Homo sapiens
gtggaagttcaattgtctttatttttcttatacagattcagagaagtaaaaaccagtaccaaactccaggtaaaatggtttgatctgatcgatttggctgcatactttcggtacgtataacattctaaacttaaaatagaaatttttatattacaaaacgtagaagtaaaattttaaaaagttaaagtactagcacatatatgtgttaggaaaatggtctctgtcaattgcccattttcccaattaaattaacctacgatttcctttttttaacagcttatttttttcataaaagttgtactttgagaagttactttctaattacgtcatgagaacacaacttgtaattagcaacacttctgtcagtctagatcacttcttctgcagagagcttttcaaccaagttggcatcaaccagcacaataaagttttcactgttttacctgtttcctgtatatggtgtaatcagtgaaagaaatggcatttcacatcctaaataatacggtgaaacactgtctaaaaattacttagatttaacagaattgcaattaggttttgacaatgtatttacttcaagacaatgtattttatcaggaaaaaatatcttgaaagaaagatctctgaaattatttttcatttgatacgccttttctgtgacaaaattttggggtgaaatgatgatgtttactgattgatttagtactaaaaagactagtactaagaagactaaagacagttatcttataataagaaatatagtataaatagcaccttatcaagaattctgcaggggttttaacacttacaataataggaaatagccattaaaaagttgctctaactttagatttctaactttagtgttctttaacaaaggccatattttgtggccttaaaaacaaaaaattatatctggctttatctattagtaaacacaaagggtccatattttattctgaaaaaatatttattatattcattcataaatgttctaactaatttaactaaaaaaatcttctagtattttctgatgccacaagcttactagaaaattacttctaaaaattggtaatataaatcatcaatgatttacctactttaaaaaagaggggtatctgtttctcttacatttaataacctgaaaatgagtctataaaaatattttttaaaaatacagtaacactgctgagttttgttaggtcccttgtttttttaattttttatttatttatttatttttagcaagaatgtacaattctttttgcaattttttgctaacaaaagacaaaaagaaatagtgctcccttcaatttagtagcaataaaatcatctatcttcatctctctcagagggcttagggagagtgaaaggaattagaggaacataaaccatgggtccttcaggtaaaataagtcatttcatagtgatggaggcaacagcaggctacgctcttgtctgcctgtacgctcagcatcagcatgccctgcccctcctcctcccacataaggtgcaccaaagccttcttttcttctacaacagagtcttccggtataaaggtggcaacagaaaattgttgctttgtccttttggggcatctcttgcatctcctgcttgttttgcttttggggtactataacttgtctctttccatttcacaactagtatcctttccacgatattccataactttgctacttcatctctgaccttttcacttgccttctttccaacatgatccaatgtactctgtacatgtatattccggtagatcaaaaggaatcttatttaagatccccaacaaataagtcccccatggaaattgaaagtatcctctcagagactcaaattattaaagtctttcaaaaaagattaaattcatagattataaataatattagttcaaaatattaaacagttgaggacttcattggcaatgcaggcagactgcatgccagttgaacatgatgctctctcagtccttaaaagctaattaaaaatggttttggttacataagaggtattgaatacatatttcatgcctttttataccaactgtagcaaacaggattaggataatatacttaggaatcaattttactgaattcagaaacatttatctccaccatacaccctcaaagggcatttttttttacatgtcagtcagagatctgcttcatccttcagtttcatagatagaattattttaaacacttgaaatctaggaagcaaacctgacaaggcttcagaatttaaaaagcaacagctcactgtgtgtggtgtgctatcaggttgaaatctatgttgtcctgatgttttcagagttatttcaaaagacaaaaatacagttgccactgatttatcaaaaacatttggctgccttttgtcatcagctacaaaattacagtgctttataaaataaacatcaaggccgggtgcggtggctcacgccagtaatcccagcactttgggaggccgagatgggtggatcacctgagatcaggagtttgagaacagcctgaccattatggtgaaaccccgtctctactcaaaatacaaaaaattagccggacgtggtggcaggtgcctgtaatcccagctactcgggaggctaaggcaggagaatcgcttgaacccagaaggcagaggttgcagtgagccgagattgtgccattgcattccagcctggacaacaagagcaaaactcgatctcaaaaacaaacaaacaacatcaagaaaaaaaaaaaccatcagattctaagctgcaattttttaaatccccagttgtaatatttcaaaaacttttgtttgaataaaatgctcataattagtaccaaactggtctctttcacaagatctgtagtgtaagacctgtgactaatgctgctgctgctactttcccgctggagggactaagttgtctagatgctctgcagtaaaataacgaaagataagctacaataggactgtgtgcctttataaatacagactaataagagccatcagagccagcatggattcaaaattacattgtattccatacagtagaattttactatccatacaatgatttttaaagctcaagttaaatagtttttaaagcatttggtactactgtcatcaatacagtttttgaaactgtaaatcaggtcgaattttgtgcacatttcctggaccaagatgccctcagaagtaactgcctgtggtcagctttttatggtttaaaatcaattggtgtataaatttcaattaacacccataaagcttagccatggggcagcagagaagaaagagaaaagtattctgcataatcaatcctgcagacacaattctgtataatctgtcacaagaacgcaggcttgcagaaaatgaaaatagaatatttatttatgtttaacttaagttactctcaatcaaaaccaggcaatgattaaactggcaacataaaaaggagggagcacgagtcatggaggcgggaagtggtgcacctgcagacttgctctgctccatcactttttccaagaggcccaggaaatgtaaggtcatggctacatccaagttacaatggtagtgattacagccaggttagaaagggctcacttttgttcagagcagactctacatcattgaagagggggatcaggtcttcagattccaaagttcctaagtcaacgtttgttcctggaagacagtcaaggaaatcagggaaacgggtctgttggggattgatgttcatgggtgtttgtcctgcgttttctcctataacaaaatgaaaagaaaccattttaattccttcttttaggctcttgaaggaggaacagttcaagtatttacataaccctcaccttcatgtcttcaactaccacattattgacccttactcataagaggtacagagatgtggaagaaatcgaaaattatttctggataggtgtggtccagaatggaaaaggccaaggagataagaaaggagcatgtgaaaggcactgtggatctgatctatgatctgtgccttcccatgacaaaggtgtgaagaactgttttacaaaagagtagagaggccttgtctgtaataaacagcttattacagaactataatctacaggtttcattgtaagcttaggtttacccataccatccttctttatgttcaaagagaatggtgtgaagcttcttttaaccaggctattaaaaagttgtcttcattgatgactttaggcatcatttataaaggcagttctgcagacgttttccctctttctgtaatacctacaccctacaactatctgcctttctcacaagcatatgagcacagtgcatatgagcatgttaaggctttaagtcttagagtaaagaaatcttttgttttctttaagacactatttcctaaacccatttaatcacctaaacctattttggcagtatgtgtattcaaataaaactgaagttctacagaacacaggtgagaaaatgctgtactagaggaaaagtaggtgtctgggatatgacatgaagaatataggttctttatgtgtcatagtatgggacagaatgcactactgactttggtgtcattagatcgagctttgtggctgtgtaagcttagacacacttaacctgcctgattctcagtttacccatctagaaattgggatcatatgctccttttacaaaagttagagtaaagtgccatatagtgtctgccacatatccatggctctgggtgtcattgatatatacaaagttatatacatacaaaaatataataaatgttcattgtcctgagagaaagaaaaacccaggtcttcagccactattaattacacaatatcaaaacaacaggttaattcaaaaagtcccaaacaattttctgaagagataatatctacttcaaaaattgagaagcattgataactaaggccagcttccaccataacgtcattttttaaaaacttgttaaattatcttttgtgtgttacaagtgcagtagccttcctgaaacgtgtgtagggaagtttcactattttaagcaaaattgccgaaagttcactttagcaatctgtgttttccagggagaaaaattatatccttccaaatgatgaaggaaccatcatccaatttggattttggtgatagcaaaacacaatggcttttctagaagtcacaaaatataaatgactcctgggtaacattttacagtattttcattgcaaagggtagtaaactgaaaaattaaatcaaattcaacaatatgacctcaatatagtgttactgatattgaaaaataacgttaaacgaaaaaacaaaatccaaaataactttcttctacttactagagtgtaacagataaaaatgaggctttaaaaagtgtctaaaaaacaatctgatctaatgtgctggatgcctttttttctcttcatctccagttagaatcattcatttttactaatttcccattttaactttcagatactcaagaatataatttttagccaagcaaaatctctgttttaaagaattcctaggccgggtgtggtggctcatgcctgtaatcccagcactttgggaggccgaggtgggtggatcacctgaggtcaggagttcaagaacagccttgccaacatggtgaaaccctgtctctactaaaaatacaacaaacaaacaaacaaaaaaaccccaaaaaaacagtgccaggcatggtggcgcacccctgtaatcccagctactcaggaggctgaggcccgagactcgtttgaatccaggaggtagaggttgcaatgagctgagatcacaccactgcactccagcctgggtgacagaatgagaccccgtattaaaaaaaaaaaaaaaaattactcttatcctttcttctcaggatggaaggcatgaggatactggctaagcttcttcattaaagttaacaatcttaaaatagaagcagctctgcaatctcatagtaatctttttggtctttgcagtttatccacttaaaaagtggaagagacaaacacaaggcaattcttttttttttttttgagatggagtttcgctcttgctgcccaagctagagtgcaatggcacaatctcggctcactgcaacctccgcctcctgggttcaagtgattctcctgcctcagcttcccgagtggctgggatcacaggcatgtgccaccacgcccagctaattttgtattcttagtagacacaagatttctccatgttggtcaggctggtcttgaactcccaacctcaggtgatccacccacctcggcctaccaaagtgctgggattacaggtgtgaaccaccgtgcccagccacaaggcaattcttaaaagggtgtgattactgcagaatattctggaaggatggatgatttcccagcctttgctcatgttattccctttactggatcttcgcaccaagcccagctgttgctgccatgtatgttttgcaaatggagtgctcagctggctcgtttcccttcagcatgtggccagcgcgtggtccacaggcctgatagatcttttctagccacacttgagctctgcctgcccccacagcttccctcattttgctactgtataattaacatttctccccttgagaagatgtatgtccagttcctacaaagacttcacagaggtggccccacactcaatgagctgactctaacttaaccaggttaacttggcactcacattcccacactcaatgagctgattctcacttaaccaggttaacgtggcactctgacattatcaagtccattgtatgtatgacatcagtcttcttactggagaagagcactttgagctggtctctgtgatctcatgactcctcacaactctgccgtgagcatatcactcccactttatgggtgagaaatctgaggctcacggaggttatgcaacttacccaaaggcgctactaggaatggagaagcaaggattcaaatcaggctgcctgttggctaaaactatgttcttttcaggacgtcatttaattccacattacggcttcaaaataaaacactccctacttacccacttgaggttattttaaagagacatagagtagaatccatcctcttttatggttttttttttttttttttgaatgtcaaacttagatttagatctcctgagcttttttccttaactttgctttttatccttactggcttcccagtgtttagaagatgaaagtaaagaattattaaacataggaaggagccacttcctaaggctattccaaagatagcaaaataaatctcacactcaaaaagcagagagagagataaaggtggcagggggtggtggtgggggaagaactgaagtaataaactgaagaacagtaaaacaatcagtgcaaactattcctgtgtcactcctcacaagatagtctttgcaatcttctcaatgcaaagatgacaacctacacgaaagacgccaggggagcagctttaatgtactgcatttgtaagacacctggctatgagtttgactcttgatctttccaacaatttagactcacaacacaaagagaagccatcaaagagtagagtgtaaaaaactacaggcactatggcaaacactttgggggaaggaattttttattttcaacacaaaacaattactttcgtcaatgataatggagaaggaactttcatgaataactccaaatagtggacaccctggctgtcatttatttttggttctagaatatcttcttagagtttatgactttcataattaagtctaggtaaggctaataagactaacttcagtttctgcaattggaagtctcactccttgagaaaaggagaaaaagaaaggtaatcgggaagcctggtgaggctggacctgaaggatgcacaggctggggacaaggtaagagtaaccctgactctcttctctttaattcctgagggaggatgtcgttaccatgttggaacttggaagtgacaattttgaatcctctgagttgctcagcattccaaatacccactgccaattgcttttcaaatgcagtgaatgacatgaaaaaaattggatactagaactataaaccagtgtcactttccaggagaaagggtggcccatatattacaactaaaaactagaacagcataaataccccaatgtggaaacatggcaaacaaacagtggtgtcttgatgcaattgtgaggaagggactatatggagcaaagatgaattaaaaaaaaaaaacaacagaatttaaaatcctgcgcccagatgtaaaactatacttgtataatctatgaggaaggggctacagtttattaatagtgcctgggggttcagtggcttttcagctgttattttatgttgtcgttgagattgagtgtttctggttggattttaaaattgagatgaccgtactcgctctggcagcacctatactaaaactggaatgattagcatggcccctgcatgagaatgacatgtaaattcatgaagcattccatttttttttttttcaacatttttacagacactcgggactactgggagtggggaggaacaaggggtgaaaaacaaactattgggtactatgctcactacctgggtgacgagagcaatcgtatcccaaaccccggcatcacataaccatgtagcaaacctgcacatgtacccccaaatataaaataaaagttgaaattataaaaataaaataaaagaaaaataaaattgagataaccgaagagatcatttaaaaaacacaaacccattgtaagtgcttgcaggctttgctcctacctgtatccatctcatccacattgctgaggaagtcctccggagttgtggggacactgtagcaccctaaccccaggccactgtcagtgctctgctccctcgaatgatatggccctctgcaaagcaaaagatgaagaaacttcaatatgagcccactaaataaatctcaaaattaaaacacagtcacaaaagctctaaactagtgcagttgtgccatgctgcccaactttccaggttagggaggaaggaaagttttaattttgaaatacataccctcatgaaaatgaaaataatcatgtgtggccattcacagtaaattgacattgatttccttttcacctcaaaataaccatttgaacattcttcaacatacagagtatgacaccatttatgtaaaactttaaaaaaaaaaaacaaaaactatgttgaatattgcttatggatacatacactaacgggcagtaaggggtataaaagtctgtgtgatggacacacgccagtttctgaatagtggctaccactggggacagaagggaaaagaaacgagatttcagtggtggggggatggcttcaaatattaattgtaatattttatttgttaaaaagtaagattaaataaaactatggcaaatctgggtagtgggtacatgggtaattcatgttattctttgtacttctctgtgtttcaaatactttaaaatcaacaatttaaaacctccattaattattatttcagctactatttgtttttatctctatctttaataatgttcataattgtattgtttgtttgccagacgtctctgcaagggcagaataaaaggcacaggaaatacagaattgccctttttatttgatttaaaaactacttctgctcatgaagatatttctggctaaattctctttcccttttgctcctttgttttaattactttttaaattgtgaaattattttaaactcacatagaagacgcaacaagagtacagagcgttcccatgtacccttcaccagcttccccagtgataacatcttacataaccatagtgcaattaccaaaatcagaaatctgacactgtagaatattatttactaaactatagatcttattcacatttcaccctgaacatcatctcttttcttttctttcttttttttttttttgagatggagtttcactcttgttgccaaggctggagtgcaatggtgcaatctcggctcactgcaacctccgcctcccaggttcaagcaattctcagcctcccgagtagctgggattacaggcatgcaccaccatgccctgctaattttgtatttttagaagagacagggtttctccatgttggtcaggctggtctcgaactcccaacctcaggtgatctgcccacctcggcctcccaaagtgctgggattataggcatgagccaccatgcctggccgaacataatctcttaattgttctgttctcaatttgccatatggcatgcttttatcccctgttggttacataaaaccagaagattcttccaagtataagtactagacgacaccatcatgtttaaaaatataagttcatgcccattttcaaattcttgactaggggtttactctacgtcctatcaccaattttttaatttggaaattttttaacaggcagatgatttcccctgcttttcttttttctgccagctcctcccacttcctccctttattctcaccctcaaccctcaagctccccacctcttcccaatgtaaacaaagatcctattatagtctagatcacataataaagagaataaaaataagtggcccccaaatattaacttacccattgaggaaaggatctgagctattattagtgatggatctcatgtctggggtcatcgtgggtgggttgacagcagcctgaactggggcaagagtctcagcttccatggggagctgtcgacagagggcagcttcctacagtcagaatgggaagcaagagtcatgcactcattgtcacaaggcatggagcaaagtgtacttcacatcaaaacttttcaccaaatacaaagcactgtgtatttactcccagcaagtcaaaatcaccaggcaaccattagtattctttctccgaagaaagtcttacagacataagtcacttcacattcacaaagttaatgggaagctcagctattatttgatctaagggcacttaatgttgcaatcatcccacccatgcaattatttaaacacccaaatcatagaaagccctctcaaaacactttgtcagagacaaggctttttctatctcaggttctcaaaccaaatctacatcaatcaaagcaatcagactcctctggactataaagtacattctggtctttgccacttacaggccagtaaaactgtggaattacagagtccaggctctacattaaattgcatctggcagttttatgtttacagacaggaaagcaaaacaatgagttgaaagtttactttaaaaagtcaatcagtggccaggggtggtggctcacgtccataatcccagcactttgggaggtcgaggtgggcggatcactggagcccacaagttcgagaccagcctgcaacatggtgaaaccctgtctctacaaaaaatacaaaaattagttgggtgtggtgctacttgggaggctgaggcaggaggagccctgtgcctgggaggttgagactaaagtgagcagagatcacgacactgtactccagcctgggtgacagagtgagacgctgtctcaaaaaaaacaaaaaaacaaaaaagtcaatctatttgactactttgttgactaaaatgctgaaggttggggaaccatgtagatccaatccaaatcccacagacaagtaactgtttcacagcatatggatttcattagcagaaacaaataatacaagcattattttataaaagctagcattacattgctaagaagagtctatccaaaaggctacaaatttactgactgcaactactttctctaggtataatctccaggagtctctccatcttgacaaacataaccagacatcaaattcctttcaaatttgctgatgtttccagagaatacttttgtatgtttacatttgcatcccaaaccaaggttaggcctttccccatatttatgcctatcagtttcccactttccatgctgaagtcattggtctcactgtccctcaaaccctaaaaccatggctacaatggcaaacagaacatttaggacttctaaattacagtatcttcgttagatctcttccagccctaacatgatgtgactttagagggtagctgctgtctagacaagtcctagtgaagtcatcggctataaaaattttcagttactagagttggttgcactgttacaaaccatgagagacctgattgatttaaaaaaaaactgtattgttaacttatactgaaataaatctagctggaaagggtctttggctcacttctgttcatctagattgcaaataatcaaatacttaactaacaaattttattcaggaatctacaaaaagcaaaccaaaaactggagatttttttggtaaaaagtgattttcatcatctaaatcttggaagtgccttctgaataaacctagaaaaatcaaattattttctgatagttgtttttaacatggcaggcagggtgcattagaaaccttattatccaaccaaagttttcctgaaagcctcagaaggaacaacagggattgaatctggcataaaaagcctgagtcccaccagtccccatccctcaagcacactcatacaccctgagccacagtttgaaaaaatgtatctcatcaatggtaaatttctaatactttattaaccataaatgcaagaatcttttgactcataaccctcattatccaaaaacatgaactttactagaatattccatttttcaaccattctgaataaatgtgggagtttacctctaaacaaatacacttttaatttaaaagttgatgagatggctgcattcctttgtattgaaaaaactttatcaacatatgtcttaagaatacaagttgaggccgggcggtggctcacacctgtaatcccagcactttgggaggctgaggcgggtggatcacgaggtcaggagatcaagaccaccctggctaacaaggtgaaaccctgtctctactaaaaatacaaaatattagccgggtgtggtggcatgcacctgtggtcccagatactcaggaggctgaggcaggaaaatcacttgaatttggggaggcggaggttgcattgagccgagattgcaccaccatactccagcctgggcgacaaagcgagactctgtctcaaaaaaagaaaaaaaaaatacaagttgaatctgcaatttccaggagttctaaatttatatatggtaagaatcatttctggaacttcatgggataaaaaaatacactatatataacacacatgaattgttatctgtaataatatataaaattataagaacaaatatcaaaaattagatataaaataaatagttctaaactttcctattaatttaaattactcctagctatttccagtaaataaaacataaaataatgcttgtgtgtgtctaaatatataaataaaatatataaataaaatttaaaggattatttatgataaccaaagctgaaaaacctatactatattggaggaaatgtttcactgtgccatttcacatttgttccatctgttctaaatcaaagagaacagaagctctagtctccagcactgatgtttccctaactaccctgaagacttaatcaccaagtcatcctaagggcaaatgccgccttctgtctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgcaaccttcacctaccgggttcaagcaagtcttgtgcctcagcctcccgagtagctgggactacaggcatgtgccaccacgcccagctaatttttgtatttttagtggagatatggttgcgccatgttgcccatgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaagattattccaaaatcattcttaggtcacaagttattccacatagcagccaaagtgaagctcacgtgaccccctgctctaaagcgacctgcttcttgttccacctggatggtaaatagaggcaggtcctcactgcagaccaccacaccctgcataacagccctggccaccctttcctcccatgtctctgatgtgctcccctccttcacccccttccagtctcctggtttctctgctgctcctcccacctcctgcacctgcgccaactgttctatctgcttgcaaggtgttcctcgagtcttcctaaagcttattccctcacttaacgcctgcctcctacagacgccatctcttcagagatgctcctacctcacccctgtctaaaatggcctcacccctgtcattttctgtctcttaatctgcattaattttcttcagtgcaacttaagttttcattctctgtctttcctactagaatgtaagctccacgagggaaggggccttgtttgtcatgttcactcctgtacccaactaccttaacagtgctaggcatacagtgggtacttggaaatataaactaagaacatgcaatctcacctcagccacaaatatgagagaaataatagcctattgtatacaacccaactagccaggtgcaggctccatcctcaagaaatggtcctgctgcactctttcctgctcctcacataggatgaacaggagggccgagtggccaggagctagatgcttgaattggaaacctggtcctgctatctaacagaaagttatttaaccctctgttcttcatttgtaaagtggggataataagagcacccacccaagaaggctgctgtgatgataaaacgggataacactacaaggtgcttagaacagtgccaggcactcaagatcacataataaatactgaaggaattattattatttcattttctgaattccaatctcaaaaaaaacaaaataaacaattttaaaagtcacactgtcatgtggaactgatccactttaagtggtgagaggtttcttcctggtcaactttcaccttggagggattaaaccaaagtgtgaaattcatcataatggtcaccaaggctaagaaaacaattttttttaaacaaggagaggtttataaaccatttttatataacataaaatttgttcgaatataaatggaaagtagtgagatgttttacttcacttaaattttataatacgagttctatatttagaactttaaaaattctagcctttttttgaatgaaaatacttccctattccaactcatgaactgaaagagaaaaagaaactgtacaaaacccgaggtctgaaaataaaagggctaacctcaccaacatgttgccatccaaacaggggagggttttgttttaaactaaatttaggtataaaattaaagcccagacccagtaggatttggactgccacatgacatccactacccttgcgtgggtaaaaatgaaaggcaaacgtctgacttagaccaaacagcagcagtcaaaatggatgaaactaaagcagctgaagcaaagacaaagacaggcactggatgaagtaagcttccatggaaacagaggggtgacagttggtcaaggctggctgagggcataactcaaggcctctgccgctgagcatcggtggtgcagctgccttcactcagcaccccttccttcctctgctccctctagtcgaggcaggaaaacaaacgctaagctggcttgtcactcatttcccactgtgctccagttaaacatgtatattcacagatcccttccagggtcccctctgtgtccaccctgccctccaaacaaaccttcagtttcctagaccaagctcaaaacctgctttctgtctcaagaagcaggtcatcattgcttctctagctagtccaactgacctcttcctccaatcaaccttcaagtgcaaggctgcatccaggtccctacccaacactttatcttactgaaatcttttcaaagagtgaccagagaccaatcaggatagagaggggtcagggcatcacatcctatgaagaagagtggggctatttaaccacaggggaagactagaagggcacacagtggctctcaaattattaatgaactgtcacaggaaagaaggaagatctcttctagcctagatttgaggcagatacgatgaagggctttctagttacttatcagttcagggcaggaactgccttcttctcaattctccaggctattagccaccggatttctgaaacagtagttggggtttaagttggggtccagagcttggcaccgaaaaggcagcatggcacaagagcaaaactgtctttggaaccagaaagattggagttcaaatcccagttcagttactacatgttgtggcatcttgaactaaattcttaacctttcttgacagtttgttcacctgaaaaaaaaaaggtggtttataagactgatcttgctgggatgctataaagattagaaagcgtacttataatggacctggcacattgacgcagttaacagaacaagctgctgatagtgttaaatggtgtgggaggcagagatactagctaaaaattgcatattgcttactgtgtgtgaaacactgttctaagccctttaacatgttatttcccatcctggctaacatggtgaaaccttgtttctactaaagatacaaaaaaattagccgggcatggtggcatgtgcctgtagtcccagctacttgggaggctgaggcaggagaattgcttgaacccaggaggcggaggttgcagtgagccaagatagtgccactgcactccagtgtgggtaacagaatgagactctgtctaaaaaaaaagaaagaaaaagaaaagaaaagaaaagaaaaacgtgttatttcatctcttcctcgtgacaacccaattgtctccattttacagatgaggaaactgaggctcagagttaagagtgtggcaaagtctcagtgtggcagagaaagaaaagttgagggttgaggttgacagacctcaaattgtcaaccctttcacctgctggctgtgagaactgggcaagttacttcacttttccgagcctgttttcccagcaataaaatagaaagaccaacccctctacctcagacagttcagaggaaatttaatgaaacagccgatttaactttcctgaacatagttttcctccctgaacagggcaacagaatgaactggatgtattcaatgatagttttcaacgtatatgagtggagctcatgtcctaggaattcacaacccatcaagcaaagttacaagttccaatttcaagggcacttttcagaaggaaagctctccctgctgaccctgacccaaccctcctccaacaaatttatttttgtctatgtccaagcttggggtggaaagacttgcaaaataagggctcaagaatctcttggtgagtttgtggtcaactatctagctctctgaagtgagtaattatttatgggctaaaaaataccctttcctagcagctggaggacgggtgatgtgtaaaatagctgaagaagtaaggatgtgaaagacaaatgattatttgtgagctgaaggtgtcccaggaagcaaacctcaaacctcctctccttctaggtccttggcctgcagcttgcctgtggaataaaccaacagaggaggtgagaaagtaaacggcagctgaaagcatctgcagctctgtcccgccttggctgagggaacactctgccagccagctcctgccctcaccagaatgcacttcaaaagggaaacaaatgacaatcagctcttcagaggctgctctgcttgatttaagtgtgtgtggccagggactctacaaacatggaagattggattgttttaattataaagggtggggtgagtagaaagaaaatgaaaaaaaaaaagacagtattttgaaatcctaacattaaaatagttattctggatgcagagaaattgctttctctgccaaaaccctgagggacttcagagagagaatgccgaattatttaccttctttacgggggacggcggggggaacaaaaaaaaattactgatgtatatttctttttaattcggtgccaagggattctaaaatgcactgtcacacttcccggagactgcctttttgaaacaactcatcactaatgctcagctgccagactgtccctacaaaagaacaatcgaaactgcgatacttttaggaagccatttactaagtttgtcattattatctatggtctatttgttgctctttttactcagagtgcataaagcaaatttgtattattccacaactggtttctgttgtcctttcaaatcacattaaagaaaacattataatttagatactcgtctgtcttcacttaaaaaaaaaaaaaaaggctgaggcctggtgcagtggctcacacctgtaatcccagcactttgggaggccagggtgggcagatcacttgaggccaggagttcgagaccagcctggccaacatggcaaaaccccgtctctactaaaacacaaaaaattagccaggcgtgatgatgcgcacctgtaatcccagctactcaggaggctgaggcatgagaatcacttgaacctgggaggtgaaggttgcagtgagccaagattgtgccacagcactccagcctaggtgatgaagtgagactgtgtctcaaaaagagaagaaaaagaaaaaaaaagacttgaattgatactattgttcaacaacaagggcacactgggacattttggaaaatggattatttctgggacatgtaagcaaataaaacgcttgacacaagctagaatggaagctctgtgagggaaggggctggggtctgttgttcacagctgtacttttaatgcctagagcatttgtaaaacaaatatatgaacgaatgaacttaaatagccaagcttatatggagggatttatagattcacaaaatattagactacgtgacctctgttaacccagtcaactctgaaacctaatgctatgaaatgcttttctaaaagttaaatagtcccctgttctgaagcaaaggctatgaaatagcctacatttatgcttcatgatctgctccaatacgacactctcctagctcgctaaatagctattctttgcatgacaaaaaaaaaaaggggggggcctcagaaccttccccaggccagtgctgctcacagccaggtgtgtccccctccaggagccctctgtcaggatggctgtgcgaggtcagccagctggcccgccgcgcctggtggctgtcaagcctggcagaaatcccacagacctgccaaaagaattccgaggcctccctcttttctcgtccctgttgccccggcgacccgaggccaggcttagtcagcatttttgtttgacaaactgcattctcctgtcccccaacccccaaattaaaaaaaaaaaaaaaaagaaagaaaaggttgagggtaaaagcagggctgaatttgctttgggaataatgatttctctacaaggcagcccccgtgaagggacaagggggagccaaggctttgccacttactcgtcttccaggtcctggtcctcgaggttaaaatcttccagaaagatggccccaaaccgttatatttaaatgaataacacacatgaaaagaaatactctcttcaggtaaagccatatgcctgttttcatgtcaaggaattgttcttttagataaacaggcattgagaagcctgtttctcaatgtctgacctgtgactacgatttcccacttcatttggtaaagttgcaattgtgccttttaggatactgagcaaatattgcgttgaatttttcagttgtaacaacagaatactctgtagtcattgtgggtgtgtgtggctcatgacatttaaaaatttatgtacggcctgttgtagaaaggattctaggcgctttggaatgggtacatacaaagtcacagcacaacttcatggctgacacagaataaaaaaatgacttcccaatatattaagaagaggcaacaaagcagtattaaagtatgctaccacttttgtgttttaaaaaacaaagtagacacattgatacacatgatacatacaaaaagactagaaagaaatcatcagcatatttacagccactctttctaggtaagagtataggtgattataatttccttctttgttgtttagtattttatacattccgtaccataaacatacgttttgtctttttgtgtgtagcaattcgttttcttttattattctttttgtttacatacagtaaaattcactctttgtggtatacatgtctgagttttgacaaatgtagagctgtgaaatagccaccacaaccaagacacggaactgtgccatctgccccacaattcctcagtgctgcccctttggagtctactctttctgtactgtcaaccctggcaagtgctcatctcttctctgtccccatagttttgcttttccagaacgtcacataaatggaatcatacaggatgtagttttggggggaagtctggtttcttgcacttagcaaaaacacttttttaaatgctaatcactaaagtaactcagtaaattatatttttaattttttttttttgagacagagtctcactctgttgcccaggctggagtgcagtggctcgatctcagctcactgcaacctccacctcccaggtccaagagattctcctgcctcagcctcctgagtagctgagactaccggcacccgccattatgtctggctaatttttgtatttttactagagacagggtttcaccatgtcggccaggctggtctcgaactcctgacctcaagtgatctgcccgccttggcttcccgaagtgctgggattacacgcgtcagccaccacgcttagtcaaaaattaaaatttttttctacttaaaaaaactcaacaaatcaaattttaatttccttaaaaaaatgaagagaaagcaaaacttcaataagaattgctttttttttctagagttgccatttctttggtgaacctgaagtagcctcacagcctttgggaaattcagtaaaaataaaagaaaactctatcacagacaaaagacttcctttcacagaaatgcactctttatgtcttccatgttagattcctggtacccctccacttgaagtgtctgccgcattccaagataattcatcaattatcagatacaagtagctcagctctgttgctacaccagccaatgctagattggagggactgcatttaaggaaattctcctgcttcagaagattccttatcagcagagataccaaaccttactggctcttttgatcctaattctgtagccagtaacctgaggggtcactggaaagaaaaaggagtatctgatgctcactttcacagaactctgctcaggtgcatctggtctcagttccagtaatgaaagtcaaagatggtagccactgggcccctgtgaagcagggaatggttttaatttactcttctggtctttaacttggattaaagttaattatttttccttttctgcaaaaatacaagttatctgaaggcagtcacatcccatttacctgtctgttattttctactaaataaatattgattgaatgaatgaagagataaaggaatgaaggaaggaaaaaaaatatgagcttccatactgaaataatgaaggctcactttagatttgtaatcaaagtttcctcagatccattttgttaatgttctcgcatgatttcaatgccaatgagttaataggtgaccctttggcattgtggtatacatcaaatcatgcaacaaggaccaaggagttgtttttttcatggcacaacatcatcaaactatatgcctagtggaacaacggcatagcagaaggaacaggaagaaaaatgaaacaatatttatatagcatattctccacagggatctttcagattcgtcgtatcattcaagaatgataaaactatagacagcgtgataatttattagtaattaggggataaattcatctacttattaaattttgccaacctccctttctactacagaaagagagcatagcctggggccttgctcccagacaggctcagttggtagaagggcaggtaggtctaggcctacctgcagggcctgggccccaagaagacaggctgtacaattaaggccgcctacaagcaagaggagagccagtgtaattacaaactgtccactgagcaagggatattcaggcagttgttgactacccaggacataggggtaggacagagagaacaaacagaagtgtacagataatctttaaatttcaccagaaccaccacttcccccatctctccaaattcctaccagatgctggaaggcaactaaacaagtgagccaaagatcacttttaattccagtccatttccctgctgctgccatggcttaggttcaaaaagtgaagcagaaaatcaccaaaagagttcaaaaaatccaccaagatgaaacacagagcccacacctgaatactgaataatcaggtgtcctggcaaatgccccagaaaactattatagaacactccaatgccatttattatatggtcttaaatcatatctttgacaatcaggagcatgctgcttctgcatggggaaaaaatctgccatgattaaaaagtctatttagaccttttcctgtactccctaacaaaaataaaaaggcatcagaacaccagaaccaaccactccaccattccatctcctcctaactacacacacacacacacacacacacacacacacacacacacacacagagtcaaggctgaactacatgagtccctgtgagcaaatctggacaatcttttctcctgcttcatatacaatgcaacaatgcaattgctcactatgatgcagcacaacgccccacgttccacagcctccaaggatcagcatttaaggaacttggttggcatttctgtaatatgaaccatcagtactacatcctggttcaaaggcacctacagctggaataaaggaaacaatttggggcacttttcccaccccttttcagaaatactttctgtgggaaagaaggaggagaagcaagagaaagagaaacacacccgcaaaaacagagaagcaagtcattctttgcagaatggtcacaactttgtgtaaagaaaaaactcactaaagctcatttaagtataaaactgagaatgtataaaatgctgttgggatactgtttaatttaccttacattataaaacagaaaaattattccaaataaaattattattcaaagacagaaaacaattaacaatacaattacttcccatcaagaaacatgacactatatatctaaaatcagtataaacaaccgttagcctgaaataaccgtgaaagttcaaacataaatcctcagggtaaaagacacaactgtagttacctaattattaagttgtattcctcaaatttggaggaaagttcagctgagcaacaaagcacaatttatattcattttccttattttcaaagactatatctgagaaatgattttaatttaccatgcattttaaacctcacacaatatagatttcttatatcctggaatgtatttgatgagaaatacattattcattcatggaagtcaatgtgtatttttgaaagtatcaaatgtagctttaaaaaaacagcatttaccctaacatgctcggtcctttcctccaagaaagttctctggaatgttaaaactacttatttctctaatttctctaaagtagcaaaaggaagttattcatgtatcttgcttcatgtgagtcacaaaacaaagtctgaaaagttaaaacaataaactgaagcttttctccccaaaaatgtagccagaaaaaaagcatgagacctgaaaacatgggttatattagtttagcaacacagaagaaagaattctgctcttccatagaccaagccactgaaacagggagagcactgtgggttcttttaggaattctcttgtattcgtttttgaagtacagcactgagcctgacccacagagggcacacggcaacacactcctgactgacggaatgaaaactgaatgaatggagtatggtacaaaagtgcctgattgatgcccaggcagttttgcagagcactctgttggagtccatatacaaaccactttcccttctcattctcccttcagcttccctctttttcatgctctgtggtggaccaagatcctttgtcatttcttctgaggaacatccactccactatctgcttgaatctcggggggttctctgtgactactttgaccaagagagtgtggcaaaagcgactccacgaccgtttccagagctaggccccaagaaattggcaacttctacttcctgtctcttagaatgctttttcttgaaaacccagctgctatggaatgagtaccactactctgagatcgccacaccatagatcccaggcttttgttccagcttagcccagtcttccagcaatcctcaccatcatgccacccacttaggtaaagccattgtgaactatccagaccaacccacctaccagttgaataccactaaatgacctcagtcaatgccatgtagagcagaagaatatcccaggtgagccccttctaaattctgacccacaaaattgtgcgatataatgaaatggctatttaagcaactacattttgggataatttgttacacaacaacagactcttgtctctctactttctcctttctctccttctaaagactagcagtggaagccaaaggcagccatgctaatacagctcgtccttgtacccttaagcttcgttctgaaaaggcaggcagaacactgagagaagaaactggattttaatcaagaggcttggagtagggctttgagccctattgtctcttcttctctagaagaattaccctgaaggtaagcagctacctacccatcagctttggcaccaaggccagggagcctccaccagacaccatggaaagccatacctgcctcatgagctcctcttggcgcattcgaatcctttctctctccatctggattctctgaagccgcagtttctgctgctgctgctgctgagtggtcagcgcattgggcatactcatgagccctgcgggtgggttctgagtggggtggttctgctggctcagggtactgggggccatctgctgctggtgttggtgattcatcactgcaagagggaagaacatacagattaatgaccagggcccacaataccttatcaaaaatagaccatcagaatgttttctgctttggagtatagattcctgagattccttccaaagtactttcctgttaaccattactgtttaagtaattattaccttaattcaattcacggaggctcgaatactggccccaatcctgactcatctagcctcggcttttgtttctgttaaaatctcatttcacacctccctgtctagagtacattttaagccttacatagaacatagtggtctaaagcaaattccacaaaggttatcacaagttatgagataatttcaccagatcatttgtgtgtgtgtgtgtgtgtgcatgtgtatactttctcagttaatttgtgtgtttatggcagaggtaaggagggcatgtgatctttggtacacaaaccagtgaattgacaaacaacatgtaacacaaagcacctagatcaggagccgacatataaggaggactccattaatcctttgtttgaaaagcatgctgcaaggaagcctgagctatgagctaaactcaggaacaaatatctgactgagaaaaaaatgtttgtttcttcaaagggagaaattagtgagaaagaaattatgcagaaatgctaaacatgttgtgcctggataaacgcatgagaaatattttcaatttttttaaaatgctctatttatctgcatttaacaaccagtgaaatttcagcatatagaacttcactttacggccaggagcagtggctcacgcctgtaatcccagcactttggaaggccaaggcgaacggatcatgaggtcaggagatcgagaccatcctggccaacatggtgaaaccccatctctattaaaatacaaaataattagccgggcatgatggtgcatgcgtgtagtcccagctactcaggaggcaaaggtcagggactcgcttgaacccgggaggcggaggttgcagtgagccgagatcgcgccactacactccagcctggtgacaaagaaagactctgtctcaaaaaaaaaaaaaaaaaaaaaaagaacttcactttacaaaaataattttaaaatccttaaataaattttataattggtatttctgcaaaaatgcatttataaaagtgctagtttttctcaaaattgtttaccagtcaaatttgcttaacttctgctgggcaatgtcatgtaataaagaaaaccatgcttttcagtctatttcctcctaggtcagggtcaaagaaaacaaggtataattttatatactcacttcatttctgagaaaaaaattctcaatttttgctatatttggtatcattaactttaaaacattttataatatatgtatattttttataatatttcatatatatgtatatattttaaacatagagacgaggtttcactatgttgcctaggctggtcttgaattcctgggctcaagcaatcctcttaccttggcctcccaaagtgctgggattgcaggtggaagccaccacgcctggtggcttaagttaaatacttttcatcttcagtttgctatgcatattatgtagaaatatgatttacaagtaaatctccttaaatgaatttaagtagcccaaatctccatatattaaatatatgtattaaatgtataatatatgtgtatatttgaacgacatatatgtacatttgaaagacaataccaacactgaagcttttctagagaagaatagatttctttgaggaagaattcaatggcaaagatttctccaggatggaggtgagggtgggataaaaatgttcttttttgtccatacgctcactgaaattgttattgcaattcctgctgcgtgtcatgcactgggcttaaacttggaaaaatagctcctgccttcatgagaactaacggactggtggaagagaggtgtgaagaaatgagatggatttttatgagtggcttatggaacatgaaactgttaggctacataaggaacctgggagattatctagtccatccccttattttatggaatagggactgtaacccagaaaggttaagggatgtgccctggttagtggcaagtagagccaagaccaaaatcgagatcctcttgtaccccgtccaactgtccctagccaccttctgtcacatcttagactgaagaagaggaacaactgctgaagcctcagagcaaccctgtaaagacaatctgccttcaattgtttgcaagaaagtaccacacacacagcaggtcatcaaaatagggacccaaatgttgcttgcgttactaagaggaagggctcgaggaaagcctggatagatttacaactctgggcccaataacatgctagtaaaagggaagatatcagtgtatattgcctagacagtttaggtttcccccttagaattaagcctgccaccaaggactctcacctcctggcacaatcccaggtacacagggaaagctcaggaaacgatctgatgaatgaataaaatcagttgggcatttcttacactcttagattaagaacaagagaaaaagcacagtcatgattgatgccaaaaaacctgagatgagtatttcacttctagagcttgttatagtataattacaacttctacttgaaggcctggggtgggaggtaaagggttttgcacagatggtgtcgcaggggaaaagttcccttaagtacagattcaagtaagacaaaatccagacatccagaagggtttaattcatgaaacctatttcaagccagggaagagaggcgcagatggaagaatgataattatttcaaggaacaggcatttctgaaccttctataaaagtatgttcttactagtagttatatttaatatggtagtatctgacacaactactagagacaaaaaagatgcccaatagttctgatatcagaaatacccaggttaggaaaacaaggcttcaaaggcacaggttgttaaccctatgttgttgttgttattgttgttttgagacagagtgtcactctatcacccaggctggagtgcagtggtgccatcttggctcactgcaacctctgcctcccggtttcaagagattctcctgtcttagcctcccgagtagctaggattacagtcgtgtgccaccctgccccgctaatttttgtatttttagtagagacaggattttgccatgttggcaggctggtctccaactcctggcctcgagtgatccacctgcctcagcctcccaaagtgctgggattacaggcatgagccaccgcgcccagccctatgttaatttttataacttagatactttggaaaattttataactgactcaggtgacttactgacataacaaattctagtaggactatcatcagtcacttaggtagactgcccttgtcggtgtacaaaatgctgcattgggcgtactctcaagcagtgtactgtattactgaaagccacatagcaaccagatattgctcagcagattttattaatacctgaatcctaatctggaggagtttcagacttggagaggagctcttcccaagccacatctatgtgagtctttaaaacacttgcccctacttgagacattcacaggaggtaatggtggaaacactggtttcttccatttaatttagatttgatctttcagactaaacatctctcattattaactgtagagtctggaaaagggtggaacttagatgatagctttgttttcaaagtaaagcacatatcaacagagcagtttgtacaaggatattcaaaacagtattgtttataattgcaaaagattaaaaatgatcttaatgtccatcagtgggagatatggtccacccatttagagaaattctgtatgatgattccaatgtttcttagagatcgtccagaaggggaaaaacccaaaggacagaactgtattatgagcatgttactagttgtggttagaaaaggtggggcatgttatgcatgtgcagcaaatctccacagaagggcacacctgagaccggcaacagcgagcacctcggcagaagaaactgggtatcagggatgggagatcttccttttccttttctgtactattttaagttttcccacatgaatttatcatttaatgtaaaacataagtgaaaataaaaattttaaagcataaaacaaaaacatggccatgtaagcttcaaactcaatattttgttggtagagtgaaagaaagaagccccaaattatctgaaaaacaacaaatacagcttaggatataatcaagactgtcaaagctgagagtctgcttggtgcaacctctccttatggagatgaggaaaccaaaactcagagaaagtgaattttatcaaggtcataaaaccggtcggtatcctagaagccaggtgacttgtctcaacccaggaacccaccattcaccttgccactatgctccctctagttgtttaatttcaaaccatactgaaccatcattgacactggagctcatgagcttcacttgtggttgaggttccttaaaaccaccgcttttgacactgagggcagaggaggcctaaggcagagaaaaagagaaacaaagtcctcagcagagcatgggaaggcaaaacatctaaatttgtgatgaacaaaatactccttgggataatattccagaacattttagggagagaacaatagttccattaaaaaaaaaaaaaaaagagctaggcgaggtggcttacgtctgtaatcccagcactttgggaggtcgaggcagatggattgcctgaggtcaggagttcgagaccagcctggccaacacagtaaaaccccgtctctactaaaaatacaaaaaattatctgggcttgttggcaggtgcctataatcccagctactcgggaggctgaggagggagaatggcttgaacccgggacgtggaggttgcagtcacccgagatcacgccattgcactccagcctgagcaacaagagcgaaactccagcttaaaaaaaaagaaaagaaaaggcagagtattccaaatgcagtatctgaggccaagccggattaagggcagactgccacaaactgcctcaaaaaggctaaagacctcgtcagctctagaccgttgccagtccccccagaaaggaataacccaaacagaagatttctccatagaagcaggaatgcatcaaagctaaagcagggacatcttttttgtttttccttccaagagagtcagaatttaaatttagattcccatttatctttttctttttcattgttttcatctccttttccctttttcttttttttttttttaataattggctttctcttctgtgtttggaaattgataaaaccatgctctgcagatgtgtgaccagaaacatttaattggcattattcaatataaaggaaaaaatcacacacacacacacacacacaaaaccgccagtgccaaggcatctgagatacaaacacacttttgattcaatgactgtgtccttggtgaagcaaacagtcaacacgggaatggggcggggggtggggttatttacgtaggacatgaccctctggttagtgctgcctggggcaatatacacttggtcatttctacaaagctctaagtgtatgctcaaggcaagaaagtcgcccggactcaattctaagccagcacaagatttgctatataagaagcaaacatggaaaaggtaaaggcttcaatcctgaacttttgccttttgcaacaccaggaaacagagagccacagctcgtagagaaagtgcttttggcagcttccctaagccaggagctgcagacgatgagggaggccagtgaatcagaggctgcccagagcacctcctggaatgtttcacaaacgtctttttggcctcggcaggtttcagtggcttgctcttctatgtcctgggcttgcttccctcatttttaaaataggttttagttacacacatacacatatacaatgccaagtgaagaaaacaaaaccataagggtaggctcaactacgaaaaccatagcggacaggcctgcaaggggctggctctgagtagatcatggaaagaacagctggcgcccagtggctagaagtcacacctaagtgctaggaagacacagaaattacttggctcccttcaaatccttctcctcagttcacatgtgagtcttggaaggtgaagaagaatatcttcggctagtatgcgtttcttgttgtatctccctcctctctcctttcgacaacaaacttctcagtggaggtatctctactcttggcactttgaggtgaattttttagaatatgtggttttgttaatgtgtcagaggcacaattccatttaagtgaatgggtaaggcctccccaagccctccatgactttttccatccccagcacctatttcctaacagtacttcggttccaacaataatagggagttttcacaggctgtagactgtggttcattagtttactaaaaatgtaatttccacaaatccatattcatatgaacagataattaaacaaataaatggatgaaggagagacaaatctcccttacagaggaattcaaaatcatttatgtagacacaccatgctcaaaggccggggggatgggaggcaacataactgcaaatagtgagttcattccaaagaacacaggattgaatgagtggtggctgatgggagttggggggcaacattactgtgcaaaaacttggaagatactaccttggccaggtgatcaaggtcaacattaacagtgacaagtcatgataatggtgtgcacccttgatgtgatgtaattagaataacactttatatctgtagtcttcctccaaaaacctataactccagtctacctaagagaaaaatatcagacaaatttcaatagaaaggcatcttacaaaatacgaaagcaacactccttaaaactattgaggtcatcaaaaacaaggaaagtttaagaaactgtcacagccaaaaggagcctaaggagatatgatgagtaaaggtaatgggggctgagcgccatggctcacgcctgtaatgccagcactttgggaggccgaggcaggagaatcactggaagccaggagttcaagaccaacctaggcaacatagtgagaccctgtctctacaaaaaattttaaaaattagctgggcatggtggcatgcattcgtggtcccagctacttgggaggctggggcaggaggatcacttgagcccaggaggaagagactacaatgagccataatcatactattgcactccagcctgggcaacagagtgaaaccttgtctcaaaaaaacaaaaaacaaaaaacaaaacaaaacaaaacaaaaaggtaatttggtattctgtatgggactctggaacagaaaaagatattagataaaaactaaagaaatctgaataaagtatggatttaataataactggctcactaattataacaaatgtagcatattaatgtaatacactaacaacaggggaaactgggtgagtgagtgtataggaactctcttctcaattttaatataaaactaaaactggtttgaaaaacagcaaattttaacgtgcccagtgaataccaggaactttgctggctactctctttttaatagtcaatattaatttaatagtcaatggttggggtatgtacaaatggacacaatctttaagagaaaatctggtctataatgtgtcccaggggaataaatagatattaagctaaaactttttaaattgcttctagaagtgttccctggtctaataagactgggaaatgttgggctaaagaaagttaaaataatttattttattggaagatttgtcagtctttagagtaatagggggtaccaagactttctgaaagagatatatgaattcaacaactcgtttctcaaacttgcaaggctgatattcttctggataggaatactaggaaatgctggtccactgtaactcagtggatgtcttggcagagtactgaattataaattaaatatgaatgaatattatattaagtccctactgtgtgcttagctctttaaaattaattaaagaagctgtttaggacacggagccagagaagggaaaaaagcggacagggaatgttgaacaaagcagtttcatgtgcctagaatgagggactgctgttcaagatacagagtaatagaaaaacaaagcaaaacaaaatacaggaaaagcaagggttataaaagactgcttgaatatctgctgacattttccataagcacgtgatgatttaaaaagaaaatttcaaagatggcttaacttccgtatcagttttcacaggtagttagcaaagccttgctaaattaacttcagttacatatattccaaattatctatcttttagtttttttttttctttaaaaagcttgcttctataataaaaccacatcaactattccaaataacacttctaacatcatcctttaagagtagaacaggtaaagccggcacggtggctcaggcagtaatcccagcactttgggaggctgaggcgggcaaatcacctgaggtcgggagtttgagaccagcctgaccaacatggagaaaccccatctctattaaaaatacaaaattagctgggcatagtggtgcatgcctttaatcccagctactcgggagtctgcggcaggagaatcgtttgaacccaggaggcaggaggttgcggtgagccaagaccacgccattgctctccagcctgggcagcaagagtgaaacttcgtctccaaaaaaaaaagagtagaacaggtagaggctgacattgtttttaaaacttgaatgcagtctcttcaaaataggtaaatatgcaacattcaaaggcatacactgggtaatacacttgatatggcatctgggaaacttcctccttggaacaagtgtttaattcagtttgatatttgggccagtaagttcatataaacttcatcagaaacactttccaggaacctaaacccaacatgagaggggagcataaaagcttccaaaagttagaatgcaaagctttacaatcacctcattctcttcttctctgtcacagagggtgaccaattatcctggtttgcctgggactgaggggtttcccagaacacaggtcacagtgctaaatctgggaaagtcccaggcaaatgggatggtttttcactccaggcctatggccatccatagacctagggctaactcagggcagcagaactcaaatttcctatttccaccctaatgccttcccttaaaaagagaaccaggagccagtacaaaatgacctttcattattcagaactgtcaggctatccagattagctgtcagtgtgtcctccttggattaaaaattggtggttgtccttttgtatccatattatgtgataattggaatgggaatattacatactcattttgtctgtaatttttgaaggaaatcaagcactatttatgacatttattttatgactgcattatatcacccataaacatgcacttggttaaatgcaaaagtcaggaaaacctttcctgttggactcctggttgagccatacatctgaagtaaagctcttttaagaaacattgaactattctcttcctgtgatttgaactaactctcatgttcctggacttgtgctctttataaacaagacctgggaaagagcaaagtctccccctacccctcaggaccaatcacaatgatatggatcttcctttcttacaaaaatggaacaaaaataattttagtgcatttcaaatctgattaaggcacagagtaggcactaaatacattctccccaaagtaaggttaagggaggttagaaattggtaacaaaatatcagttccatttatagcaagatgatcatcataggctttttaaatttcaaatagaaacataatcaagatgagaactgagaaaaaaactggcaacgcctcacccataactcatcttctctagaggatgcattttaacccttacctctagagtttcataggggaatatccaaagggtaccacattctagttgctgcttcctcttacttccagagcatagttgcctgcttagccccatttcattctgagtttcacacatgatttacaaactcatcactttccccacagcactcattataggtgagggccatgtatttacccgagtttgtgctatcaccatagaaattcaggatagaagggtcttagtccatttagagcaatggttctcaaacttttctttagtagtagaatccttctccagagccaagtgtacggcttgaagcagaggctatccttatgtcccagggttctttcatcagctgaggaaattagcacttaaagtcagcacctttgactgtcttctctaaatcatcttggtcttgctttcactctgctttcccttcaggcatttctcaagtgtcatgctgaaactttaaacaaatgtttaaaacacattgaacagggcccagcttttggaaactgaacactaaggttagcttctgctcacatccccctgagattctagcatgggactttgggacagactttaaaaccaatgatttagactaattcagttattttagagatgaagaatattggaagattaaatgcctcagcccagatctcaggaacaggctgcgacaaacctaggaaacccggaacgcctgctagaatactacagctggcatcagctgcatggatcaccaattactgcccaatgatcaccaacggatcaccaatcactgcccaatcctttttcgtagtcatcaaaatatacgtgataagttaaatttggtgatgaggccaagtagtgtttccttttccctatttcatgaaaaagtctaacagactattttaattaacttatttactttaaaatgatgggatcaacgtgaatcgcatgttttgatgacaccatttgtgtgacctcactttatagaaatggtagagcattttgttcttcaatcctccaaaaaaaaaagacaaaaatcaaataaactttgaaaactcacatttcataatttagaaaggcttatatatgggaaggagaggtgctgccatcagccaatggtagaccttctggccatagaggctttgtgggaataatgatatgcaactgaaagaagcaagccaaaacatacaggtgtaaatcgtttctgacttatgtgcagacccagccacatcaagctttgaaaaatatttcagcatcaagagtgtctgggtgcagctgcgggtcttttcctctgtttatgcgccgtccatggcttaactcatgtgaactggccaacgtcaggtgtcacgcagccctgtctgatggaaaacatatgtctacagaggtaggaagaaaaacccagccacaatccagccttgactcagtcacgatacaatgaagggaaaaaaagggctgcagacgcgtctctcgccctccttgtgtctctctcagctcctgccaacaatgagccgcttgtttctcttatttcccagaaacagtattagccatccaacaaggtcagcaaaaaaaaagcagcttttcacttcagggtgcatttggttccaaaaatctgtaaagtattaaaccgagaagttgtactatcccaacttcacactgagccctttattccaattctgggtgagaataactgcaaggaaatttctcagccggctcagttgataaggcacagagctctggaatatatgttgattcagccacactttcccagcttcactgtttcaagccttaaaaccacttccaggtgccccaaagcttgccagatgggcctccggtcctccagatgccccaagcctgtctagttttagacttgtaacccaagcttcgtttacttcacaggaaaccctgaatttttagcaccaggaaatgattttcctacttgctatcctgcctgcccatccaaacaataatgtagtccacacaccagtgtgcaagtatctaggcaactctcctttttcaggtgtaaaatagaaatgcctgtaacactggcttttatattttcataataactgcattaccccaaatgtatattttattggcatttaaaggattcagacattagttctcatcattataatatatccagggaagtctagggaaaaaaaaaaatcacatctttctggcaggctgatttcttctggatcctttttcctgtaaagaaagaactctttcttccacctaaagcagcatcagaatgtgctactctgactccatttgattgcagggatatctcaagatttatcacaagtggcccgtggcaggaagcacctctatggagttagtgaatttagaaaaacaattatctagcctgtgaaaaagaggaaatttagttattcactttgctgcttcacaaagttgtccttgtgattttgaatataattccatggttgggcaatagcagtacaactacaactgttttgttatcttcagacaataggtatacttttatccagcaggaaatggaaactctgattcatgcatttatttttctttagtcagtagagagtttattgtagctttttattggttagctttcctgaatcattttaaaactactccaggtgcgaagtatggcagttgcccaagctaagagaaaacgaatctacagctgtgttccacacggaatggaagaaaagttgccagcgtgagttgctagtttttaatgtgtgcatgtgttttttaatagcatgcccttttagtaaacatctttattatggagatcatgtaacagatactaagattccaagaggtagtcaaaagacttgaacgattcataaaagagaacatgcaattagtaataaaatatggcaaattatcagcttcgtaaggaatcacactaatgcaaattaaagaaacagcctttttcagcaatcaaataagcaaaaacaatagtgtggtttaggtgctttgcattgggccaggaccactcaggaaaaaaaaaaaaaacgaaagaagaatgtaaccaggggtaacaggattaggaaatctggtagaagtatatgccaaattttggaaacctgtataaatatgcatttcattgaggactgtacccatatatcttataggatttctagtgacccccaaaaagttaattacctttgaaatgaaaaagtattagaatattaacagtggtggtgtttcgcttatagaactatagatgattttttttctttccaatgatctacggttcacctagctattcatttcccctgtttctaggaagtagagatacaatgatgaacaagacagcaaggtccctgccctgtaggagattatcgtctaacgaaaagacaggctataacaaatgtacagaataattttagtgataagggatttgaacaaagaaatgtggagctattttaggcagggaagttaagaaaggcctctgtgaagcagtgatgtgtgctctaaatctgaatgaagtatggaaatcagggtgggggacaagtacaaagatcctaaggtggaaactgtgagcttggagtacttgtgcaaaatcagagcagcccatgtggctgaggagcagagggtgaggggccgggaccaggtcccttgaggcctcttgcctgtggtgagcactgtggttggcctctattccagactgatagaaatctccttccagctgactgcctggactgcatgggaaactgccagattatttcacactctatggtaaaatttaaaattctgaagaaatccagagactctgggggcacacagtgaagtgagtcaaaaagtgtgaagcaggccgggtgcaggggctcatgcctgtaatcccagcactttgggaggccgaggtgggcagatcacaaggtcaggagttccagaccagccttgccaacatagtgaaaccccgtctctactaaaattacaaaaattagctgggtatggtggcacgcgcctgtagtcccagctacttgggaagctgaggcgggagaattgcttgaacccggaaggtggaggttgcagtgagccgagatcgcgccactgcactccagcctgggagacagagtgagatgccgtctcaaaaacaaacaaacaaacaaaccatgaaggaaagaggccactccttgggatcaatgcctctcggtttgttgtctctcagccctgtaaagtggttcaggatctttgggaaggaaaggaataaggtttggggcaaggatgggggaacagacagaaaccaaagcagctctgcttttaaacacttacaaagaggagattctgatcccaagcaaaacaaaataaaagcctgtagctctaaattttatttgagaaggtgtgtcaaaaggagcttccttcttaaaaatgaaaacaaaacatacaacaaaaaaactacagttctggattttctaaatgttatccttgaatcaaaatgcatatgtagtatacactcattttggtcttctgtgaacactggctggtgctctgagatcatgccactacccagtatttaaaaagactatagaaaacttccccataaaactcctagtgttccctactggaatcttctttttttttttttttttttttttttttgagacagagtttcactctgtcacccaggctggagtgcaatggcacggtctcagctcactgcaacctccgcctccctgattcaagcgattctcttacctcagcctcccaagtagttgagattacaggcgcccaccaccacgcccagctaatttttgtattttttaatagagatgggatttcaccatattggccaggctgatctcgaacgcctgacctcagctgatccgcccgcctgggcctcccaaagtgctgggattacaggcgtgagccactgtgccaggccactactgtaatttcttttttaaggacattgtcccctagatcacagagtctagatgacttacggggaagtacaggagaactccctcttacatctctgtgtctagaaaaactacatttctcttcaacaccatgaaagcctttatctcttgagtgatctgactcctataacagagcatattatcttctttacaagatcccccaggaatctcacagccaaatctgtaggtacctctagcaaccacacaaggccccatggtatgcattttttccctggctttttttctcagccacagtcctttaccccaacttaattcaattatttatttttatccttttgaattacatgttttggccaggcacagtggctcacccctgtaatcccaacactttgggaggctgaggcgggaggatcacctgaggtcaggagttcaagaccagcctggccaacatggtgaaaccccatctctactaaaaatacaaaaattagacaagcgtggcggtgtgtgcctgtagtctctgctactggggaggctgaggcacgagaatcacttggaccagggaggtggatgttgcagtgagcggagatcacgccattgcactccaacctgggtgacagagcaaggctccatctcaaaaaaaaaaaaaaaaaagaattatatgttttttaagatgcaagagtagggaacaaatgaatggaagcatcataatttcattttaaaactactcgtgtgtcagtcacagattgccctcaatgagaaacttgtaaacctgtgaatgggccccaagcagtacacctgccagtctaggactcagaatgaagtgaaggagaaatgggttttttgtggtcttgagtcacactgagacagtcaactgcttgtgactctaataaacatagcctaccttttgtaaataaattaaaaaaaaaacctacctgtgtgtatatagctgcacagatatattatgtgtcaaataaataatgttctgtgaagcttaactgagcaggttggaaattttacttgttagtcatcccgaggggaagagtttacatgattttaggccataccttatagagacctggtagaccaaaaagcctttccacatatttcattagctttacagaacatattcattagaggagccatttggcacaagcatgctctgctgcccccaccccaccttccatagacactaccttcatcaagtgatcaaagctaatgtcacctatagtggaacaaatcgtgtgcctcctgataggattcaatgagaagaacacaacatcacttccatggtattcctgccaaaaatttataacctaaaccaaaatcacgaagaaatgccggacaaatccaaatttaaaaatgattcacaaaataactggcctatatattcctcaaaaatgtcaaggtccagaacacaaggaccgaagacttgttccaaattagaagagattatggaaacaggacaactaaatgcaatgtgagatcctcaatcacatcctgggccagaaacaaaaatagccacaaaggacatcaccgggacaactgaagacatttcgaatctgggctattagataagagtattgtatcaatgttaaatttcctgattttgatacctacactgtgcttatataagaaaatgtccagctgggcacggtggctcacgcctgtattcccagcactttgggaggccaaggcaggcagatcacctgaggttaggagttccagaccagcctggccaacatggggaaaccccatctctactaaaaatacaaaaatttgccaggcgtagtggcacacacctgtagtcccagctacttgggaggctgcagcaggggaattgcttgaacccaggagatggaggtttcaatgagacgagatcatgccactgcactccagcctgggcaacagagcaagactccatctcaaaaaaaaaaaaaaaaaaaagaaaagaaaagaaaaaagaaaaaaagaaaaagtcttttgagaaaatataagtatttctgggtaaaggagaatgatgtctccaactttgtctcaaatggttcagaaaaaaaaatatgtagatagatagatagatggatagatggatagatgcaaccgtggctatgtttataagcaaacaattaacaaaggcagatctggggaaaaggtatatgggaattccttagactaaacttgaaactcttctgtaagtttacaattctttcaaaataaatagtgacatttaaaaaaataaaacctctctacacatacctcaaacctcctggagacagaattctcagtccggcagggaccagagaaactgtgttatgtatgggccattgttctgtggcactgttgaactttgaggaaactcctattaaacaatgcttttgataactgattggaatttggatggaacagaatcccagctgcaatctgtgctacataattctgatacctcatactcatagttccttccagcctcccacctctatccccaaccccaactgttaaatgattctaattttaaaacatagacagcctaggaagacaggacaaagagctaccccaacagaccggttggaggtctttcagaagaaacgccactggatagctgcccctgaggaccagacacccagaataggaaattgcaggttttcttgggaaggacctgggacaccaagagagttgactgtcaagcttgagatctgttgtgaaaggtccttacatcccagggtcagagctgagacattgctccatttaggtcttcttgataggaggaaaaatgagcaagctaagagtggaggatggagaaggcaccagtgaatgcaaacatatgaaatagggaatgcctcaggcgaaagccatctgattttaatatatcgtagtttcgacactgagattccctcaaattgcaggaaaaatataatgtgtacttaaaactagaggagacacagaggagaggagaaagcacaagcaaagaagacatgctgaggatcccagaagagaagtctcccaaggggcagccctaggctgcagtgacccaggcagaaatgatatagggaaggtgtccagaaacctccagcatggagccgccctgagcatttgttttgttaggatgggatgatccaattccatttggagagaaattatagttccattctaattaattcaggcattacagcagttgatacggcagaaattaagagaatatttttcttgacatttgaagtgtgagctttgaagcagctaaatgaaggccttgtgaaccaagactaaatcagccacattaatttttttttaactttctttctttccagcgctgcaaatatttaagtcttggcaaaattcaaaactcacaactcactcttcactggtatctgagaaatataatactgaaaaggaaaaggacgaaaataatatggaatgaaatgcatgacatgtactgggaagcaaaataacttccaacgaaacttccatttatggcttagtcaaaaacatatggatatacaagctgaaaaacagagttagtgggaaagctaggtggctggttaaaaatacactttttgtggtaatgttacattattttttaaaagaaagtaacacccccccccgcaaaaaatcccctgctccaggatctttagacaattccttagtttgataaaagcaaaccatgtcaaaattgtattttttaagaaatgtttatattttattcagaaacattccaaagaaactggaaaagtgaggaaattaaaggtgggcacaaaaatgtatgtgtgtgcaagaaaatgtattgaaacatcatttataatgataaaaaatagaatcaacctatatgtctctcaatagaagaattggttaaataaattatggcattattggttaaataaattcacaaaaggactactgtgcagccattaacatgatgtgatggtttatgaacaaaagaagtatgtccaagtctattcataagttaaaaaaaaagaacatactgagaatctagtttgtagctatcagaatagtaaaggctataagtttaatcatagatattattggccagggtacggggaagaaaacacactttattggtaggggtgtcaattggtatacctttttggaaagaaatggaacaacagttttaaaaactttaaatgtacatactctttgatccaggaattccacttctgcaaaattatcctatacataaacagcatatggcacaaggatttatgtccaaggctgcacactgtggcattgtttagtaatagtgaccaaccagaaaataaactaaatatccagcacacaggactggttaaaccaagtacagtatctcaacggagtggaacattacatattgctgacaaacaatgaacaaatcagtaagtactaatttggaaggctctctaagatatgttaagttttaaaaagacatactgtatatgcccaagcatgcatgtgtatgtagagcatgtctagaataatgctcaggaagctggtagtagtgtttccctggaaaggagaaaagggctgggggtcatggtgggaaggagacctaatttttcataaataccctttggaactatttggattttttgccatatgcgtgtgttacttttctaattaaaacaactcatcaaaaaatattatagaaaaatatttactggccaggcgcagttgcttacacctgtaatcccaacactttgggggccgaggcgggcggatcacctgaggtcaggagttcaagaccggcctcgccaacatggtgaaaccctgtctctactaaaaatacaaaaattagccgggcatggtggcgtgtgcctgtagtcccagctactcaggaggctgaagcaggagaatggcttgaacctgggaggcagaggttgcagtgagccgaggtcttgccactgcactccagcctgggcgacagaacgagattctgtctcaaaaaaaaaaaaaaattactgaaatgggaagatgctcatggtatattaaaaacaagctacaaaaaagaatatagaggagtttccaactatttttatgtttgcattgaagaaagtcaagaaaatatatgaaaacacactagtgtcattttgaatggtaccatggctttttattttctcatgttttgccaatcagcattttctacagtgaccaaatagcaattatgtaatatggaaaaaaataacattcttgaatcttgctgcttcaaaaatgtttagaaccttttttttttctgccttaaaatacagacacacacacacacacacacacacacacacacacacacacacacacaaagggggaggggtgatcttctttttagcacttaaggagaaagacaatcaaggcttttgttttcctgaggcttcacttaaatgatattgttttgctgacttcatcctggagaactattcagaataaagcatggaagaacagctgttcttgaccaccagcaactgcaaaacacccagggaataaatttagacttccagaaaggaagaagaaatcaatcagttggtacctgggtgggagaggtgatgatcacacacaggcgggagcaatattaccagggacgccaaagaggagatcaaagagaagtgtcaaaatatcactcagcacttatcaatttggaacaagtggctgaatgacaaaccacctcgaatcccactgcctgcctttcacccttaactgggtgaaattctccatagcaaggaagctcctgagggcaaacttttggaagtcagccagcaaacaggatgaaaattgtcaaaattatttttaaaactctcaacagaggtctacagctcggtgaagaaattagactccattacaaattaattaattaactaattaattaatgtggtgcaaacaaagaaaggactaaaaaagaaaacaagtttgacctagccttcaccttcctaaaaggcctccctcttccccaggtgtgggggtgcttctctggaattcgtcacggtttaggcttacgaaggcctgatggattctcaggcccactctctgcaagcaaaactgaagcagacttgtacatttacccagtggattaaacaatacatttcaagaatctggatcccaagctataattttcctcctcatttttgaagtttacttggaatatttggggtcaagatgctctgggaagccgcttcagcattcacttacccaatgctcatgtgcgcactaacaccaagcaccaaaatgacaaaagtcaatgccctagtaaatgtctatttcagacaaagaatcagttaaaaagttggtgggcatactccaagtccttttcagataaattaaagactgaacgattgagtaggttcttgtatttttattatactggcattttcccatcactgtgctaacgtacacaattctttttttgttttgttttgttttgctttgctttgaggcggagtctggctctgtcacccaggctgcagtgcagcagctccatcttggctcactgcaacctccacctcctgggttcaagcgattctccttcctgagcctcccaagtagctgggactacaggtgtgtgccaccacacctggctaatttttttgtgtttttggtggagacggggtttcgccatgttggccaggctggtctcaaactcctgacctcaggtgatctgcccgccttggcctcccaaagcgctgggattacaggtgtgagacactgcacttggccttaacatacacaatttgattgtggctcccacacctggctgatgatcagagtcatctgagcactcgaaaacagcatacctttccagattccaccctacatttactgacacagaaatttccagggcatattcctcctagcagcagcccaggataattcttttgggagcaaacaaaccactgtattctaaaaatgtatgtttaacaaatgcccccaagtgatccagctagtggtagatctggaccacgcttggataaacactgatcttagagactagtgaataatctatttgccacaggcagacttgctcaactgcagaggcctgagcattcttggttttgtctttaatacacatggggcctggagccttttttccaacacactgttctcctcttccaccacaaaaagctcaaggttctcccctgttgttctcactctttttttttttttttctccttttggctattacaaaagtaatataaccgcattacagagaaaatagagggaatcacccttaactcaaaggcttaactataatcactattaacatttaaaaatacataactgacttactcaacacatttattctacagaagagtacacctatgatgcctaatgagctttgcttggggctagaaatacacagatggagatcaagttcctgtcctcaagaagcttagtcttgtgaaaaaatggaaagaatctaagcaatgtgtttttcaaaaaaatagaagtataattatagcataaacaatttgtcatgctgtgtaaaattagaatgttacaacaaagttttccatgtgtctacatggtctatatccattatttcactgcttataaatatatttgtggctaggcgcagtggctcaagcctgtaatcccagcacttactttgggaagctgaggcaggtgggtcacttgaggttaggtgtttgagactcacctggccaacgtggtgaaaacctacctctactaaaaagtacaaaaattggctgggtgtggtggtgggcacctataatcccagatactcgggggctgagctgggaggatggcttgaacctgggaggcagaggttgcagtgagccgagatcacaccactgcgctccagccagggcaacggaccaagattgcatctcagaaaataaataaataaataaatttatttattttcatatttcaggcatttgtttatttactggctattataactaacacatctttgtgtatggttcccaaaatattcacctagcatactactttttttttttaaggaaaattgtggcatcagacatttttcatggcttttattatttcttatcaaagaagaaattttctacctaaatttctaaatttcatataataaaacctataagtctccatcacctaatcttaataaagactcatccacattaagataagtggaacatagccatgaaaacataagatttattttttatatgctattatgtcctgctttattacataaaaggaactcaatccgttgatttggtaatttttttcagtctcatttcacatattccttaaaaaccgtaaaagaaaggaactataaagaatgtccttttcaggccgggtgctcgtgcctgtaatcccagcactttgggaggctgaggtgggcggatcacctgaggtcaggagtttgagaccagcctgaccaacacagagaaaccccgtctctactaaaaatacaaaattagccaggcatggtggcacatgcctgtaatcccagctacttgggaggctgaggcaggagaattgcttgaacccgggaggtggaggttgtggggaggtggaggttgcggtgagctgagattgtgccattgcactccagcctgagcaacaagagcgaaactctgtctcaaaaaaaaaaaaaaaaaaaagaatctcctcttcgaaaccccaaagaaggtagccttcaataatgctgattaactagagtgtatttgacaatagatagcttcctcaaaatctaagaaaattgagggcacagtggctcacacctgtaatcccagcattttgggaggccaaggtgggaggatcacttgagactaagagttcgagaccagcctaagcaacatggtgagacgccccaatctctacaaaataaaaagaaaattgattttctacagtgtttagaaaacttttccttcttttttttaatcaagaaaatcatttttaaatagaaacctttccccctgtcctgtgcccaccagtgttccttttcttccataaacacaaactttccaccacaacaatcctacaacacctacaacacccacaacacccaacacttcacttccaccatctcccaaaaagtgtatgggtatttttttgtttgtttgtctctgggtttgtgcgtgtatgtgccggtgcactttaggctaatctatgctgcataaaccacaaagttccaaaagcagtgagaacatcagagctggaaaaatcacagtagccagatgtgtctgccgtgaactcaccatgtaaatttgattaagaaaaaaactaatggaaaaaaaggaaaacataagatgcctaagtagaaatctgacttctagtgaactttcagcatgtctttccaagtgctttaagcaacccagggcttcgatatcccttagctattttatttgctcttgatacaatgctaagcctctttgtatacttcctagagagaacagcaagccaacttagcaaactgagcacagacaagattttccatcttgtcttgaaaagtatgccctgaaaagaaaaaaaaaaaaaaacacacatgtgtttataatttgaagtacagctcgagacacagacctggaggacttagactctgggctggtggatggcacatcttcaaaggggtaagtaagtgcgtgtgtgtgcatgtgtgtatatgtaactttaaaaatttcctatagtattgaaaatacactctagttgcactttaccaaaagtttctgaattggctagggttcgcaggctggtgaagttgttatagtctttattttttcctgtactgtcaggaaggatactagcatctcaggtcagggtctcattccaacaaaaagcctcattagtgtgtgacagcagctcagcacaccatggtttatgatcactaggattatcaccaaaaaggcaaaaaaaaaaagaaaggaaaaaagcatgacactttcttttggtaaaaacattttaaaatatggagctactttaagttgttgcatgttttcagtatttgtctgctgaggaatgggaaaatctaacacttcactacttgcagaggggaaaatgttcttcacttagaactcagaagtgtgactgctcttcacaaactccctctgtgaatgacctgacagtcacaagcttgctcctcttcatcttctcacaattgctgtccgaggttaaatgttattttttggtaccacaccagctagtttcacaatttgtaagcaaaagtgcccaaacaaatataagttgcagtaaccatggttgggtcttcctgaaggaggaatggaatggctttctaacagagcatatcaaaggatcttcctctgattacacaggagccagaaaggggaggaaaaatgaggcaactggctaacaataatagctataacaatacaagtgctggcagcttactatacatcaggtaccaagacatggactacctaaatactcaaaacaacgttatcagataggtactatcattatcaccattttacagataaggaaaatgagactcagaggttaaataacccaatacataaacgtctaaattaagagaaactcagttctgacttcaagttcttccaaaacagtccccaccctccatcccacttccatgcccacttcgccaccactctaaccaaggactaagatctgcagcaggcttcattttctcaagcccattgttttatacattataacagagcctgtgtaggcagtctatttttttccctcttttgtttccctcttattctcttttttaaaattttagtaagtattaatagtaaggaaggcccacaacctacttaaaacatacaaacttctggctgggtgcagtggctcacgcctgtaatcccagcactttgggaggctgagatgggcggattgcctgaggtcaggagttcgagaccaccctggccaacatggtgaaaccccatctctactaaaaatacaaaaattagctgggtgtggtggcgggcgcctgtaatcccagctactccagaggctgaggcaggataattgcttgaacctgggaggtggaggttgcagtgagccaagtctaaagtcccccaaggtcgtcttttcttcttccatttattgcatatgtctgggaattcaggcttaaaggccattactctgctcagacagaatccaaattggtaaagcctgatttggcaaatacaaaaactaaaattttagttttaagctagacgaaactggagatggctatttgaattaaagtgcaaaaaaaaaaaaaaaaaaaaaaaaaaaaaaaaaaaaaccatatttttgcaattttccccttcagagcttatttcattttacttagactcagtgttcaacaaatctgccaacctgcagaaagaatcctctgtttttacaaagtcactcactccaggatgactaagtaatgggtctttcctcttgcaataaaaatatggtttgatttacaagtcgcattacaggaatacatctaaagctctttttgttgttgtttttgttgttgagacggagtctcgctctgtcgcccaggctggagtgcagtggcgcaatctcggctcactgcaagctccgcctcccgggttcacgccattctcctgcctcagcctcccgagcagctgggactacaggcgcccgccaccacacccagctaattttttgcatttttagtagagacggggtttcaccgtgttagccatcacggtctcgatctcctgacctcgtgatcctcccacctcggtctcccaaagtgctgggattacaggtgtgagccaccgcgcccggcatctaaagctcttataaaaaataaggtgtctagtgataagaagtttctcctgggagaggtaacttaaacatttccaccagagggcactatcctcactgaaggtaatgaatacattgttcctaatttaaaacactttgcaatctaaccagcccaaaataaatcatttttattctagaaagcacttataaagaacagttaaattgtcttaaaatataacatgctatagttaaataaaatataaaatattttttgccataaaaataatgataataaacatatattttagcttactatgtggcaatcatagttctaagcactttgcatatataaactcgtaagttcctcatatattaataatccccattgtacatatgatgaaatcaaagcacagacaaataacttaagggtcaccaaactagtaactacagagccaggattcaaattctggcagtcagacacccaagtccatgtacctaacctacagaaacatacagggaccaaatacaagatttgtttctgaatgtagttaactatgccactgattatatcacggctctagaaataaataaaattagttataaaaggtactattctatcatctgatagtaatgctattaactgtattttgacatccttttcacatgtatataaatgccttgcattaaagaagacctatcactttagttcacttatttgacagctacattccattgaaaagtaccaaagttctagatttaagaagaaggaagagtgggaggagaagaatctgctcttttctttttctagtttttaagagttgggggtctcactatgttgcccaggctggcctcaaactcctatgcccaagagatcctcccacctcagagccttccaagtagctgggactacagggatgcacctctacacccagctctgctctttttatttttatatgtttaaagatatataataaagactatgaaccacaggcagagttatggcttgaaatgaaatagtctgagtaaatcatttattattctgactgtattgagactctctaaattaagtcctggtctttggaacttacttggcattccaagttgtatttccatccttcagacacatctgtgattctccataagctagaaacacactttgcaatgggcaaatacacaaatattgttggaaaaaccccagaatgtgcgtcttgagaaattcactgccttattagaaatctggaaactgctgggtgccgggtctcacgcctgtagtcccagcgctttgggaggctgaggcaagcggatcgccaggggtcaggagttcgggaccaacttggccaacatggtgaaatcccgtctctactaaaaatacaaaaattagctgggcgtgatgatacatgcacatagtcccagctactggggaagctgaggcatgagaattgcttgaaccaggaggcagaggttgcagtgagctgagatcgtgccactgcactccagcccggatgacagggtgagcctctttctcaaaataataataataataataataataataataataacaaaaattaaataaaaatagaaatctggaaactaaggtattttactgagctacaggtaaatttgtttcagaatgttcagattacaacttctttagatatactttactagtgcaattggactttgtgtgtgtgtgtgcatatgcatgcatgtatgcacatacaggcagactcacatgtgccttcaatatctagttccaagcattcaagcttcttttaattagtccacttcctacatatcgcacaaattttaaaaattaaggagaatgcataaaagaacatgacaaaggatatccactccagtatttgtatgctagcaacacactagtaacaacctaaatatctaccagataggagttagttaaataaactaattatagcatattaatatagtagactaataggcaaatttttaaaagaatgaagcagctctatatgtatggacaggcaggtgaaaaaagcaagatacagaacagtggttatgatatgctaaccttagtatgattaaacatacacacacacacaactagaaacactggttggctccaggaaacaaacttggggactgaggaaagggagattggaggaagtgtttgaatttttttttcttttcttttttttttttttttttttttgtaaactgggttcatgaaagatttttttccgattataattgattacaaagttaaagttaaaactttaataatcagtttttagaattttcgatgaaaattaaatggttaaacaaactgtaaaaaccagtctaatgccacctaatttggggtctctttactacagtggcatctgatttctacacgagctcctgtatatttgggacaaaataactcactggaggctttggtttaccactgctggtaccagaactggttgcattttctttgatctgccctttagataaggaactccacagaggttgttccatgtcatttgctttttggaaactgtacatctgcaagctttaaagcagtaggttcagacttcctggaagaactgacacttgaagctgactagggtctacttgagttcatactcactttggctaagccacagtatgagggaagggtgtccaggaataacgcttccatttttatcttgttcattcctgaaaatccaacaggagattcttttcactccctaaaattaactgttctgtgtataaagcatatctggatatctgatcttaaatggaaatgttatctgaaaatggcaccaacttttctaaaactttaaaattggcccttttttatttttagccctgggggagaaggaagggaatgattaccaaaaaagctgactggttccgttgctgcagtgtattaattcactggtgattatctctagtggggataattttagcagaaaatattctcttctcaagtctaaaatcgcacttattaagtattgtaaatgaagtaaaaagtgagccatattatcccacggcaggtatggggagaagccacctgcaggttatgtaatggttaactcccttctaaaatcagactagcctgctctccagctctgctctccacaagctgcaagactttcggaaagtttcttcatgtataaactggagagcctgctactttttgcaggggttttggaaggctttcataaggtaaggcatggaagcacttggcatgctatctgacacatgttatgcagcaattatgaaaaaaaaaggaaaaaagggaaataaggatagggatttgagactagaattgtacctgtaggcagtcgccaggagccaaagtcacccaaagcgtgtatgtgtcctacttgcctcaggctagatgaagacaggaggcctaactgatttttctaccccaattaaggccattggagggaaggtcagaactgtagtttaaaactgaggcagcagtatcatgagttggtggtaaagagaccaagtaaagaagaaaaagccggcagaagggtaacacggtattgcagccaagaagaaggagcaaacaccgtctgggtgcatgaagagacatagaaacagccagaaccacttatgagccccgccaccccttgattgaacaccatttcttcagcttggagtcaaagcttggggctccaccaggcacagtggttcatgcctgttatcgcagcactttgggagactgaggtgttaggattgtttgagcccacgagttcaacaccagcctgggcaacaaagggagaccccaactctacaaaaaaaaaatatcttttttaattttaaaaaagcttgaggcttaccgagatttggctgggatactgccatggacctctgaggcactggtgtggaactgacggcagggtggaggttcatatgattcagaggctgattcatcgccttcctagggtcttgccatgtggtgattttttctatgtgactaaaagaaggaaaacaattaattatctttttaattgtcagcatcattatcatcatcaccaacaacagcataatagttaatgacactaattcttcccttaggatctgcttgagtggttgatagattgtgcttggtttcatccaaggacatacttgcctatttttccctgcatcctggttaggccacactggggattctgcaagcagctctctaaacacaagcccaagacatcgctgtccagacagcccttgcatgcagtgagccccagtgaacttcccctcggcccgtggagcttgtattccccagcacctcagttgcttctcagccatccaatcactggagtgccatagtgtgagctccttcctggaaggggagccatgctcaccttcccagccagtaccccatactctcctgactcatagaattgacataatgaggatccctttggctgtcatcaagcaaaagatgggcccatgaaaccagcttctgaacaccacattagtgagctctcacagtaggagtgtaaggtatttcaaggtccccaaaggtgacacataaaaccctcaagaagctcactgtcaccaagcaaggtgacaatagggtagctggaaggcagagtattagaaaataatagtaggaaagtcaactagtgccagcttatggagaaacttagatattgaggcatgaaggtttacaagggagaagacatgattacatgtttgatcacatacaacttccagtttgttactgtgacttaatcacagagaaactaacccaacatgaaacatgagcttctgctcagagtttccagtacattctaagaaaggtggacatggcctccagctttgcctaccaccttccaaatcacattgcaggtcactcctggtaccttagagactctgtcccactccatcaaactcttcctttagtgaaagtttgtgatatatatatatatatgatgagtagattcatcccgttcctctactttgttttataaacagtatcagaaatcttccttctcctccttctccttcttttttgttttttcgagacatgatcttgctctgttacccaggctggagtacagtggcataatcatggcccattgcagccccgacatcctgggctgaagcaatcttcccaccttggcctactgagtacctgggaccacaggcacctgcgaccacacctggctcattttttttaaaaaattttttttgtagaggtgggtgtctccttatgttgcccaggctggtctcgaactcctgagctcaagtgatcctcccacctcagtctcccaaagtgctgggattacaggcacaagccaccgcacccagcccagtatcagagatctttccatatccatcaaagacaacaaacatgatagaagaaactgaatgttagccctttgttttgggcctcacaaccaggtgggtctcttccagtcaggcccccaccattgaccttccttagacatacaacaaaaggagcatgattgttgtttctgttaaacacacctcacttttgaataacaatggcctcctttgaatctttaaggtaggaaaccacttttactttcgttatgtttaatcagtctagaaacttccttgcattgaagttgtatttgtcttgttttcttttcagtctgtctcctcatttttaaatgcttcctctgctaaaattgttattcagatttcttaatgcaagacttgaaggtattgccaaggggaactcatccattgccttgcgtgaaaacttgggtctaaaggtctaaggttttagaataaatgtgattaaaaaaaaaaaaaaaaaggccgggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccgggaggtggaggttgcagtgagttgggatcatgccactgcactccagcctaggcagcagagtgagactccatcccccccaaaaaaaaaagatggggaaatactgaagtaaagagatgaaaatcatttccctaagtataaagtaaataataataaaaacaatagttttagtttacactttcagtttcacaattgtagttctgtttaaagctttcataaaatccatcaacttctgggcaggtggaaactcatagccagcctcaggcttgtcacaggccttccaagtgaggaactaattgatgaggatgtcaaaattaagtaactccctttagcaaaataattagacctaagaaatgctttgattattccttcagaactcattctattaaagcagcatgttttccaaggcagacatgtgctacataaatagttttcactctggtaccagaaggaaaagaatccttctctctttcataaacctttcttagactctctgacatcatggatattgatgctgtgctagaaccaacatcagcacaggccccggtgagatgtggaaatatacatcatttgctggaagatgttcaaggacacttccgtggtcagaatttcagctaccagctctaggaataatacaggagctggaatgatgcattcctaaatgctcgtcccccactctcccctcccgttctgaacaagtgggctgtggctcctgaatgcggcaagagcaggaacatctagcataggaagcccagcatctgaagtggcagatgagctcatcttgccccaggagtgccagcacagcttgccagcctaaatcccctgggacagagtgtggggccttctgggtggacctcatcctgacagttctgaccgagcttacccatggcttgaagtcccagcactcctgcagtgcagtgggagcctccacggcccacccttcaaactccacacccagccaacacatttaaaggagttttgttcccagtggatttgttaattaaaagtgtcactcacagcattccccaaaggctggagtacaagagggagcctttcttaagtgagcagttctcattgctccaaaacaactctgagaagaaagcccaaattcctggctctgcagaccagtcgacctgacatcagctgtaaggctgcgctaacatggtgtcaagagtggctcccaggctgaatgcaacaagtaagagtgagctattgctcacaagaggcacttaatacagccttgatgatttcatctgaaaactaaattctcctattgttctaatcacttagtgcctcaggctccagctccccctacttcccaccacttcccaaacccaggatacgccattcactctttcactctgctgtctcatctctgctccctctctcaatgttactgagtcatttcctttctcgtatttcacagtgtaatctcagtgtttgccaggacccacaatttagctagattaatccccacttccccgctactcccacctccttcctggcttcactcccttgcttagtctacttcaagaaaaactctctgctgttttaaaagtataacttcccttggaaatgcacacacatatacaaatatatttaacctgcctatatatgtgtattgtataaatacatacactgtacaggtttcatatttgaaaatggaacaaaaaaggaaaaagaaacatatcaaactatttatggtgatatatgcaaataacaggctcactggtaattttttttttcttatctaaactgctttgtactttccagatttttagcagtgattatgtattgttttcacaaccagtaaaaacaaaaatactaatgaaggtacaaaaagacaaaaaagaaaattgatgcatgaatacacaggtcataaggtataagcagcactttgggaggccgaggtgggcagatcacctgaggttgggagttcgagaccagcctgaccaacatggagaagccctgtctctactaaaaatacaaaattagccggctgtggtggcacatgcctgtaatcccagctactcaggaggctgaggcaggagaattgcttgaacccaggaggcggagattgtggtgagccgagatcgcaccattgcactccagcctgggcaacaagagagaaactcagtctcaaagaacaaacaaacaaacaaacaaaaagagttcctgaagataaactacacttttggctcctatcttcgtgtggctcaaatcaggggacaaatggaatcaatcacctgatcccatgctgtttataaagaaaaagaatagcagttcctacggggaagaaaagcttttcttgacagtaaacatttttttcctcgacttaaaaaaaagaaaaatcctctacaagtgcttcccatggagagccctggtggtatgtggggttaacggtacctgtaacaaatataagcgggagtgggctttttccccttccttcaagagccccttggaccactacttcccagacagcctccttctctcagtcccagaaagaccaaccaattcctggcctccaattacattatgagtctctgcttagagaactgcccaggttggacaaaagcatggagtttgctaaggggcaagaaaggtcaccacgtctctgagaagatatttggctggaaatggtaggttatgaaaaaccatgtcgtgtgaaatcagttttccctcatggattaatattttcctccagaaagacgcaaatgtagaaagccattttatttaacaggtaaattgtgtgtttggggttaaaatgttttgaaattggtggggtggcactcccaccctccaagtcaccctcccctcagactggcctccccatcagcctgcggagggggtgttaactttgctccagtttcctcctctcaagccactgctacctccttctacctccttcatgacctttcaccttgatgagggcaatggcctctgggcttcccttctgccaatctttctggttttcctcccttcctccttccctccccccaccctctctgcctgacaatccattcactatctcacctccaggcacatatcccaaggacacctggtatccaagtccccctgggtcaccatggcccatgaaataacagcacaactcacataggcatctcccagacacagcagcctactgccagactctgtgggctctgcaaagaccacacgcagttgtggagtcacatatacctgggtgcccgggtttaatattagctctgaccctgtgtgatctaattggatatcctagtcacactacccatatgcatgagacaggggtaaaaaagctaacaatatactggttcctcactgtgaggataaagcaggtctgttctgggaatattatgaccaccaaagtcacttacagatttcatggccagttctcctggcttcccaaactcactcagcagtgagtgcagagaaggcagctctggccttccaaggttggcaacacttggttcaagttttttcaacaaccatagatcgtatacctattatgcatgatgggtgatgtactggttaggtgtaaaaatcaaaaacattgtgcaaacatagtaaaggcaaagataaaaatcttatctgtaaaaatagaataatcaggccgggcacagtggcctgtaatcccagcactttgggaggccgaggcgggtggatcacctgaggtcgggagttagagactagcctggcgaacatggagaaaccctgtctctactaaaaatacaaaattagacaggcatggtggtgctactcgggaggcagaggcaagagaaacacttgaaccggggaggcggaggttgcagtgagctgagagagcgccattattgcactccagcctgggcaacaagagtgaaactccatctcaaaaaaaataaaataaaatagaatcctccagcttcttaccacccaggaaaaggcctggtgtttttggatgaatttacccacactaactttatgatgaaggaagccgtataacaaggactttctgaaatagagaatcccatgtaatgtattttgtattgctggaagcatacaaagatataaaaataggaatgattacaagtgcttcattttgaaagaatttaaaactattagcagcatgttgcttatttctatgggcaaagattttgtcttcaaacataagtgttttgtcttttttctgcccaccatttatttaataaatgagagtttcatacagtgtcagacatcagggctcccctccatcagcagagtggttaggacgggacctggaagcagcctccaaactgcctcttcttttgccacaacctagctgagcagttaaagagaaccacaccaatgagatgagaatttaaagacagcctggggtcataaaaccaaggcagactggtttaaaactcaatcatactcactgctccctgtcttcatcccctcagtgaaattcctctgtagcctctgtccttactacctccttttttctcttccagtagaatacaagctcttccagaagaaatgttccacagataatgctagccaggtgtggtggctcacacctgtaatcttagcactctgggaggctgaggcgggaggactgcttgagccccagagttggagaccagcttgggcaacataaaaagaccctagctcttaaaaaacaaaaaagaaaaaaagctgccaagcctatgatatttacaatccccatttaagtataagcaaactgtcttatttcagaaaatcagatttttaaaacttttttgatttactaggccaattcaccatcctcttaatgttaaaacaaatgtacatactgaagacaattagcttaaaatttgctaaatgaaacagctttgcaacttgcttcttgtgactcagtccaattagacccactagtgttaaaaatggaaactgaaacagatttggatgaggttgataaattcccagatagggcctgccaagtaaatctgacccactgtcagtagacaacaaatgctatgccaatttttaatcctgtaccagatggcaaggagtcttgccgaagacttatattaaacttttaaaattttcctcaactggaattagaatacaagtatgcaaaaggtggtttactttctcgttgtatgttggggataaatactgtttgcatttaaatcaaattaaacattctattagtgtgatcttatttagatttcaagacctaggaaatgacatatatcttactcatatcttacatttcttttagtagtaccttttgttttgccaacggtacttagctctgctaaccaacaccagagatgagtcttaaccacaagaacaaagacaggggtggtatgcacacttactaattctcccaggcccagatgcacactttctccaggtagtccctctgctgtcacctaaaaccacaatgcaatgggagctgagcacagtggaagcccattgcagtgggagcccattgcaggagaaaccccagggagctcatcacagaagggaggccacatcacagagggagcccatgacagtagaagccccatcgcagtggatgctcagctcaccacccacatctaaactagcaacccgacctgatcatgtttgtaatactaagattaggttttttgtttgtttgtttgtttttgagacggagtttcgctcttgtcacccaggctggagtgcaatggtgcgatctcagctccctgcagcctctgccttccggttcaggcaattctcctcctttagcctcccaagtagctgggattataggcgtgtgccaccacacctggctaacttttgtatttttagtagagatggggtttcaccatattggccaggctgatctaaactcttgacctcaggccatccacccgcctcaggctcccaaagtgctgggattataggcgtgagccaccgcgcctggcgacaatattaagattagtagccatccagtacattgatctcctctgcttaacgttatcagtctatttgcataatgtggagtcggcttttgaacttcgatatgttgacaatcagaaataaagtaatagctcttcacatggttgaagagatacatagcttaggttttactgtatttctagaaaccctaatcaatcttcctcccacgttgtcattctttctaccaccctaattaataattctttgtcccaaggcagcttttaaaacactattattggttataatgattcttccattctgcccaaatcctaaacggcaccatctcctgctatttttaatgcatcagaatagaagatacaaagaggtaaaagtcaagctgccaatgtgcacagctgacacatctattagcaaagcattcagagtttaaaccccaaagctattaaaaaaaaaaaaagactcatgccatataataaaggtgactcttcacacagcagaaatgtgttagatgagaaagttcatccttctttgaaaccacaaagaatttatagttgaaagtttccggtcagattttcacttaagcagctcatcaaacatagctgcagtctatgacacagaaataataactgatatataaataggggatttttttaggatcctctaataaaagatgatacaagaccagagaagttatttcagtgtatggttccggtctctaccattcacttgccaattcaaaaaatttcagcattctctggaattctgaatgaatggcagggattgtatttttaactaccaggctctaatcctcgacttccctcacagacttgccaagaagtttccacttgtttaagttagcagcagtaggcacagcagccatgtgaaaggtctcctagtgcctctgccctggccagctgtggtgatccatctccctcacgtccttcccactgagcaccaccgacttttctgcagactcattctgtctgaacctactcagtcaggcagaagctgagtcaagcaaagctgctgtcagccccaaagagcagatgagccaaatcaggactgtaatacccgtggttcctgcagggattcatttaccagagttttgtccctggggtgggaaaaaaaagtggcactgtgaagtgccacttcccagagaaaaccactttggaaggctggtgactcatcaagacagccccaggtgtgactcaggagcctcacttcagaaggtgaacagttcagtcactgtgttagagacaccccgtcatatgctgcacgcaccccaacagcacccggccctggcaagcctcactttgcctctgcaaactgagcaaaattcttgcttaacctcatttttcctattttgtgaaaacataagaaggaaaaaaaaaaaaggactgggagtttctgttgcttgtttgatttgggccaagagccatattaaagaactttggctgcgttgcaaacaattttattattagtaccagcatttttttttctcctctcatgccaggatcaataatgctattaaaaaatgtatagtccagacacagtggctcacgcctgtaatcctagcactttgggaggctgaggcaggaggattgcttgagcataggagttcaaggccagcctgggcaacatagggagatcttatctctaaaaaaaaaaaaatcaaaatatgagtcgggcgtggtggtatatgcctgtggtcccagcttcttgggaggctgaagcggaagattacttcagcctgggaggtcgaggctgcagtgagccgtgatcataccactgcaccccagtgtgggcggcagagcaaaactctgtctcaaaaataataataaaataaaataaataaaagatgtataaatcaccttaagtttattgtgttggaactccacaacaatgtgagagtctatttcacgatattatttccagatgtcaagtataaaatatgtacttggtagagtctttatttcacttttctcctttctcacaaacaaaaacatgggatgagaatcagaagtagagaaaagatgagacgctttatgaatggtgaattattattactcttatttttttctgagatggagtttcactctttcaaccaggctggagtgaagtggcacaatcttggttcactgcaacctccgcccctcaggttcaagcgattctcctgcctcaacctcctgagtagctaggattataggcgtgtgccaccacacctgacgaatttttgtatttttagtagaggcagggtttcaccatgttggccaggctggtcctgaactcttgacctcatgttatccacccgcttcggcctcccaaagtgctaggatgacaggcatgagccaccacgcccagccacatgaatagtgaattctagaataattaataggaagtggaatgtattcatccattttttcattagacaagtatttacagtggggtacatcttccatagggattcagttccaaactcagttttcttttgtttgaaagagatgctgcccaggctggactccaacagttgggcttaagtgatcctcctgcctcagcctcccgaggctgggtctacacatgcgtgccaccttgctctgctccccaaaatcagttttggcaaatgtggagtgtggtaaaaattaccactgaaaaacttttgaatatacagtccactaggctttgtgtacattatattatctttcagtaagcccaatgcagccagtttcttccagggttagaatatggtgctatttctacacccaagatccagatgaagtgatgctgtacccaaatatgtatgtcgggatttgctaggcactcagtgatgaattcacgacacttcaacatgcatacggtgatgagtgcctgtaatacctaggccctcaaggagctggcagtcaaatgagcagggagaaggtggcagtgaaacaacgagcagtatggtggtaaacagcacagactctattgtttttgttattataaatggtccagagcctgacactctgtctcaacagctgtatgttagaaatgtttcccatatcaactgcatctaacatctaggaatcagcttcaatctcacaataagtcttaaaaagaagttagtattttagagtagccactaagctactctaaatgctaaaatactttgacaattgtttttccatgctctctgtgcctaacacgtttttaacatgttgttttttccagttgttcttaaatgggacactgacccagtgcttggctgctccgaagccactccaaatgtgaaatatgtcgaagctaaagctgcactgccctcctttctcttctttctaatggggccaagtgaattaaatgtcactcatcccaaaaaagaaggcaaatcctctttaaaaccaaaaattcttttgggttaggctagcttctcctctattcatgtgaagagatttaattcctttttgttggttttgtttttttcaattctgggaagaggatgagccaccctggctctggccatcagagccactttctttttgcacatgtttgaaaggcatgacacaacttgaactggaaaaagggctggcatgaaccccggcatctcaagagagactagaggtgcttttcagagtgaggttcccattttgcaagaaattatttggaggatcaaagacaaaaactgaggcatcgaaagggaccaacttaggcttcagaggaaggggagagtgctactggggaccttgaaaataattatcaggaaacacagcttatggttcacatttcaaacccagcctacaatgtttctttacgtgtatttcttggcatcttcagtcgaaaatatcacccaaatgaggcagagtggtacagtggatttgagatctgtttctgccattaactgactaagagactactgtaagtaacatctccaagccttggtctcctccaatgtaaaatgggcataagaacatccattacatgaggctgttttgagaatttcatcaaataacaaaagtaaagcacctagcacagtgccggatatgcatgacacactataaatattagttcccttcctttcccttgtgaaaatctatccaaactgtttaaagggatctgagtaattcaaatgcaaaaaaagaaaaaaaatcaataaacaccttatagtacaatgaacacaagaaaatggagagaaataatggtagacatcaatttactgcaaaaactacagatatacttgatttctttcgtgtgtgtgtgtgtgtgtgtgtgtgtgtgtgtgtttaagatggagtttcactcttgtcacccagactggagaacgatctctgctcactgcaaccttcacttcccaggttcaagtgattcttttgcctcagtctcctgagtagctggcactacaggcatgcgccactacgccaggctaatttttttgtatttttagtagagacggggtttcaccatgttggccaggctggtcttgaactcctgacctcaggtgatctgcctgcctcggcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagcaccccacaatttttttttttttgcattctaataatagcaactctcagattcagtgtgagaggcagccaaagctgcgattcctttactgcccttgttggtaatgagtgccttggtggtaatgagcatctcatgtcagcacaagattttctctcccatttaaagtagaaaggggacttcagcttgcagtaaaaagcacagtaagattgaatgcaagcaaaagaatatgtaatggatttccatttttcctaataaagaaatgctcaagaagttttaatctaatttaatttttctaataatttacaaggagataatagttccaaaatgtgaggggacataccaggtacagaaatgcaggaagccttgaaggttctatgacttcaactaatggaaaaacagatttagcctaaaaaatgctgttgtttttaaacaagtatgtttatgcaaactccaaacagtaagtatctttgtacccacaagtggatgttaataaaaaatacatgattgatttaattttttacttaacaaagtacaaaaatatgtacctgtttcaattatgacttcaaaccccatccttcttcatgaaagtagcagataaaaatcatataaaatcaacatctatttgtgcgtatataactttttgttttgatatacctttaaacttataggaaagttgcaagaatatatacggcacggccatctactgattcaccaacttttttttttttatttaagttagtagcattagaataatcacttgtttctaaatgatccctcagtgatagtaatcctttggctggtcacttttctaactttgaagagaagtgagttttattctgtaacactcgcaagataaagaaagatgaaaaaaagctaatataaaccaatttgaataaccaaatcgggaaaccatgtgtgatattgtgatatattaagaaataaatctctgtcaccattgccgatctagagttcctataacccttgtagataggggtgctaggagaatctttggttttaatatttggtctttgacttcggctcctgacacagagcttctaatcccttggaattttctgggtgataggaacttctcttgttttaatgaggtgactgttggtgggctcctacatagccttaggaaggggctggttgccagggggaaccaaccacatggctggaggattcgaactttcagtcccacaccacatcccaaccttcagggaagggaagaggggctgaaggatgagctgatcaccagtgatgaaatcaattatgcctatgtaataaagcctccataaaaatccataaggatagggttcagagagcttctggatagctgaacatgtgaaggctcctggagggtggcacatccagagagggtgtggaagctccaagtaccttgtcctatgtatctcttccacctggctgttcatctgaatcccttgtaacattctttctaataaatgggtaaaagtaagtgaagtgtctccctgagttatgtgagtcattctagcaaatggatcaaatccaaggagggagttagtcagaagcacaggtcaccacctgtagcttgcaattggcatctaaaaaggtgggctggagggggtgcagtcttgtgggactaagcccttagcctgtgagatctgatactatctctgggtaggtagtgtcagaattgaatgaaattacaggacacccagttggtgtctgctagggaatcggaagtgctgtgttggatggtgtgtgagggtaaaaagaaaaaagtttgattttttttttcccttcagacctggtgacaccaagttttttgataaaatctaaagtaataacatttcagcagtaatgatgatgaccccaatgtccttccactgaaggagaaaacagaccccacccaaaaggtgggaagcgccggcagatgattcctttatttatggagctgctgatggtcacaccacggtgtaatacaaacatttctgtctaaacactaacttgggcagagccacttttacactgtgccttgtatttaattgacaggaagtttttcaaaacaggagagagctgccttactttgattaatgtattaattcaactggcaacctccaaataagttttcttaggagtagaggaaatacgtgcgaataacattaaaatgtccttccagtgcttggaatgaatattctacttgtacagacatagattttgaagacaaaattgtaaatagtaaaatctccacctcactctttatagaatgtatgatttaataaacaaaagaaaaaatgcagcttcagaaaaatagctttaaaaatgcccataaaatgcacacaaaagaacctgaaaacttacggcgggttattctcgcatattactagacttaacttggtaccatctttctgaagagcagtatatcaatatgcaacaaaaacctgggaaaagctttgatccagtaagtccatttgcacaaagcttttattcccagaaaacaattagatgggaatgacagagatggttgttgctttggaatatctgctctccctttttaggtgctaagtattgccaagagactaagttctagacaatgaacagaagtgctgtgtgggcttctgggaaaggtttttaaacggaagcaatagacatacgtttctgcttcccacccttccatcttttctccagcctggcatatgaacgtgatggctggagctgcagcagacagctggaattatgaggaatggaagccactcagtaagaacaactaagcagaaaggtgcagcggagccagcaaaccagctcttgagttccttaattcagatttccttaatgttagagaaataaatgatctcatttcgcatccctgtaaatcacaaacatgactccaaaccaatacaagtatgcagaatgtatgcttaaggatgtccacagcggttttgtttctatctttagtgtatgatgatagaatggttaaacaaattatggtacagtcagacagtggaagactgaacagacatgataaattacatggatctgtatttgctaaaatatattgtgggagtgaacataatcccgttttggtaaatagaacacatatgaacaagggggaagtaggctttattcatatctttacatttctttgttctttttgtacaataagcattatttttctaatcagaaaaaaaatgagaaagctatcctccccccaaaatgaacccatttcctgcttaaaaaatgatgctgcattccacatttgaacctatacctgctcattacagcctctgaaaataattccacagctatagtgcaggactgaaaatcttgtctctgccttaactgtgagttggaaaaggcgccaccataatactcccatgagtgcttagcctaaaggtgctctgaactagagagaggcacaaaagggggaaaaatgcaatagaaggaagggataaagaggatcaagggaagttctataattaagcaatattttacggctgcctctggcagctgtttgagtgagcgggagaatctaaacgaggtgtcaacagacacaggagctgccctctccttgggcagatccagcagggcctagcatgtcctgtacttcacaggacaatctggggcatcttatatccagcacctgtcagcctgggagactcccagctgcaatactgttattgctgtcatctgcctaatccagaagggagcggcatttattgtatctagaaagaaagattaggctaaaatatatttgactgttcttatgaaagagaatgcatgcctcacgtaactgtgtttgttttcttcttgtccctcctgactttttctgtttttatcaaaggaagaaacctactcttgcagctgtatttttcatttttaacccccacgttaatcatatattcacaacaaataatggtttaaatttagtctgacgaccagccacaaggctccttctcatcccactatgaggcacatcctgccttcagactctttacgcaatcctcattgacttggagaggaaccccgtgcaatgagttaaacaggatatagaccatcataattaccagaggaaatggtattttctttacaggatacatttagatttttcctttccatgagttttttttttttttaatggtgttaaaatgaaaggagactttaaagcagctttcaacttctcagtagccccaactatggactaaatgcagaaggccttacacacagcagacattaaaaaactactcatagaataagtgactgaattaaaggaatgaatgaatgaatgaatgaacatatttaatgggtttacttcgacaaatcattttgcttctaggtatcaaatataacagttgaatcttattcacatcatatatgtttttatctgtaagtactcataaaactaatctaggaagatttgttccttacttgccccagaaaggaacaaattctagagaatgctgtcacattctattaaacaaattaagtcattctcaattcattcctgttgattctgcaaactgctcggctgagcctctaccaggtactatacaccatgggtcctgaaagtccaccatatctagcatacaatagacactaaataataaatgtatgttgaatgaattgctacttatattcctaataatgacaatcatggtaataatgatagttacaataataattattcatattaattattagtcataatattcacaataaccatgctgttaatgtctgataataatagttgacatttatataccattttatggcttcaaaaatgatcttaacttgatcattacataacaggcttactaatctctgtttttaagaaataaaaatgggccgggtgcggtggcttacacctgtaatcccagcactttgggaggccgaggcaggcgggtcacctgaggtcaggagtttcagacaagcctggccaacgtggtgaaaccccatctctactaaaaatacaaaaattcaccaggcatggtggcgggtgtaatcccagctactcgagaggctgaggcaggagaatcgcttgaacccgggaggtggaggttgcagcgagccgagatcatgccattgcactccagcctgggtgacaagagggagactccgtctcaaaaaaaagatacagaaacagagttgggtgaagtaaacctacttaataagttcttagtttccatgtggcagagcagagtcaaatcttgttctcataataaggtctagggctttttccatgatacaatactgccttgtgaacccaaagaggctgacgtgcataacttgggccattaggaaggaaggaaaaggggaggtggaccgtcagcactgctgatagcctgactttgtcctggaacaatatctcctgcaggcttggtcctcctcttgcttcaataacacaccaccatccctccttgtccctcctgaaacccttgagtcacacagtatgtcaacttgcctgcaaaacttagctttttttttttttttaacaccctggttttaattaggcatatcctgtcaagaaaagggactcttgtgacaataaaacaaattaggtccatgtgatcctgtagttgttagggagaaaggaaagaaagaaatacaaatactacttaaaaaaacataaatacaaagcggaacgccaactctccactatgacctaaaaggaagaggtaaaaggactctgaagatagatttggagatgcaaggcaacagctgaatatgccatgagcaatgctggaaccctaagccagagctggggatgtgattcttaaggccctgccacttggaaagccaaaacctgttccttcagaagccagtctctgatagtaactttagcctaacttgccttccatttttattaatgcttttaatatcatattgcctttagtttttattaatgttttcattattttaataactagggaaaatattcaaatagggctgttgtataaaatgtgttcagtctataataagctatgtaaccagcctttataattgactatataactgtaattacttaactaaaattcaagatgtacattcacttttcctaaattttctctaaacaaaaaaaagtagtagagataaattccaatttttctaagaaattaccttttcatgataatatcttatgttttaaaacatttacacaaaaaacatttttgcaatgtattctgaaattaaaaatagttatattagaagaaacatttcattctgggttaggaattgtagtcattttaaatgacttgagaaaaaagttcatgtttaaatactcagacccgtaataaatatattaatacaaaagtgcgggaaaatgtacaaatgttatcatatgttgccaaatgtgagaaacattgcgggagggggtaggagaaagaattagtgaatacaaagtcattgtgaattcagcaaagggagagacacttctgattctgccaactgcatctggtatttccacctaaaatctacttctccggtaacaaatgctttcaggttcaaccagactgtgaggagacacagctatggggcaaggtaacctcaatgatgttctataaaacatcagtcctagaagataatccccctcacccctgcacccaaaagggttctgttatcaaataagtatggaaaacactgaatgttatattcctctcctaatatttatacaatacatatgcatataaaagattctagttttcaattagcttaatcccacatttctgtaattcattttatgtgtaacttttttcacttaattattactatcctatagaatacattttaagaagttgcaaaatatactatttatggtatttattacaagcatgacttcagattcaacagcattgtctgaacacacactgtgcttctgacactatggcaatattttatacccaactgaccagaactaaaaaaactacaggcgttcctatccaaaggcactgaataaatgtaagtacaatgctatgaagccctgatgccaaagcatcccaacgacaaagttcattcaaagcagagctaatatagattagagagattaatcggcatatatcagaatatatatatacaggcatatatgtatgtgtataaatatatatacatatgtaaaacacacatgtaaatttccatatagcttgaaattaacttgtgtttttaaaaagtgacctgaactgtttatacccagaaagcttttaatcgtccgctgtattttaaaatcaggagcctgtatctattcttagtgtgctttcgaaataaagcttcccttggttcggggtcacagctgctgcaaagcactctgggtggctcctctccatccctttgaaacagctggtgggaacctagtataaggccttgaacccagctgttcaatcttactttctaactttagcaagtcccttctccactaatgtcactggggcatgccacattgaaaaacacaccagagatggtagattcctatccctgctaaaaaaaactccaggcacaccgagccaagttacactcatgtaccaatcacagtatcacccagataccgactgcaggatccgcgtgatctgatttaggctgggcataccaatgatttaagaaggcttccctagacaccacaaataggcatgctgccatcactcctgccagttcagtgcattagaaagttaccgactaccagtggcagagccccacaacgtagaatcgagaagaccatgaaaaccaacctcagattcaaaagacttgcacatacaatgtgctgtctggtggcttttgtctccacaatgttaatgcaccgtacactactcatgaagccctcataatgtaattacttctatttaattgattgtacatgccctcgtcttagttttctttctttttttttttttaattgcatgctcattgtaattacttgccccaaagccaggagatttcagaaatatttgactgtttattaccctttgagaattactaattaaaataatttccttcagtgaaaagggttgctcttttcctgattccacttcgacactgctcaccactgaagagaactctaagaatgccttgctaagctcccctgtaattgactgcctcctttgttaacacatgcgtggacttaaaaaacattaaacgacttatacaaatggaaacaaaatgctctttgagttctattgataacttaacctttagtgttttggatgaaatcccaattctagggaagcagggggagccattgaatgaaaccattatgtaaaacattgttgtgggaattattttgtgtgaaaatatatacagtatatcatttaaaatgtctttgaaggtgggctttcaaaatacctaattaaaatatacatattttgtatggcttctctacttcgtgcttcctttttcagggaaagagaagaaatttgcataaggcaaatgaacccatgacgctggatgttagagtaggtacccttggggaatctggaaggggcgctttttggagctgggaaaaatcctgtttcttgggtcagagacctgcttacgtgggtgtgttcaatttgtgcaaattcatcaagccgtttatttatggtttgtatactgttctacaaaaattctacttcatttcttaaagtaatcaagagaaattacctccatttttttcaagtaatttgtataaaagacaaagggatgtagtttccatatagcagaagcctaagaattactctgaggcatttacaaggaatagaaattaagactgtggtcagggggcctctctgaacttattctggtttaggagttccccctccccctcaaaaagactgtaattgatttttctatgtcgattttttttaaatggtgtacaatatttggtttgagcaagccgatgtaaaaaaacacatctgagaccattaggaatatttgaatatgtactggatattaaataatattttaagaaattattgcttctatcctgataagatacaataagaaattcacaaaatcatttatgctgtatttttgtgaaaaattttaacctaatttaatcataaagaacccatcgtgtgtgatagtggtctaaagtttttttcaaaacaggttaagacgaaaaacaaacaaaatggtcaaggggagagacactttttgaatcaggagaaacataattattactaaatgcaatatgtgaatctgattggatcctgcactggggaaaacagacacacacacaaacacacacacaccacacacacacacacagagctacaaaagacatttttggaacaactgggggaatttgaataagggctaaatattaggtcatattattgtactaaggttaattttcttgggtataataatagaatttgttatggtataaaagaatgtcttattcttaggaaatgcattctaaagtacttagggaaaatctcatattgcctataacctcttttttacttttttttttttttttttttttttttttttgagacggagtgtcgctctgttgccaggctggagtgcagtggcgcgatcttggctcactgcaacctctgcctcccaggttcaagcgattctcctgcctcagcctccctagtagctgggactacaggcatgcaccaccacgcccagctaattttagtatttacagtagagacagggtttcaccatgctgcccaggacggtctcaatctcttaacctcgtgatccactcacctcggcctcccaaagtgctgggattacaggcatgagccaccgcgcccagccttgcctataacttcttttggaaaaaggttaacaattgctgaacctagataaagagcaaactctctttcaacattttttcaggtttgaaaatgttcaaaaacaaaagaaaaaaataggttattgttgattttgtcacacatgtaaatagtaattttgttatgtaagaaaatgttcttcttttttagaggcaactatttaagtatttaggagtaaaatatcatatattttatttgcttgaaaatactactattaaataacatattaaacaaatataccaaatgttaacaattcttaaatctaggcaaggggtatatggtgggtcattaccctattactctctccttgcatgtttgacattttattacataaaatgtgatcagatttttttaacaataaaatccttcctacttggttcaagtttccaaaatgaactgcagtagaattcctcccaaattaacattcatattatggttcaaatttctccataattgggcgaggcgcggtggcccatgcctgtaatccctgcactttgggaggccgaggcaggtgaacacctgaagtcaggagctcgagaccagcctgtctaacatggtgaaaccccatctctactaaaaatacaaaaattaccccaggcatggtggcacgcacctgtaatcccagctactcgggaggctgaggcaggagaatcgcttgaacccgggaggtggaggttgcagtgagcagagatcaccacatcactgcactccagcctgggcaacatggtgagattccatctctcaaaaaaaaacaaaaacaaaaacaaaaaaccaagttctccataaactggtattgtcttgggagacattattagctcaatggactcaaaattctttgtacataaaatcaaatagcatatttccttctatcctccagttataacaaaaattacagtaaaggacagtaagtgttctaagagaagtagtgaagtctgttctgaaactgaaagttgtttggatgttttccaaagacaagccatcatattcctgccctgctctctcagacctggcactgataacacaacagccttcaggaattcatttttcttctgaatcattctccactggggaattagccctggcatttctaattcccttgctgggcacaagcaagccctggcaccacagctttcccagagaaatccctctgtaacctgttcctctgtcagtgcactgattaagttagaaaaggtgagcccacttctctgtggctcgctgacctcaggacatgaggaactgtggatttgaatacacaaggcaacagccgtagtgcagtggatcttctagtggacccgccactggtacacattttcttgactctgaggacagaggctgaagagcactcagagcagtacctggtgccatcactcagactttgaagccatgttgcataacagataatgatgtgcgcaatggcgaatcttgtttgaaggtaagatctgccgcttactagctgtgtgactttggataagctactgtgcttctatttctcagtttctacatctatacagtggagatattgcacagtggttaagacgtctggaatcagattgtgttccaatagtagctcctacactttctacttaaattaacttgggcaaattacttaatctcttggtgcctccattttctaccaatatctatgacacacaaagaccttagaacaaaacctggcagatagaaaactatcaataaatattagctaccattatgattaggacacaatgatctactccataaagttaccctgaaattaaagttaataaagcatgcaaagctcttaacatggtgcctagaacacataattgtttaataaatgttagctattgtgatttggcttcacaataactgttaggtaaacagtgccaatattagtattttattgataaggaagccaaggatcaaaaagactcagtgactttccctctgtcgtatgctgacaacaatgactttactattccatgctcatactcttcctaaaattctctatgccttaaggatccactataaagaacagagagaaactaaaataggccaggagcctgtaatcccagcactttggaatgccaagatgggtgatagattgagcctagaggttcgagaccagcctgggcaacatggtgaaaccccagctctacaaaaaaaaaaaaaaagaagaagaagaagaagaaggaaaaaaaaaagaaaaaaagaaaaattatctatctaggcgtggcagcgcacacctgaagtcccagtgcctcgagaggctggggtggaaggatcacctgagctcaagggagggtgaggctgctgtgagctgtgtgagagtgagatcctgtctcaaaaaaaaataaaataaagtaaaaaagataaactaaaatagcatttgaagatagactcattaacatcagcataagcattctgaagctaagtttaaaatataaactagtaaatgatgagactgggaaagatgcttggaagaaaagcaaggagtccaaccttggacacaagtgcactttacttcgtgccactgaaagtgtaggccgaatcctttttttgtttggtttgcttgaatcacattttaaatgcacaagagaggtcaccctttgaaaattaattctgtgcaaatctttttggaatgattattttttaaaagaaataagctccacccttttataaatgggattgtagttaaagattttctgtatctgcttcactcaaaacaagcagcatctgtactcaagtgcatgcctgcaggtgagtgttgttggttaagctcaggtgaacagtgaaggtccctgaatatgtgacagggcctaacacaggtgttggtgtttgacctacaatgtaccagaaaagccgtaaaggcaaaccccccaatagatccttcacattacctgtctcctagcagcatgtcaaaaatcagtgcaaacgtaacagaagaatgccaaagtcaagaatacaactgagaacatcttgaagctacgaattagtacttgccaccatccagctgttggttgcctatagattatcaagaattttacttgtatcattatctcatttaatactcacaataatcctggaaaaattattatccccatcttataaatgaggaaactgaggctcaaaagtttaaaagacttgcctgaagctacatagctcataagtaaaagagtaggaatttggacccaagtctgactggcactcaagccaagcactcttgaaattttctttaatcttctttctagtgtctcctagtgtctcccaaattgcttggattacaggcgtgagccactgtgcctggctggtttctgtcttttttctaatgcatgttttttccatggctgtgaccatattgtggaaaatgctgtattccatttttttttcatttaacatcataacaatattcaaatgccgttaaaaactttcatcaacatcataatttaattaacaattccttactgttagatatttatatttttctttattcattacaaataatgcttcaacaaacatccataagcataagcttttctcaatgttttgagttatttctttaggctagagccccagaatcagtaccactgggtcaaagagcatgaatgttttatcatttgcttattttttttagagtgaaaaaagtacggccttattacttgtaagtcattatatatggatttttaaattattatttgtacataagaacaattttaatgatatttgcactatcaaattatctttaattggccaaccaatttttatgacacactgacatgtttggattatatcagtccataaggtaaagattccaaaatggcaatgaccaaggtctaccataggcaccttggttagaaagtatcactctgcatagtactgacttgtagatgaatagctggatattggaaggaagatttgattcatgaaggttaatgggctggggaaagcaatgggtccaattagcaaatggattgttcttggaccttctgctagtctcaaaaggataagcttatggttcccatggcccatggcagaaaacacagaacaaataaccaggttaaacactgaagttcaaaagttggccagtaatggttgtcaagggctgtgtccaggaaatcccgccagacaggcactgtttgcaaatggctgggaaatatggtctgttgccatcaaaaacagatgaaaagcaggatttggttaaaagagtaagtctttgcgcaagcaaaacctttccaaaataaagaaacagtgtatagctgttgccaactgaccttgactgaaaagaggggccagtcctgtaccaatgctcattataaccagtctcaaactacttaaatggtgttgagtggaaataagacttaatcaagtgaagaacctgccagctttgacagtggtaatatcccaaactaaaatcctcaagagtatcattaaatcaaaaattttttaaacttaaaagtaaaatacaccaaggcaataatatctactttagtattaagagaaactacaataatatgaaggaggatccattaagttacatgttcaaaaacatcaaaattccaagagtttgagacatctttaaatagcgacaaggtatataatgggcccttcatcttcacctgtttcacatcctgggattcaaccaacattggcctgaaaatattcaaaataaataatgatagtacaacaatttgtaaaaatgaatacaaataaaaaacaatacaatgatacagtataacaactatttacattgcatttacattttatcaggtattataagtaaatctagagatgatttaaagtataagagaggatgtgtataggctttatgcaaatatgatgacattgtctataaaggacttgagcgtcgtcaaatttttgtatcttccagggtcctggaaccaatcctttccggacaccaagggacaactgtatatcacacagtgtaatcaaatggggcaagggcctattaataataatctcttcaagtaatgccattattaagaatcagtagcagtagctttaattaagattctacctgtaacacagtccccgatgggaatataattgagttaatatatgtaaagtgcctggtacatagcaaacactatgaagtattagttaagctaataaagtcacagggccaaaagggaaaagaggagcctgacagcttcctcaccctgattcttctctgtccctccaagcacctcaagctgggacctcagtcctctgtccttgacactcactccactcacctgaaggggaagaataaaataaaattgataataagcattagttgtacctcatgggcctggcaccttcctttatacattagtggaaataaagcaccttcctcaaggcaatagccaccctggggtacccatttgatacattaaatgaaatccaaataaagtctttccatgagtcataaaatttcctatttaaaattcacattatcaactgcttgaccaatagaatatggtaaatatgatgtaccagtttccggcaccaactcatggctcctactttctgtttcatggaatgctcactcttggaacccagccaccatgccataaggaagctcatgcattttgtagagagacccacttggaaagaaaatgttgcctggctgacagtcaacaccaacttgctagtcatgtgggtgagcccccttgaaaattaatcccttgtcccccagtcaagccactccaaatgacactgcatgaaacagagagaagctgtccctgtcaagcaagctctgtttaaatttgtgaccaaaattaatgactattttaaccaccctcccaagtacattatcttagcaaaacatagacctatgctcaggctctaattattcaacatttccaaattcaaaaatgtatcaatttcaagaggtagatgcatattttataattttttatagtttttctttctttttgagacagagtctcactctgttgcccaggctggagtgcaatggagccatctcagctcactgcaacctctgcctcccaggttcaagcaatactagtgcttcagcctcctgagtatctgggaccacaggtgacacaggtgagcccccatacctggctaattattgtatttttagtaaagagggggcttcactgtgttggccaggctggtctggaactcctaacctcaagtgatccacctgcctcagcctcccaaaatgctgggattataggcatgaggcaccacacccagccaagtggatgcatatttcaaacaaagcacccaaaaatgcccaggcatgaccatttctccttttcttgaaactacaaggtcaatccccttgggaacttcctaatacttctctaaaaaccaacctaaaaaacccaaaactaatacatcctccaattcttcaacatgtaaagtccttgtaaacaaagctacaatgacccagaatatgaaaaaaattattttttttttttactttttaaaatattatataattctattctttggctaccttttaaggatcctccggtctacttgagaaataaaacgtgcaggtttaaaacacccaaccgacaatgctaaaggcagtacagcaagtaagcaagccatgtaatcatatggtacagagggagtggctgcctcagaacggaagaaattcaacttgagcaaaatgtgagagatgggtacattatgcttgaagttacatttacccacagagattttgccacactagtggttgtggaaagtcttatttctatcagattttaaactccttttgagcctggactacatctaattttcacatttaccattaacaaccacaaaccaggtcctactagaaaaactaccaatatgcatttgcagacactcaaataatgctgggggaaaatgaggaaacaataaattttcccccacaggagaaaaatgtatctacgtagggctaagaggaaatgttaagaaaaccaaaggcaaagttcaggtagaattttccgtctgcagagtcatgatataagaggatattttaatatcctttatattcttgaatgagcattcacatgtatttttgctagcaactattttggaatgagctgatgatttggattaaagaataagcaaagctatgtgaacaaaggcaacccaagatgggaaggcgttattggcagcagcgttcttttcactctggaccctgagcaaccctgaaattccagcagtcacagggtcctaaatacttggggacattccgactcagtctcacagactgaaaggtagagagcacagatctcaacaggaactgaaactctagtgttgatcattgccctgacacaactttaaagtggccaccaaacccctcaaatagctattttcatccttgtttacactggccacactgacactcaattggtgagaaaaggcttcccccccaacttttttttgagacggagtctcactctgttgcccagactggagtgcagtggcacgatctcggctcactgcaacctctgctgtccagtttcaagagattctcctgcctcagcctcccgagttgctgggattacagcatcaccacacccagctaatttttgtatttacagtagagacggggtttcaccatgttggccaggctggtctcgaactcctgacctcaagtgatccgcttgcctgggcctcccaaagtgctgagatgataggcatgagccactgtgcccggccagaaaagcctaattttaaagccaaagataaataaataaataaataaataaataaccaggcttctttctactctaggtttcaactgtagaaatctatttgcaaacttcaaaaactattaactttgggcaagaatttttaagatctgataagaggagactctaaagttaataatgtcttgctttgaggaacaagggtctccacccaccctgggctcataaactgcccccctcactaccactctctggcttcccaccaagtcctcaagaaatgatttactaagttcaatcaaggaaccagattctatgaaataataaaaggaaaatggagttcatgactgaaatcaagctgggcagagacataaagggtctttgttaataactgtacaagggaatgcaaatgaagacaggcttcacaaggaattttgacatcttaatgaagatttatgaagaatttgcagcatattaacctcaaatacaaggggaattacatagtcacataaaaacactgctttatgatttctttagcttaaaaacaattcaaaagacagtttcttcatgataatgctaataatttagttacaaaggttccccaccccccccttgtactccactctaattacattctccatcccccattacatttctttctttggttaactctgaagtgatacagctcattggcatgccctaaagctgtgaactgccccactgatgaaatcatgacagtgattaaatttctctattccacacagaaagttttgtgttacacagttttctttgttcatgtccttagtaacgcagaaaatcaactgacattttctcctaataatgaggggaatataagataatgtcaatgaaaaaaaaatcctctactggtgctacataagcggcataccaaaaaaaaaaaaaaaaaaaagcatgtgaagctgtacagatctcagtcaagaacacattggccacatctaaggtcagtgatagtattttgccacggtcatagattttatgttgtattcatgatacatacagataattagaaagactgagttcattaaatatattcaaaacacagaaactttttaaactccataaatagtagtaatactataagtagtagtacatgaaaaatagtttcatattacataatatgcaaagcatttttgcttttgattctcttaatatttatttcatgctccaaccctgtaagataagtattatcccaactttataggctaaggacctgagacctagaagttaaataactggcttaaaatcacactgccaacactgccagacaatggctgaggcctcattccctgtgacagggccaccccctcacagctcactgcatgcacaccccaccacatcccgggaaggagcttgcacaggactttaagggcacatgacttggcttccatctctactcatcatccagagatgctccttagctaaaagagaagttaatctcaggaaatcaatgctagcagggccaggttttactcttagggttctatctcaaattttagctacaatttagaaaatgcaggaagtgaaggaaggaggtcaaagaaagagccctgggacttccaggagggccaggtgctccttgtgtcacagttgctgctacaagggctgccttaatccctagtcccctagcccagccccattcctcccagcccacatgctgaccagctgctcagtgtttctctgtagggtatgtgaggggcagatgcaggccagcccaaggctgctggccttccgtgtgctgcccttcctgctgaagcggtactggcccttcttcacaccctcccagtctgctcagatcagacacactggcaggccagaaggcaggtgggaggacaggtgccaggaaaaaccaggcatagagaaaggcccacacagaagctgaagccatacgttctgcattcttacccatggagcaaaggagggaaatgtcaatggaaggcttgaggtgctgaggttcatggtcaccttatcccttggatttcagggtagtgagattcatggataggcttccaagcctgtgcactgaaggagggaagggtcactaattgagaaaacaagtaatttagacagaaggagcagcactaaaggtccagaggccggagacagcacaatacacaggagaaactgtaagatcatcaatatggttggagagtggagacctggtcacagggcctctcataagctaaggcatttgaactttatcctaaatgccaaacgaggagcttcaaagcacatgcataattaagacatctgtctttttagaaaatcactttggccacagcatgagagtggatcagaggagagtaagaccagctaccaggtaggagaccagttagaagactattgcaggagcacaagcaaaggatgacctttctagtgtagtgacctacactagaaaacatagacaagggagcaggttatggaggaaatgtatgaggcgggactgagagaacttggaggactggatgtgataggtgaggaagaaataatgggtgaggcagtaatttgagcaatgtggttactgagttccataacaacggagaaggagcaagttcgagagtgagataatgaatttgctttggacatgttgcctttgaggtgactgtggcgcatgcaagtagacgtgtttaatgggcaaaagaatagggtatccagcactcaaaagaaagatttgtgctagagatttagactagggacttatcaccatacagttgctgaaacattttctctagttactaaaatgtggtcccgagttacagactccctcaagccccagccaccccatgaagctgctttcttaccactagttaacattctgaagtcctctcctgaatctaatatcctgtccaataccactgagatactggagaaacaagagaacacagctataaagacaaacaggtactgtcacaggtggcatactgctatggtgtgaatgtctgtgtccccaccaaattcatatgttgaaatataacctcccaacatggggcctttggaaggtagttagatcatgggggcagagcccacatggaatgggattaaggccctcatgaaagaggccagagagagcttgtttatcccttctaccatatgatgactcgggtagaaggcatgatctatgaggaataggccctcataagacaccacatctgctggtgtcttgatcttgtacttcctagctaccagaactgtgagaaataaatgtttgttgtttcctgagccacctagtttatggtatttttgttatagtagcctggacagactgagaaacatactaattatttcatgcatatgtattttcctgtcccattccgctttaagcgtttcaggtcaaaaatgtgtctgctatatgccctgggtttctctaaggcagtcttggtttcaaacattctggccctatgcattcttttatcattaaaatttctaagaaatcccagcatttcctcaaatagtaactgaccaaatctagtcagtaaacattataatatataggtcatgaaacactgaggtctacaaaagatacacaaaactatggggtgaggaaacatcagtatttctcactaaattacacgaataatagcttatattgatatagcttcttttgtgaggggtgggtaaaataccacttataggctcattcaaaccaagtgctgagaatagagtgatgggcaatacacactccgccttcatccagcttcttgtcagataatgacataaacaattacagttgctcagaagaagtaaggatgctaacaggggaaacttcagtccacataaaactcagggaaagcttccataaagagaagacctttcaagttgagacttaccaggaattaactagatgataaaggcagagaaggaagagattccaaagggcggcaaatgtgtgtgtgaaagacctgaagtcagatttaactttattcaaaaagaactgcgaggcatccactctgactagaagcagagcaaagccggggtggcctggaggggagtgatacacagtgaatgctttcgctattgttggactattggttacggttataatactactattacaatggtatttttttatttgtaaagcccaaaaatgccaccctcataaaagcagacaaaactcatgatatcaaggcaaagccatgacgcagttttaacagatattactattttcagttgcttttactttttgaaatattcatcttttttagtattcattgaataaatgcatgtgaaatctttttttatgaggagaaatgtgtaacataaatataaatccactaatgctgcttagaagactgataacacgggttaacttcagtgacctttgagaatttgacatagttcttttctttttttgagacagagtttcactctgttgcccaggttggagtgcagtagcgtgatattggctcactgcaacctccacctcctggattcacgccattctcctgcctcagcctcctgagtagctgggactacaggcacacgccgcaatgcccgggtaaatttttgtatttttagtagagacagggtttcaccatgttagccaggatggtctcgatctcctcacctcgtgatccgcccgcctcggcctcccaaagtgctgggattacaggtgtgagccactgcacccagccttgacgtagtgattttctaaagaacttactgaattgatcttccctaaagttttaaattgattgaagtactttccaaattaactaatataactaaaacgatagaattcattctttgtcagtgaggaatcagagttctcttcaatgattaacaactttaggcgactgcaaaagtcaacaaagacctgtgtgactgtaaaatttcctctggtaattcaaaaacattactcagagatttcccaagagataactgaaacaaaaaaagaaaaataagtaatgaataagtacacctcctctgaaaagtacgaataaaaccatctacctagcatcttcaacaggagattccattagaatgcaagtttcgtgagggcaaatagtttagtcttcaaggcctaagccagtgccttgaagtacatggtaggtactcaagaactatttgttacatgaatgaataaataaatgaataactaaagtaactgcaaaaatcaatatctgatattgttgaattctgagtataattattcatatacatttattatttttaataaaaatagtgtaaatgcctaattgcccattatattgtttttataacttcaagaaagactgcacaaaatagaaaaaaaatttatttagaatactaatatgtacatttttgtattgtaactaccctaccatctgtttcacacacatgcacacacacaaatgtgcacacacacacaaccaccatcaccagagcctgcacagttagcacatattagtttctcaacaaatatctaaatttttttttttttttgagatggagtcttgctctgtcacccaggatggagtgcagtggcatgatcttggctcactgcaacctccatctcctgggttcaagccattttcctgcctcagcctcccaagtagctaggactacaggcatgtgccaccacgcctggctaatttttttgtatttttagtagagatgggggtttcaccatactggccaggctggtttcgaactcctgacctcaagtggtccgcctgccttggcctcccaaagtgctaggattacaggtgtgagtcaccacgccaggcctaaataattttttaaaaggtaaattgcaataattatcagaagaagaaccaaaacacaagtgataaagggtctaaaacgttaagatcagtcaagtggctcacgcgctataatctcagcactttgggaggccaaagcaggaggactgcttgagcccaggagtttgagaccagcctgggcaacatggcaaaaccctgtctttacaaaagaaaaaaaatagaaataatacaaaaattagtgagctgtggtggcatgtgcctgtagtcccagccactcaggaggctgaggtgggaagattgctggagccttggaggtagaggtagcagtgagccctgatcacaccattgccctcctgcctgggtagcaaagtgagaccttgtctcaaaaaaaacctaattaattaattaaaataaaatgttaagctctacacgaagccctagaagtcatctagtccaacttcatcatgtaccagatgggcagccaaggtccaaagtgccattcagctttacactaacagggcagggacaagaacactggactcctcaaagccatccaactccaccaggaaattttcttcacaagtttgggttagctaatcataatcggattacctactaaaaggtacagaatgtgtaatgtgttatccactacacctccccacctaagaaattattgcgctagttcaccaggatagggtcagcaaactatgccctgcacccaaatcctacccactacctgtttttgtacaacagggaatctaagaatggtttttacatttttaaataattgtaacaaattaaaataatactattttgtgacatatgaaaattcaaatttttgtgtccataaatacagttgtattggaacacagctactctcatttgtttctaaaactgtctatggctgctctcataccacaacagcagagctgaaaatttacaacagggactttatggcccatgaagtctaaactatttacctctagccctttacagaaaatgtttctcgacctttgcactaggagatagctaatgtggctttagtaagtttcaccttcaaaagagccagggttgtccccaccaacttgcagtcactcacatgctatttcctcttctttgattactgaaactccacagcaaactattgtttttaccagtcacccagaaaacgaagataaacgtttccacagaggaaataataaccttccttttccaaggtcctcctctgcctcacgtccagtgaaattaaaagcaattcttcattcacaggggttctgtgtcattttccccaacagaattcagaggacaacattaattcacttttacaatgaagggctcaggcagaagaaaagtagctagtagtgagtttatcctaagaaaaaaaggaatgtttaacattttctggaacggaaagcatttttgttttcccttgagatgctattctttctaacatcaaatgcaaactgccattatatactatacatcttctaaaaattgaaaatcataatatccatacttaaattttcaactttccagttttccaattacaagcaaagtaccaaattcatacctgctcagtgttgcaaaatgattttaaaatgtaatgatgtttttgtttgattttgtttcatagtattttcctctaccaatgtacaaaacactcccttgtaacaaataaactaagaaaatcgcattcccagggccttgggaaataactttaagggtgtctctgttcacttacatcatgaacccagctcttatgctcctaaagttacaaatggccactcttcgttttaatagcagatttaaagaaacctaatgttagttcaacacgggtaaacagtctctcacacagtataaataaagaattctttgagttgtaaatagtagttgctcaaagaagtggaagggtggctgaggaagacagagaaaagatgccttctctcctctctttctagcagggcaggccagggaaaggaggcaggacgccagaaggctggaagagctcagccatccagaaggacagcagggttgccaacttctgaaagcagccaccattcattcactgttcactcatttgtcaaacatcaactgaacactctcctatttatacaacatccgggggactcaaaagaagaaaacagcctggacactgctgttcataagaagccttactgtccaggcacagtggctcacacctgtaatcccaacactttgggaggccaaggtgggaggatcgcttgaagtcaggagtttgagaccagcttgggcagtgaaccaagaccccatctgtacaaaaaaaaaaaattttttttaaattagctgggcatggtggttcatatgcctgtgatcccagctactcaggaggctgaggtgggaagatagattgaccccaggaattcaaggctgcagtaagctatgattgcaccactgctccagcctgggtgacagcaagacctcatctttaaaaataagaataatagtaaaagtttttaaaaactttttttttaaaaagaaggccactaacatgcaggttaaggcaaaatgtacgcagaaccaagaaagctgcgtagcaagacaatgacccatgccaggggtcagctaactacagcctgcaggccaagtctagctggcagcttgtttctgtgaataaagttttattggaatatggccacactcacttatctatgtattgtctacagatgctttcacattacaatggcacagttgagtggaagcaacagagaccatgtgtctggcaaagccaaaaaacaatctggactctttcagaaagtttgcctatccctgacataggccagagagggatcaatccaactggagtaatcagagaagactatatgaaagaactgacatttgatctaagttttgattactcaacgtttcaaaaggcagaaatgggaaaatcatattgtgaggggcagaatggccaaggcgagatgagtctgagcaatgaaaggactgaatttgaatggggtacaggatatgaggtggggagttgtggcaaagtggctaatgatacctacccagactacatggtttaacagttaataacatagctccagagtgtttgctagcttactggaaatgtcattccccttttctctagcttccttcacatttatggctaattccatagctcacaaatatgtttgttcactgattgattactgtgatcaatcaaaagtttgcatgtcagtttaatttcaaaaacacttctatttacattattgcctagacttacatttaatcctcaatcacatcagacattactattcctacttgacaaatgataaaaactgggcaactcacctcatgtcccatatggcgtcaggggcaagagactggcttagaaccctggattctccaacccatctcatgacccaccttaggaagacactcatattggaaaggttaccacctggactgtattctagaccagaaattctgataatcaaacaccaaataatcaaacaggaatgcttttttggggcatatccttgctatacctgaactgtggcctgatagtagctcaaaatccacatcaaagaccaagttcgaggtacattcattttatacttaatgaaatctggtcaattcacataattttgttacaatgggcattgggtaaacgttctcacagattaacttaatccattataggaggggaaaagaaaaaaaaaaaaactccacctaccagtatatactttggcagttggatcatcattattttgcactggaaacctagaacccttaagagaaaggtatcatttgtaattaattttcctgtcctttgtacttgtaagtaaacaggtggtgttcggatgagtcccttaaaagcccctgttgcctgccaattaagtaataatattttcttttcagggaagtgccataaaagagactctaacatcttgggtcactgagtacttcctatgcaggaggatatgaggctgcaacactgaatttttccaccagcaggatattcaatgtgatgagtaaattagcaattagcatggaaaataggagttattctcagcatttgtcatatgagagatcagaattcctgcactcgtcacgtctgtataaatggtttctttaaccatgaacatcgtctcctcttaactccctccccatgtcactccactcacaatccacctacactgatacctcaaaacatctcttcctacacaatttttaatgttttattcctttacctgcttgctttacacaagcctgtctagagtcctctacaactaaattatttccatcatcgttaactttagaacacggttccaatgccagtctgaaaaccattctgaaatatccaacagctcttcttccaaagtgcaggtgggtaggctggcagcagagcagagatggctttttatactttcaggatcataaggggagagactacactctgctagtgttttgtcttccagcatccaccatctcctagcctttcccaacacccacctcttaaaacctgggcagtctcagaaggcaagaccaggaaatgtaaaggcacaggaccagacagaatcatatatgaaagcctaacacagcttaggggactggcctaggaactatggccaattatcctctctcttggcctaatgagattatgtcatgaagatgagtaccactccctaccatcagtaatgagaatgcagaggcaagacccagggaccaaggaaagggttaaagacaagcagcaagatgaagggtaaaagcttgctggttcagaaacattatctatctgcccctgacatactcatctcaatacagccaatctccactcccggcatctcttctttgatttactaacttatattcttttgttacttttttatttttatttttggcagggtctcactctgttgcccagggtggagtgcactggcacaatcttggctcactgcagcctcgaccctccctgagttcaagtgatcctcccacctcagcctcccaaatagttgaaactacaggcacataccaccatacccagctaattttttaattttttgtagaaatgaggtctcactgttgcccaggctggtctcgaaatcttggactcaagcgacctgcctgcctccacctttcaaagtgctggtattagtggtgtgagccactacacccagctgggcttttgttatttttcaacaatcaaataatccatgttcatggtgaaagaaaatccacactcacggtgaaaaaaaaaattgtaaaatgcagataaacaaaaatgagagagagagaaagatgaatggaaaaaagaaagaagagaaaatacataacttccctatccattactaacacttcagtactggcttccaaatgtgttcttgcttaaatgtcttttgaggggtcttgcttgaactgctttcaaacatcagattttacttatatttcatctgggaaaatcagttcctctgagagctattactgacacacagtcatgtgcagcatgacttttgggtcaacaacagatggtacattcaacagtgggcccataagatcatgatggagctaaataactcctactgcctggcaacatcgtagctgtggaaatgtcgtggcacaacacattacctttctctatgtttagatacacaaatacttaccattgtatttgtaccactgtaccattgaatacctacagtattcagtacagtaacatactgtacagtttttgtagcttaggagcaataggctatgcatatagcctatatgtgtagtagactatactttctatgatgttcacaaaatgatgaaaacatctaatgatgcccttctcagaacatacccacatcaagcagtactgactgtacttttcaaaggcaatagcactgatgaataagaatttcttttcatgtagtgtaatataaatgtttgattctacatcttcctccaaaatcattaaggctcttttgacctaagaagtctcttacaaacaatatgaacatctttcaaaaggagacatcagaacgatagcttagggtgagcatggtggctcacgcctgtaatcccagtactttgggaagccgaggtgagtggatcacttgaggtcaggagttcgagaccagcctggccaacatggtgaaaccctgtctctactaataatacaaaaattagccgggtatggtggcatgcacctgtagtcccagctactcgggaggctgaggcaggagaatcacttgaaccagggaggtggagtttacagtgagctgagatggcgccattgtactccagcctgggagacaagagcaaaactctgtctcaaaaaaaaaaagatagcttaggtgatggttacaggggggtacattatactagtctactagtattgaggtatgttttaaatcttccattagaaaaaagtgttttgcatatgcacctaagtgctaatctatgtgcagaccagcatgtggcatgctccttaaatgaaataaacaatactgaactttcaaaatgccactcttaaagatttgcagacatgtcctaatttggttgcagaaatacctataattcagctctgaaaattgcattcaaaacactggtttcaaccatttttttataaggatttcttctttggtcactgatttatcagactcttaaaaactctctatacacaaaattatatgctctccagaatttgctttaaaataatttaggtagcagttaaccattacaaatttaaaacatttctaaaagaggaaggggatcaatgaataagaatggcagaatgtggacgattgctgaagtggagggatggtaggtacgtgggaaattatcatactgttctcttatggatatttgaatatttccataatacaaagttttaaaaaaatcattgtgaatatatattgctccaattacgaatcagtatttcgtacccagtgcacaaataattaagctctattggaatggctacttactacgtgcccagcactatttctagcacttgatactcatcaattccttgagacatgcctgttcagttggtattattggtctcatttgatatctgaggaaacagatcgaaagaaacaacccacttggccaaggactcaaggcaagtgagatggaggaggggtagcggccacaccacagaggtgtctgctacatatattgtttggtccctttataaatattattgtacgtgagcatgtctgtttcattgtcacttgcagtattttagtgcatcctgtttttctagaaaaatgaatcagcctctctctgtttatccaagataacaaaacaaaaaaatggcctgagaacaatattggtctgatggaggccatcctgactgaaagaggaaacgtccctgagtcaatatcctcagtgagagacatcccttcataaaacaaaccaggaatattccaacaaggttcaaataagcataaacatccacagagttcagtggaagctacactgcactcagccaccggcattttttactgcctgtgggcttttcctgtctcatcgcagactcaattctcaaattctgttccctcaaatgtctcaggctttaaagcttccataagatctcatttttccccttaattgagaatgtccgcttcccaccctttctttctgcctatgaaaatttgaccctatctttaaaaattcagttcagggaacacccttctctgtaatcccatgtaatgaaatcccctggctagaactacgtatttcttcctctgtactttcctaataaaatggctgtcctctctctctctctctttttttttttttccgaggtggagtttcactcttgttgcccaggctggagtgcaatggcatgatctcggctcaccgcaacctctgcctcccaggttcaagcaattctcctgcctcagcctcctgagtagctgggattacagggacgtgccaccacacctggctaattttgtatttttagtagagacaaggtttctccatgttggtcaggctggtctccaactcccaacctcaggtgatctgcccgcctcagcctcccaaagtgctgggattacaggcatgagccattgcacctggcctgctgtcctctcttttaataaatttctttcattctgccaggtattatgagaagtcattttcagatttctttctaaaactgaacctaagttatttaggacaaaggccatgtacttattcattactacatcccgcagtcccagcacaaactagaagcttaaagtggaagaaaaagtaagaaggagggagggagggagtaaatgttgctttatgtgcataggccagagagtctaataagggggttagtttctaaagtcaccaagaaaatgcgaaactaatgtagaaaaaaaatgtccctgaaaatctcctaactgcatattaagtttatgtgccatttttagacatgctatctcttaattaaaaccagcacacccagttttacctcccgctttggaacagatagctgagaagatagctggtttccatttaggagccaccttgtgccatgacaaggtggtcacaatttgagggtctcctggggaccatgatgagcagaaggaaaaacgaactttcatctcatctcactctcactccagggcaattggattggagcagtgtgcaatccgtcttctctttccttctgtccccatctctctccaggcttatgtagtagcatgtggataagtcaatgcacacacagtgtgtgtgctttgctgtgcttcttcaagttcaaaaccactagaggcttatggctttccacggattagccacttttcattatttctaactggcctcattctaacaaaggatttggaaccttttaaaattccataaatcaggccaggcgcagtggctcatgcctataatcccagcactttgggatgccaaggcagggggattacctgaggtcacaagttcgagaccagtctggccaacatggtgaaatcctgtcttcactaaaaatatgaaaattagctgggcatggtggtacatgcctgtagtcccagctacttgggaggctgaggcaggagaatcacttgaacccgggaggtggaggttaacagtgagcagggattgcatcactgcaccccagcctgggaaacagagcaaaactctgtctcaaaataaagtaaaataaaataaagttccataaatcataccaatattcagagtccaatattattcatggactctgaaaaatccctcctatggatacaaaaataaaatgcagaatattccaccattggctaaaagaaaacaacgttattatagtacatgcacatagaaaaatctggaaggatgtataccaaagcaaacagtagatatacaaatgatagactatgggagatttttcccccttaattaacaaagaactataattacttttgaaataacttttaagggttactttttaaaggctactgtcaatttcttagggatggactgaaacaagagattccaaagataaagcctgtgctctttgcaggcatgtcctctcagaagagcgtctgagaataagacattcgaaggactgaagaacagtacgaaggactccttgagccaacaagctgcctgcccaggctggctacaagcctgggtctacaatgtcttgcagccaacagatacatccgggcatgctggtggggtcagcagacactgaggcgctggtaccaagcttgaggtaaggagaacaacatctctcgagcatccatctgtgctggtcttggtgccagcgatacaacatgtatttatctctaatcctgacaacaccacccaaggcaggcaagaggctagagagcttacccaatgtcacacagccagcgtttgaagctcagtaagccaagctccagaaactgtttaacaatctaatagctatgaaaaagatgtggtccccacatatctaaagcttacagacaaatgcagaaaaagagagagagaaagatgtaatgtcagatgtgaaaaaatatcatcgaagaataagtacaggggttttgaggagtatataggagaaaaaccttaaaataggcagagtcgagacttgaacacagctctatttagacataaagtctctgtgccttgcattatactaggctgcctctccacgctgtaggagcctggaaaggtaaaggaagctccaactgagagggcagtgacacgacaagtacaatcctgtcccctcttctcctcccccctccccaccacctcctgggcttctgaaagaatcagtgcaagagccaacatctccttcaacccattgacgtctgtgagatacccagagacgttcaacccagagatatccaggctgcttgccaaacaaggaaatccaagataaacgtgccattctgtcatgaccttatcctgctgagagacagacagaaacaatggcagagaggaatagccttgcatgttttcatggcacctttcagaaagagatgaaattcaccatcagtcacacctcttggaggttgtaccatttagctgataagaaacagccagagaggcagggagtatggacactcctgaaggcaatcctatgaggagccccctgaaacttcttgaagaagaaaaatagcactgttcccctccccttccaactcttcacgctgacaggagtttctacgaggcagtgtttgtcagtagtattattaaaaaaggaaccaggccagattagtgactcacacctgtaatcacaacactttgagacgccaaggtgagaggattgcttgaggccaggagttcaagaccagcctgggcaacatagtgaaatcctatctctaccaaaagaatttaaaaattagccaggcatagtggcatgctcctgcagtcccagctactcaggaggctgaggcgggagtatcacttgagcctaggagttccaggttacagtaagctatgatcacaccactgtattccagcctgggtgacagagtaagatcctgtcaccaaaaacaaacaaacaaacaggtatatagcactggttgatgatttcttcaatctccacactctgtttatttttattagagcacaacaaaggtaattttgttcaagcctactactttaggtttaggcttgaactgactgccaagggacacagtttacctttcttgcccaaaaatgtggtggccccagtaatattgccttcttgggttgctggttaatcctcgcacaggctgaaactggagatcatattatatcaatggtctcgttctctcaggatctcacagatcgatttctaaattttgttttccaaattggtggtccattagaagcacccaggattccatcattacaccttcctttagtcacccaatttgggacttagctccatttaacatctacacgctttgatgtattttggtcctgggctccatcttatagcactcttatagaaaaacgctttcttaaatcctagaaacagctttgttgggtaggtgttttcgtatcatctcagtttagagatgttgcaaaacccaaacattctgactacagaatccatattcttaaccactacaccagattgcctcctccaaagagggtttcagacaactcagtttctttattttttagataaagaacccataaagggaagcgtggcacacagagcataaacagaggtcatggacaccccaacctccatgatatgagacctgaggatctaactggatctttttggaacctctttggtcagccattaaattgaggcaaccacagaattcatcttctaagatgacagtaggtgtgaccacagagcttagctggattgacaagtcttgatgaaggagagaatttgtgggcagtgccttcaaacttagttccaagtgccttaaggaagatcctctggggagctggatctcatatgttcttctgcacccctcctccaccgctcccccccacacacacacactcatcttctttgtaaaagacttctttaaaacaacatagagtatcttatctactccacatgacagaggatgtttttatagcagccaacacaaatgcctagatcatttttatctaggtcctatttatctatctaggtcctcaagttccagctcacatcccatctgtctggaaactaacagcatttccattgcaaaaagttacaattgcatctgccccacatgggggaataaaccacacctctaggatgcagagctaggagaccacacacatcagcctttacacaagaatctcaagcttttcaactgtagtgtcctatgactattctcttttctcagaatgacacaagtggagagaatgcaaacaaactaccagaaatctggagcatcataaaagaatccatgtcacccttgataggaacaattctgtattggaattaattttgctgaatgaaccacaggttcctgaaaacaaatgtgctgccgttcttactttagggtcctgaaaatgtcacagaataacatgctttttctacctcagcttttgctttgcttaaactgttttgaagtatactaaatatggcatttaaaagggcaaaaaatatgaacccaacagtttttaggcctcccttataaagaaacagtccttgtttttaaacttttcaagtttcttaaatttgcttctttgctgtctgcttttaaaaattccagacagtaattctaatcacagaagtctttgtgaaactacatttctgtaattttttttttaactcaagtaatgttattggaaggaagcagaaaaccacagtgcccaaacagaagtgactaatgctagcagcaagtgctgtaataaataaggccccgagagcaagagaccgctgcaccacagtagcttgttgtatattcccatggtcaggactatttggagaccagcaaccagattttccagagctcttgatgtgttaatcaaggtaaccaggtgcaactcctttcactagcaatcttttgctaaagatgatagaaagaaaaaatacaggaagagcaaaaatctaaagagaggaagaagtccaaataaaacattcactcagaagacagaaatcatactaatatggtctatgcccagttatattacagatcagtttttaaataactacatatgttttaatgtctgatgtaatgcattacaggtgttctcaaagttgtacatggacgatggaccagtgacctaacattaaactttgaatttctctactactgtttcaacatgttgttggcacaatttccgaattagttacgtggtttttctttgccaccataaggatgtctgctctgggacccaaagagtcaaaatgccttaatcaatcattgaactttccttatctttatttcaactctcactcactcacctttatctaaaaaatattttggtagagattatgaatccatatcccacaccctcctcctgcacaacctatctgcttctgctcactgcatgccccccagtcttatgacatgattggtaataactatttttttattatgataaatttgatcacctcaaaatcagcaagaggcttgttttaacccagacttatgagttgtttctctgacaatgacatttcaggtataaccttaaagcaaatttgggatgttgttattattctcccaggtgcaatgatcttttctatcaagttgttgttatttgaaagatacactttgttttcaaaaaccatgaaaatatgaatgaccaattgtcaaagtaatttattagagacattaaatttataccaataatataatacaaataacatataacaatgataattatctttttgtacttacaaccaaaccatattttcccagaaagaaagaaaggaaggaaggaaggaaggaaggaaggaaggaaggaaggaaggaaggaaggaagaaagaaagaaagaaagaaagaaagaaagaaagaaagaaaaagaaagcaagcaagtgagcgtgcgtccaggcgcagtggctcacgcctgtaatcccaacattttgagaggctgagctgggcagatctcttgagctcaggagttcaagaccagcctggacaacatggcgaaaaccaaaaccaaaccaaaccaaaaccaaaaccaaaccaaaactatctccaccaaaaatacagaaaatcagccaggcacagtggtgcatgcctgtagtcccagctactcgggaggctgagggagaaggatcacttgagcccgagaggcagaggctgcagtaagctcacatcacaccactgcgctccagtctgggtgacagagtgagaccttgtctcaaaataataataataatgtgctcgattcagtaacccactaaagtgggtctgagtttatcattattctttccttactatccccatcgaaatttatggcaataatagccttggattcagtaattccattgctaagaacaaattctaatgaagcactcaggatgcatcttaaaaatctttgagaatgtttatcagctgggcacggtggcttatgcctgtaatcccagcactttgggaggccgaggtgggtggatcacttgaggtcaagagtttgagaccagcctgaccaacatggtgaaaccctgtctctaccaaaaaaatacaaaattatttgagtgttgtggtgcacgcctgtaatcccagctactcaggaggctgaggcaggagaatcacttgaacctgggaagtggaggttgcagtgagccgagattgtgccactgcactccagcctgggcaacaagagcaaaactacatctcaaaaaaaagaatgtttatcatatggccatttaaagtgtgaaaatgggaaagaacctaaatgctcagtaagaggggctagatgaacaaagtagggtacagctataaaatggaattctgggcagtcccaaaggccatgctatgatgccattagctgtgaaaggcatcccacatcatttaagtttgcaatatatgttgtctttctttctgatgaattaatccattttttgtccattgaatgacatcacttctacgaacttgcattctgacatccttatttgaataggagagaaatactttctatgggtaaatgtaaatctgtataagtggaaattatgtaattgctttcagggctaatcatccactatgtgaccgtgtagagaagatacaatcctgataagcaaactagagggctactatttatggcaaatgggaatttatatacaatgccagaacctcacagtcctttctgaagggccatgcttcatggctgcacttaattctgcatctcctcgttaccttcatgtagttttggcaatgttgtgctctcttgcatatatgcttagctctccagccaggctacagggttaaggctagggtccctatctcccatgtggcttgcatcactctctgtggagaaagtatgtggttatcgtctgcccagaatcacttcccttcgtccggccacatccctccccaccactaccatgaccacttccattgaggaactaaatctttctccattctaactctgtgattcctgaatgatgaacaatccagtacccttctctgctgagctcacaggaggtcaaatgaacagatactggcatacattgaagtgggcgggtgagggcgggtagagggaagccctcttgtccctttagaggctgctcgtttgggatgtggatgcccaaccttcctgaggccatattcctgccaatggagaaggcaatatggccaagaggcagagagatgagaagtctaaatgatactaatgaagtccctggatctggagccaaccttggcctcacttggttcatgcaccagctagtgtgagctagacctctgtcatcttcagctggaacagtcctgactagtccaccctccatcacacaagccagagacaggaatctatattctgtgctgcattcatggccaaacagcccagtctctgttcttcaagctgtccaggctggctaccaccttggagatgggagccacacttgggactatataagatcaagtttgctgcatccttctaaaataacattgcttctgctaaggggaatgaactgatacgtactgtttcttaataaacttagaaaaagaaatcataatcatttttaacctttttttttagatggagtttgactctgtcacccaggctggagtgcagtggcgtgacctcggctcaccacaatctccacctcccaggttcaagcaattctcctgcctcagcctcccaagtagctggcattacaggcatgtgccaccatgcccagctaattcattttatttattttattttatttatttatttttttatttttagtagaggtggggtttcaccatgttggccaggctggtctcaaactcctgacctcaagtgatccacacacctcagcctcccaaagcgctgggattatatgtgtgagccaccatgcccgtaccattcttaatctttacagaaagtcctttttcaggaaaagttggttgttagtgaaatagacaactctacccttttttttttttttttttttggtttttttggttttttttgtgacggagtctcgctctgttgcccaggctggagtgcagtggtgcgatctcagctcactgcaagctctgcctcccgggttcatgccattctcctgcctcagcctcccaagtagctgggactataggcgcccaccacgcccggctaattttttgtatttttagtagagcttgggtttcatcatgttagccaggatggtctcgatctcctgacctcgtgatccacccgcctaagcctcccaaaatgctgggattacaggcttgagccactgcgcccggccaactctaccctttttcatccctgccttctgtgacagaattatagtgactcaaattttgtttttgttttaataaagcaaaaattaggggctgagcatggtatggtggctcatgcctgtaatcccagcactttggaaggccaaggtgggtgaatcatccaaggtcaggagttcaagaacagcctggctaacatggtgaaaccccatctctactaaaaatacaaaaactagctgggcatggtggcacatgcctgtaatcccagctacttggaaggctgaggcaggagaatcacttgaacccacgaggcagaggttgcagtgaactgagactgcaccactgtactccagcctgggcgacacagcgagattccaaataaaaaaaaaaaaagcggaaattagcatcacatgcaaacaattatattctcaaaaggaaacaagttgttctatgcatagcactaaaagccctgactcaaaccaaatgccacctccttaatcacctccatgcagcaccctgagtttaccatttaagtacctaccaagtccctcccttcctagacgtctgacacccagttgagctcatggattaaggtgacactcataaaccattcttagcaatgagtgtgctacaaccacatagcaatgactgcaaggtaattgtaactcatgacaaatgagttttcctgcaggcgccaggaaacaaaaacatcacagatggctttctgaatcaaatcaaggtacaagggaccaagtcttaaattgggaaaaccgtgcatttgatttcagtaggaaacaattgcaaataagttaatcccactctgtcagtcctctatattcattactggagcctaccaactaataacagagccttgagaaagagtaccaaaaacccagcatacagtaatgcaacatgcagcagcagaccacgtcctataaccatcctcggtgcctcaggatcatatttcctatgggttttcctcccttaaaatccatccagttgaaatcagtcaatatataaaaccaagctaataatatcttgtttgagctagaatttaaagagaatgtttgcattcaagtatatacatattctatagtatgtaaaaaaaaaaaaaatggccagaactgatgtgatgttcagtatagaaaaataatttttactttactaaagtaattagcattgaaaatcccaaagcaggctgagcgtttttggttagaggtaaaattctactcctttttttccatactccaagggaagataccagaggtatcttcccacgaggactacaaaagagcatcaattggaaaaccacccatattgaatgtgtaggcacatggggtgatgaaatacacacagcataaaggtgcatctaagaatagtatcaaaaacaaggtgttgcccaaccttggcacacagcgcacaggttgttgaacacctactccgtcctgaggccaccaagcagctgcttggccaatactttatttatgccctgccctctcttaattcacacaagtgtaatatcctgcccaccgtgccactccccagcacctctccaaagcaaagaaatcttaggccaggtaagctaacaaaaaacataaaatgagacatgagaagtttcttagggacctagggtcatcagatttagcaaataaaaatgcaagatgcccagctaaatatgaattccagataaataataaataatttgtttagtacaaatacgtcccatgcaatatctgggatatacttaaaactaaaaatttacctattgtttatttgaaattcaaatttaactgaatacctgtattttatccaacaacccttcttagggtaaacatattgttaaggtaaacccatgatctattccccttctctcctgaccacaatcctaatttcctttgggaaacatccaccccattttcagccatgtagggtgtcatgtggggtaatcaaccctgaatttatgctgaacaatgaaatgcaatgagcagaggaacacgaaattttgatgggaagaaactatggtatacagtcctaggagtgaggaagcctgagagaaaggaaggtatgccagctgccttaaaccagccctttcctgcaccccctggaaatgccagagaagccaggaagaaaggaataggtggtgataactgaagagtgtgtgctatggctacaggaggcccccaaatcaagctggtcaaagtttgtattaaaccaaacagagatatccatgttgtccatgaaatcacagcggggttcacctccaaaactctccagggtgggtctccttcccttctccttatatttgtagcctgagagggtcctattatttttaaagaaagttgacgctttctaaaaaattctgaagacattaaaaacttattggccgggcgcggtggctcacgcctgtaatcccagcactttgggaggccgagaaggggcagatcaccagaggtcgggagctcgcgactagcctgatcaacatggagaaaccccgtctctactaaaaaagcaaaattagccagccatggtagcacatgtctgtaatcccagctactcgggaggctgaggcagaaaaatcgcttgaacctgggaggtgggggttgcggtgagccgagatggcgccattgcgctgtagcctgggcaacaagagcgaaactccgtctcgaaaaaaaaaaaaaaagccaggcgaggtggctcacgcctgtaatcccaacactttgggaggtcgaggtgggcataccactaggtcaggcaatcgagaccatcttggctaacacggtgaaaccccgtccctattaaaaatacaaaaaattagctgggcgtggtggcgggcgcctgtagtcccagctactcgggaggctgaggcaggagaatggtgtggacccgggaggcagagcttgcggtggccgagatcacgccactgcactccagcctgggcaacagagcgagactccgtctcaaaacaaataaacaaacaaacaaaacttattaagccagtttggggcactttgtgagctgcatgctttgcaacaaggaaactcaaacaaatactgctctaggaaacagctgccactgaagtcaaattttggctcttggtattgtttattgctttgtatgacaggctaattcttgccccagcagtatctttttcggtatcgtggagcacatatatccttgtccgcaggatagactaggtgagcttttgaaggttagggaaaatggatggttaacctagctcaagtccagctctttcagactttagtaccaagaaagattctaatccaatggtacaagtctctcaagtctcacaaatgattctttttattttttttattttattttattttattttattttattttattttatttttgagacagagttgctctagcctctgttgcccaggctagatagagtacagtggcatgataacagctcactacagcctcgacctcccaggctcatgtgatcttcccacctcagcctcctgagtagctgggaccacagacacataccaccctgcctggctttaaaaaaaaaaattgtagagatgggtctccctatgctgcccaggctagtctcgaactcctgggctcaagcaatcttaccatcgtgtcctcccaaagtgatgggattaccaggcatcagccactgtgcccatctcattcttctggcagtaatctctgccaagtatttgaaggaaaggttcagagaaaaaacatttttctttaattgtgcagcatgagtttaagaggaaaaaaagttatttcccaactcctactggaaagacctcagactccctattaaaataaatactgttgtttatttaaaaagtttcactcctttctcagtcaaactaaaatatttgtctttgatcttacagaagagtccctcaggctcacaaaagtacttatattgtattttccacctattcatttaggatacttatatacccttacagagaaactcctcagagattatctaagaactaggtcagtatttcctacgctggggaatctgctaagcgaagctaaccccaaccaggacttgagtgtggcctgtaaaagactttcccgctagaccctgtggtttctccaacctcactcctatgctttgccatttcgaaatctgaggaaaatagtctctcctgttctccaaataccagtaacttgttacccaagtgaagaccaaaacaaaaccatgaagatattcttctctgtcacaacaatctttgataaaaatattgtttcaaagacaactggcactaaatgagtattaaaaatccctgtaagttttaaactgttgatgacacatattaaaggaataaaacaaaacaaaaaatcctttcatatcagccaacccatctactatggagtatctgatcatgaaagtgtataacaatatgaaaaccatatatgcaaacatatagggaaaaacttgaagggtattattactgagacagggtcatgctctgtcacccaggctggagtgcagtggagcaatcatggctcactgcaacctcgacttccatgactcaagcgatcctcccacctcagcctccccggtagctgggactacagacacacaccctgtgcctagctaactttttcattttttgtacagatgagttctcactatgttgcccagagtggtctcaaactcctgggctcaagcaatcctcgtgccccagcttcccaaagtgctgggattacaggtgtgagccaccacaccgggctaacttcaaggatattagaataataaaatcttcggtgcgtttttttcttctgtaaaaaaattccaattccctataaattgcttttgcaataagtaatattataatatttaagtgaaccataattataagagtgttagtcccaaaataactcatataaaattacagtctgtcattttgctttggcctccagctctagcaatgaataggtagggatgaagaaaaggttttctaccaaggataaaagaagaacagcaacttctctcggaccagtagccaaagacaaagatctaaactgtttccactctcctagctggccacctcatagacaggatatggctctatttgggacagataatcagaatttcttcttgcctttcctgcagaccagctcagtcccgctcagctcccgtaccttctaggcagaaatagtcttgtcacttcatgtgaggccccagtcacctgcttaagcccttttgcacttattgggcaggtaaacaagagtttgcatataaatcggggcaccttagctctaggatcaataggaagcagagtcacaatgcctaaggtaatgagaacggttaataactcagatgattaaatcctccttttccaggatcatggtgtagaccaagagtacctgcagtcacgccaggaatgacgtccattcttacctcacccatctgtttttgcacaatttgcatttagatgtagcaaactaaatttcctttactcattccttccttgtttttaagctctacttaattctgacaaggttcacaatctaatgatggaaaggacaggcttaatggacaaaaggggatgtcagcctcccagaaacaaatattcttttgttgagatctcccacacaaaatgtggtcagtatgtcagcctggaaatgttgaccttttcacagttgccattaatgggtcaagccagtgggagaaatgccaggcaagagctgtccccactcacctggggtcagaatagaggaagaggaataaagattcacataattctcacagtcaaatttctcgacctcctaccaatatcatgggggcagaagctaagtttagatgaggaaaatgacttactttccattctctcaaaagatccactattataagagtttatgtttctaaaacctccttactttaaaataatttttttaagttgttactctgggtgtagagagaggccttgcctaaaatccaaaattgtcgggttccttgattcttaatgacattagcaaaatcagttctgaaacaccactctccaagcaaagtttggatcaaattaacatttcatctctccttcagccagttactaaaaaaggcattttcagtcttcacgtacaaaccccaaatataagtgccaatggatattcaataaccataagcaagctcagaatcaccacctaccctctggcataactactttcaggtaaagcttaccaaaaaacagcaatgcatcctccttgcctatcccacaaagaatgaaattacactcccgctgtatcttctcagagagggaaaaacatttcactccctatagccattcttgtcaaatgacctgatggggtagtgactggagcacaaatccagatccaagatcaagagaggccattaacacacacgaagggagacatgaattatcccaacaaaattaagtaggtccactctgggtactgcaactagggtggtgatcctgggctccatgcttggtagggaagagctgtgaggcatgataccttaataaaattgagaactttaagcactttatttatttattcatttagagacaggatctcactctgtcacccaagctggagtacagcggctcactgcagcctcaacttcccaggctcaagtgatcctcccaccttagctcccctgagtagctgggactacaggcgcccaccactatccacagctaattttttgcatgttttgtagagacagagtctcactatgttgcccaggttggtctcaaactcctgggttcaagcgatctgcctggattcagcctcgcaaagtactgggattacgggcgtgagagtactttttaaaaaataatttttactttttaaaatttatttacttatttatttttatagccttgaggtccctctgcattggttgagttgccccaaggccacgtagtttctagcatagctctgactctaaggaaacaggcaaggtagttcccactttaccaacgaggaaacgtgcttcctgaagttatgtaagctcattatgtggcagatccatgattcaaaccagtacgtctgattacaaagctcatgagtactctctatgactgctctctgacattgatgaccaagcatccaacctgtccatccacacaacgcaaacaaagccattaagcccagatccctacctttaaagcagtagagggaaactgctgttggcaactgtagaagccactaaaggaagatcattttccactcaaaaatggatgtaattttcaaaaaggtggagacaacccaaaagtccaccaacaaatgaatggataaacaaaatgtggtatatccatacaatgcaatactattaagccataaaaaggatgaagttctgatgtatgctacaacatagaggagccttgaaaacattatgccaagtgcaataagccactcataaaagactacatatcatatgattcaatttacatacaatttccagaataaacaaagctacagagacataaagtggattagtaatttcttaagactggtgaagatgagaatgtggaggagaggggcatggctaatagctatctagttagttggggcttctctttttggtgatgaaaatgttctaaacctgactgtgatgatggttgtacatacctgaatctattaaaaactattgaattacacacttaaaatgagtgaattatgtgctgtgtaaattatatatcaatgaagctgttaaaaaataagtatggccaggcacagtggctcacgtctgtaatcccagcactttgggaggctgaggtgggaccatggcttgaggccaagagttcaaggacagcctgggcaacataggaagaccccatcgctacaaaaataaaataagccagccaggcatggtgacgcacacctgtagtcctagctacttaggaggctgaggtgggaggatctcttgagcccacgagtttgaggttatagtgagctatgattgtgccaatgcattacactctgggtgacaagtgagaacttgtctctaaaaaataaaatatatatgcaagtgtaattggttaagcaaattaaaaggaaacttggccattatctcctttaagttcttcatttaagggtgaggaaaccaagtaaaaagtccaatattaggcaagcgtcctacctactaatcccagtactcaacaatgtcctttgggacccagctcagtgctaggtataatggtagacccccaaagagtttaaacctaatcaggctttttgaagccaggaacaatgaaatccaacagcctgtagactgggttcaggggtggagcggacactaagagctgtgtagtcaggcaggaggtgagacctagaaggaaatccatggcagaatgaactgatggagggtcagggaagaggtgagtgagggtgctccagggaaggggtacaagcactgccaggagctgtgggtggcagcaaatgggttgcaagggaagtgaggctcgatgagcagggtcacactgtcagattctagaggtttaggaaccaggcaggagatcagccctgacaggacaggacaccaagaagagttctgtagcaggaaaagggtgatgagagccatcatgaaggaagattagcctggctgtggtgtgcaaaggactgaagtcagaggctagtgtgctgcagtctacaaataaatgatcacatcacacagtagggtggaggcaacaggaatggagaaagaggaaggaaagatgagaggtccagaaagggaaaaataatgaagacccaaccatgtcaagaccggtgagagggaaaaggagagccagggtggctctgggcccagactgcccaagtttaagtccttactagtgtgcggctttggtcaagttccttaaatgccctgtacatcagttttctgagcaaagtggggataaaaatagtgtttctgtcagagttcttggcataattaaatgtgaacagtgtgagaacaatgcctggcacaaagtaagtgctaggtacacgtttgttaaataaatacacgtaaatgcatattaagatgtctgtgacccagcttctaaagataagagcagtaaggaaaagcctcattatctcccaccaaagtttcctttttcactcattttttcccgtttatttatcctaaggttctgggaagaataaaacatgttccctgcccttgagaatgggctttcaaggagaaataaatcagaaaacagagcaatgcctattccctaccaaggtccatgcacaataaatggttgaatgacatgcttggtgaggatcccaaagaagcaagtgaaagaccctggatctgtcaggctgctgttgtgcaagtccacctctcctgtggagctcctgtttgcaaggcagccagtgacccaaggccatgctcagctggcattcgccctttcacacggatgtgctttccagacactacctcagcaccagcaaccactgagcctcttccctgccctgattctcagtagctcaccctccagacccggccacggtatatcctcaccatgtctgtcccctcacaacttaaatcaaagactctgaggccaaaccttgaattgacaatgctagccaaaaagctctgagcagggatggaagactaaagaggagaggaggaatccctgcctttcttgcatgggagggagaaacacattctgtgatcttgaccaaagagccctgtataatcagaaatcagcagaagggggccctgctctaccctcttcttcatgtggttgtgacaatgttcctcttctcctggctagctcacaggagtgctggggatacagtgctctgggtctccatatttaaaagaagtttaaattatcatacaaatgcattgtatttttagtaattggacttgtttgatctcatatcttttgataattactaaaaatctcccttcaaagtgatgaaagattcaaatgaagctagaatttaatttatattaggtctttgagatgaggtttaagtaacattacagtcccattactaggaaaacgggtaaataaactgtgtatagccatgaaatggagtaacgtattaagatctctagctgctgtcatagaacaaaatactttaaagtggtgggtaaaaacgaagttaaggtacaatatatagaaggagaagaagaagaagaaggaggagaaggagaaggagaaggagaaagagaaggagaagaagaagaggaaggaggacgaagaggaagagtaggaggagaagaggaagcggaagagggaggaggaggaaggagaaaggaggaagaaggaagaaggagaagaagaaaaacttgaatcattggtttctacatgcataagtctgaaggacagtccctgaactgagaaatgggctctccttctggggagatgagcaggattggggatagagggtcaagaaagtctattgctttagctgaatttcttaaagcaagaatgcatttatttatgacttgggcagttttttaaaataaaaaaaaggcaatgttgaatatatgaccatctatgagtaaagtaaacctggtttataattttaaattcttcttccctttattctggtcaaaagggaattcattttcccacttttctgagatctgaaaagatgataaccttatcaaatcttgggtctgtgtgatcttaaaggacaagtaaagaataaaaaagttcaagtcaaaattttaaatgaagatattaacaatgaataagtaatttagaatgtgatgttcccaggagaatgaattttcctggattaatctggctaaactttctttgaagtttgtggatgatggcaacaccactgaaaatgaacttgaggctgtgtttaaatacttgctacaactagcttttctgacatctctgtactcactactgacacagtcaatccacttaattagttttgttgatatctccaattcccctatttactttgtgtcctgaaaagtcctttgaaacccaaacagcctactctacctcttcagctccattgggaaaggttacgatcttaggatcatttgaaaggcaaggagggggtagtaaatttccaccatcaagtggaatgtggaaataatctgggaatagatgaatatattgaattaataccaggaaattttcctttcttggatcttcattgtttttgcttgaaaaactgattttttagaatttatagtcgggctaagaattaaatacaaagaatagaatatattctaaagtaaaatatacattatatgtatcctttatgctaagcacagtaccagtatgtggcacacagtatgtgctccataaatatgtattggcttattgcataggaaagagtcaccagaaaatctaaataatgtagaaatttaaaagaaaaaaatcatttatatttctttcagcaaaagttaaatgaatccctactatgcatgccatgctttgggccaggcattagagaagtattatgcacaaaaaattagctgggtgtggtggcaggtgcctgtaaccccagctactcgggaggctgaggcagaatcacttgaacccagggggcagaggttgcagtgagctgggatcatgccactgcactccagcctgggcgacagagcaagactgtctcaagtgaaaaaaaaaaaaaaaaaaaaaaaagagagaagtattatgcaaggcaggtaagatttggttcttgtcactatgagttcatagcatatagaataaaaataaaggacaagtactctctatcacagcaaataatcaaaggttgtctattatttctaaactcaatttcacatcaaacttgctatattattacatctaatctaaaagcatcaatttctgcctgtgaccacccagtcacattttgattattttaacagcatattgagtatgtttttttttttttgagacagagtctcgctctgttggccaggctggagtgcagtggcatgatctcgactcactgcaacctctacctcccaggctgaagcaattctcctgcctcagcctccccagtagctgggattacaggggtgtgccaccatgcccagctaattttttttttgtatttttagtagagacggggtttcaccatgttggccaggctggtcttgaactcctaacctcaggtaatccacccacctcggcctcccaaagtgctgggattatcagcatgagccaccgtgcccggcccatattcagtattaacattaatctcaataaatattccctagtaccaatatgtgctaggcatgaaggacaatacaacaccagttccatattctaagaattggcaagttggagaaatgaaataaacccattcatttacaaacaaaccttacacgacactctgatggacagtagaaaagattaagtggcaaattaccccaatagatcaaattactatggggatctggagtaggaggagatcccttctagttggttggtgtaataaggcattagacaggagatggggctggctaagtcttaatagaccaagcatagggatgtaggacattctaggcaagtgagaaatgacacactactcctaatcaaaagtgcaaagatgagctactctgtatgacatatgcagtggcaaccaggcacggtggctcacgcctgtaatcccagcactttgggaggctgaggtggtggatcacctgaggtcaggagttcaagaccagcctgaccaatatggtgaaaccccgtctctactaaatacaaaaaaattagccaggcgtggtgctgtatgcctgtaatcacagctacttgggaggctgaggcaggagaatgacttgaacccaggaggcagaggttgcaggaagccaagattgcaccattgcactccagcctgggcaacaagagcgaaactttgtcaaaaaaagaaagaaaagaaaagaaaagaggcatgcagtggccgtgagcataaaaggagagaaaactagggaaagaagcactttaatcgtttacggagcttccttcaggcctgtttattaacatattccaaaaaaaatcactgctgtatgtacatatatgccttaagataaagaggagcaactggaaagagatacaagccccaagtacagtatacttccctgacatttgtgtttttaaagagttcatttaaagggcaatggcataatactagtataattcacataatgctagctctgggctttggacttttaaccaaatgttaaaaatgactccttttctcttgtctctgcgtgtgcttctctgactcgcttggcctgtttccattctctttcttttttctctctccatccttcttagtgtaagttaaaaaaaaaaaatcaatgccgcaagttatgtttaaattcagcccacatgacatttccttcgcatttaattgcttccatacaatttatatccgctagtcacgctagaccccagagtattaaacatgctcttttacaaagaagctcttgtcctgtaataacccccataatcaaagttcaggaattatgggtaaggctcagccggccgatggggaaacaaacaggtttttaaattcatccaaagcaggcttcaggcaggaagcaaatcaaagccgtcactctaccaccaggtttgagagcaaaaacaccgcagaggctagctcaaacgagagatactggcatctctgcacatccagcaaatctgatgccagatactttctctttgggctgccgtgaagaaccactaaacaatgccacttaaagacacatggttacattctctctgctttcaaggcagcccattccaaaaagatctagcaatggtctacaaagactgctcttaaaatgcctctaaatgaataaatcattcttctttgttattcagagtagactaagactaaaattatcttggaaaaaaatatatatatacagggtctctttctgttgcccaggccagagtacggtggtgcaatcatagttcactgcaaccctgaattcataggctgaagtgatcccccttgcctcagcctcccaagtagctgggactatagcagtgtgcaccaccacattctgttaatttttaaaacttttttatagagatggggtcttgctctgttgctcaggccggtctcaaactcctggcctcaagccattctcctgcctcagcctcccaaagttctgggattataagtgtgagccacgacaacctaaagttacctcttctattttcctatagacagcttggacaacatgtctggtcttctttcatactaatggacagctacattagtatgtagctctcaaggtctcttataaactcatatttctgggcacttttacaacttatcccattatcttccccacttctcaagaaatcacctccccaaaagttcacctttgaaaaagtacagaagttggctgggtgcagtggctcacgcctgtaatcccagcactttgggaggccgaggtgggtggatcacgaggtcaggagatcgagaccatcctggctaacacggtgaaatcccatctctactaaaaaatacaaaaaaatacccaggcgtggtggtgggcacttgtagtcccagctacttgggaggctgaggcaagagaacgttgtgaacctgggaggtggagcttgcagtgagccgagattgtgccactgcactccagcctgggctacacagcgagactccgtctcaaaaaaaaaaaaaaaaaaaagaaagaaagaaagaaagaaagaaagaaaaagtacagaagtcatacaactacacaggggcactaacatgatttcttggattgcccttattcacgtagcccacttttcacaagaattgtgcctacttttcttacaaaatctctttaagcaacatctctggtcttccccactgtattcagataaatgcctctctaccagtgtcaacaattttaagaaacctttaatttcacccaatctcctctgctcaaaacccatccagatcaagagcaaaacaattgaaactatttatcagatccagacagttgcatcttaaagaactttttgaaagtttctatggcttgcatctctgatggttttcataaaccaatgcttttgtctatagataaaggttagaaccaatatagattggttttgtttttgtttttttgaaacagagtttcgctctgcccccaaagctgaaatgcagtgccccaatcttggctcactgcaacctctgcctccctggttctagtgaatctcctgcctcagcctcctgagtagctgggataacaagcatgtgccaccacacccagctaatttttgtatttttagtagagacagggtttcaccatgttggccaggctggtctcaaactcctggcctcaagtaatccacccacctcggcctcccaaagtgctggtattacaggcatgagccaccgagcccgaccagaatcaatacagtttggatcagagatatcatgctactcttagaaactggcagataataaatatattatttatagccaataaactacttttggtctatcataataaaaaaaacaattcctaagctatcactaaaacatgatgtcatttgtggttgctttattttgtatttactatacagatgtattctttattgtgatggcctagatctggacatattcagagccaaaattattttacgtatcaagtcactggcaaatcaaagaaaaaccaaattatttaaacattcatttaggagctcatatttatattttggaaatgaaacctcatattttaaggcattcgatattatttattatgcagggtccttttatcttgttccacaatataactttttgttttactcttggcagactttactgtcactgtacaaaacagacattgttttaaaaacccatttgtaataagtgtcagtaaatatgatctttcgcttcagctgaagcaactctatggcatcagtttacacctccacacttacttggaagtttataatgcttgttttcagcagctttcacacctagactccatacgatatgtaccagccaccaagatgtttaccagtcctcagaagggcctttcgagaactcttaaaacttaatttgttactgacgctttgcttaaaggacaatgcactttaattagccacaccactggccctttattcacacacatgaggtaagctggacattccaatgcatgtgcaactgggaaatttgagtcctttaatggttttcaacaattaactagggccggccaattgttaggttaaacaaaaagcactgtggcaaaacttgactcacttcactacggctaataattacaaaaggttgtgctggtccatccctcactctacttacctgccaaagtttcaggcaaagtctcaacaattgggatctaacctttaaaatcatttctttaatgttgacactccaaattgtccataatgaccctacattctgctcctactgttaataatcaccaactacttaatagtttattaaaaagttagcaacagacaaatacaaagaacaatgtttccactgtgtaccatacggattacagctcttggacctttgcttgagaacacagctttccaaggcccaaagcacagcccctgtcatcttcatacttcaaatgcagacatgcaagatcaataactcaaggttaacttttcttagatgatagataagatagctaaacttttttaaaagcctaggtaaaaaagagatgttttaaacatacccttggctacagctcaacttttaggtagctgatcctttctccattcctgccttctttccttcaagcttttctacaatatagccttatggttggattttatgttaaaatgtacgaatgtggccgggcgtggtggctcacacctgtaatcccagcactttgggaggccgaggcaggcagatcacctgaggttgggagttcaagaccagcctgatcaacagggagaaaccccgtctctactaaaaatacaaaattagccaggcgtggtggcccatgcctgtaatcccagctaactgggaggctgaggcaggagaattgcttgaacccaggaggcagaggttgcggtgaactgagatcgcatcaatgcactccagcctaggcgacaagcaaaactctgtcacacacacacacacacacacacgaaagtacgaatacccaaatataagttggatgatataattttgtaagagaaatccggccgggcacggtggctcacgcctgtaatcccagcactttgggaggccgaggcgggtggatcacgaggtcaggagatcgagaccatcctggctaacatggtgaaaccccgtctctactaaaaatacaaaaaattagccaggcgtggttgcaagcgcctgtagtaccagctattcgggaggctgaggcaggagaatggccggaacccgggaggcggagcttgcagtgagccgagatcgggccactgcactccagcctgggcgacagagtgagactccgtctcaaaaaaaaaaaaaaaagaaatccttatttgccaaaagttgcatatgcatagggttatatttcacataatacctaaaacaaagacccaaaaagtggggacggttgcactagagaatgcatctgcagaaaacctaagtaattttatgagcagcactcaagtttactgcttcttttatgattcttaatcccgcctactaaattcacatgtctttacaaatcccaaatctgtaacaaggccaccaaatgctcccaaattagcaaaatacagaatagccttttaactacaatacaagctttaactacaaaatgcagccaaactcaaaccagtttgatataattaaacatgttttatttaccttatattgtgaaagggcaaactggcctggcgaacttacttgcattaatctgagtcccctttgccaggtatcaaaatcagttccagtgaatggagaaacaaagataggaaagataaacatttatctgaaactacagttacataatatttggaaccataaattttttactgatactctccaaacataatctgctatttttatggctgtaatttagttatgacgtgtgccagcaataacagtcctgtgcactacaaattgtgacgaagattttaccaagctaggattgcagactgtaattttcctcacagcaagtaatgatcatatcaattagagtcatgtttttacccgagtcttataacttagctcagttagttataaaacactgatttcggaccccattttaataggatgcttaaacaagcaaacgtgtggtatacggcaataaagtgagagacactataggttatatggaaacttgtgggactatgtgggagtgtattcacaccttatctaattgagatctttattttccttatttttctgtctctcaaaactaaattatctgaattatcataagaattagtacctcaggccctgttatgacctatcctgggaaagaaagtgtcctcgtggaaaagtcattcactggacatttttcagtccttatcttccttgacctctgagaaacacaccacagagctaaccattctttcttcttgaaagactttcttccctggcttccacgcaccactctctggatttcctcctacctctctttctcttctctctccatctctttacagggtccatcagtacttcttgtttcttctcattctatctgtaacctctctaagaaatctcaaccacaccaggatttgaataattatacacattccactacaccccattttcctcccttgggcatcttaaagtcacttcaaactcaatatgttaaataatttctccacttcttccaaggctcccagtacggcttgctacaattagaggcgccaccagccctgacattatacagccagcaatctgcaaatcttcctttcctcctgctttactcgctgcctttatccaatccatcaccaaatcctgtcaaatttacctgctaatatcccttcagtgattaaaatgatctcacttcttctcttttccagcaccactaaagcaacttttcagcaattaaatcactcttatgaataccttcattccagagtggcagaatattccagtcactacctgtgcttctggaactgtaatgaaaatttctatccctgtttctccccagtatggctcacatcagacagtcctcgaaaacctgaccagttttgggccagcagagacgtcactttcttgaaccaaaaagtcaaatcccagtctctagatcatggttaccccgataaggcttttcaccctgagacatcccatcaggcattgcatccagttctccagaatttaatccatgtctgtactctacccggtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcagggtggtggtggcagggaggtgggcagtacttttactgttcacttctttttttacttatttttttgagacagagtcttgctctgtggcccagcctggaatgcagtggcctgatctcagctcactccaacttccacctcccaggttcaagcaattctcgtgtctcagcctcccaggtaactgggattacaggtacacgccaccatgcccaactaatttttgtatttttagtagatacggggtttcaccatgttggccaggctgctcttttattttatttatttttttttttttgagacggagtctcgatctgtcgcccaggctggagtgcagtggcgcgatctcagctcactacaagctctgcctcccaggttcgcgccattctcctgcctcggcctcccgagtcactgggactacaggtgcccgccaccacgcctggctaattttttgtatttttagtagagatggggtttcaccgtgttagccaggatggtcttgatctcctgacctcgtgatctgcccgcctcggcctcccaaagtgctgggattacaggtgtgagccaccacgcctggccccaggctgctcttaaactcctgacctcaagtgatccacctgccttggcctcctaaaatgctgggattacaggtatgagccactgctcagcccctacttttcactttataactttcagttctgtttggactttttggtaagagtatgtattatttttataacaaaagccagctttttaaaaacaaaccccaaaataaatgaagtcagtaaaagttacgtttgttcattatagtcacatttaccatttgcttgggttttctcctttctgatgggttatcacacacagttgcagcctcaactatgataggtgcccaggtgcccctttgaaaacctaggctaagaagtgctttgcaagtgcaaactaggagaaagatattcagtattttaatatctgcagaaaagccatcacaaatgaatattttttttttaaataaacaacctagcatgtgtatttttctccagtcaccatgttttgactcctgagtctgtcactggcaatgcttaccagcagactagtcacaaaaaagaacagaaattggatttttgtacagtgttcagaattgagatgtgccacagcaaaattttaaaacaatgagttactgtagaagccacaaagacataaaatatattatgtactagaaaacagattatatacaacctttgtgccatagatttccattttaagactgaacctcttagaatgattattaagttaatgaaaggtatgattaattggttgatgcaaaaattatagctagaaggatggatggaaaaataaaacgataggtaagtaaatagatgaattgattaagagatggatgacagacacattagataggtcgttaagagagataaacagattactgcttctcaaactatctgtggtgaaggaccggggttttatttccaatctgtcaagaccagtatgtagtcctatggtggatggcttatacatagctcacaccacatgtgactcaccacacaagagtgacacacccaaactaccctgttccacaagataattgcattggtcacctacttggatgtcatagcaatgccattttgccataaagtttctaaatactctcaacttctctatctagctcttcataggccagttataattcaactgtacactggcatcagtccatggaccatactttgagtagcactaagctatataatcagttacttcccagcagtatgccatcagttcttattggttgggcatccactctaactggttattgaatttggtagaccatgcatcagccttgtataagaaggataagcagactgattgacagatagaacagtggatgacagataaattagataaccgactagctagctaacaaattagatgggaaccggagagctgttctttgggcaaagaatatttctgaataaagtgttaacaatggtactttctaaatgggggattcagagaagatcagaagaatttcttttccactttcctccctccaacagtgtttgagcatataaaattttaattaaaaagagaaagaaacaattaaatgtccatcagtaggggacatgatgtacatttaaattcctaagcaatggaatactatgtggtccttaaaaaaaacagaggtttatgtacagaagagaaatgaactccaagatatattatactaagtgaaaaaaaaagaaggtgcagaagagtgtgtacagtacactaccattgtgttgtgttgacatggtctaggtggatatctacattgatacatgcatgcttgtactcacaaagagtttctctgaaaaaacaaaaaaactagtgctctggggagggggacaagaggactggaggagagtgaaagaaagactcttcccagtaaatgcctttgtacttattttaggttcttggtatttaaatgtatttattacctctttaaaaacttttttttttaatttaaagaagtcacctgaaaacatgaactttcgagtttagaaaatgcgttcctgagagggaggccactggctgcccaggcagggcatcctcagggaactgggcctaggtgggccctggtgggatgactatggttccagaatctcagttttgtctgtgtctagttgatcagcctcagaggaactgagaaagtaccgaaaaccacaagagagtattctgggaacaagcagactcaaaagctattcatttacaagcagaaatgatagatccagcaggggcggtcccaagtcaagggtagcctggtatcccacttacttgggaagtaaagaccacccacaattttggaactgtacttgctaaattgaatataggatggagctatgaatggaaagataaaaagaccataatttccagactcttttaagtcagcataaaatgcttagttctctaaacaaccaggaagatctcaacataggtgacaatggtggggtcttacgctacagtcacaaaaagctaggactcgtgtatctcaaaactaaggagtgagaaagttgacatttactagcaaaaggtcaatgagcccaccctagctgaggctccagaacctcaatgggatgcataatcatctaccaaccaacacctatcttttaatacaagtcagtacaagctcctcttagtctcaaaaacacaccctcagcatttctgcctctatacctctcttcccatcctgtttttcctggaaggcttgtctgcacacctacctatatctttgccactttttgaaggttccatttatgtctaagcacctttatgagacttctctgaacacccagccttcattcatctccctctccactgcatttagtatctggagctctgacattaatcttgcagtcaaaggggcacagatacaatggaatgccatttccaagcatggaagactcctacgaattccagggtgcaagtttacaatgaaaatggctaaaaataaataatacaggattcctttcgaacacctactatgtgccaggcactgtgctcaagttaagcaatgccaagcaagacaaacatcgttcttcccctgatggaggttacagtgcagtaaaaaaaggaaaaccaaaactaaacaaaacaaaaaaaaaacagtaatatgagagtggagcaatgactgaggaaacagaagggcctatgggaggaggagcagcagcatctaatccagagtgggagctgcaagttggggaaaagttcctgcaggatgtggcatctaagctgatatctgaaggtaatggaggagttaagcaggcaaaaagcagggaaataatgttccaggcaaaggaaacagcttgtgccaagttcctgaggccagaaggagtacagccaatgggagaaactgacagacattctgtacagctgcaaatttcagacctttagtcatattataaatgactgacttaggacacaccttacaaaggcttccggcaaaccaaggtggaaggcagctgatccaggctctaggaccacaggtcgaaaccagctctttggcctggtttgtctgtgttccccttctctctccagattctgtcagctgcctgcggtgataaagccagccacacatttcttcttttaggacatactcacgatgctaacacaaacaggagttcaatgcttttttttaattttttttattttttatttttttgaggcagagttttgctcttgttgcccagtctggagtgcaatggcatgatctcggctcactgcaacctctgcctcccggattcaagcgattctcctgcctcggcctcctgagtagctggaattacaggcaagcgccaccatgcccggctaattttgtatttttaatagagacagggtttctccatgttggtcaggctggtttcgaactcctgacctcaggtgatctgcctgcctcagcctcccaaagtgctgggattacaggcgtgagccaccgcgcccagccaagttcaaatgatttctagttgtaaattagctgaactggctaaagatcttttagatggcacaaaggcaaggccctggaagatcatcgcccctttcaccgtctaaatcccgaacaataacaggaatgaacttgcaaaggtggtgtttgtgccaggcactgcgctcagcactttataaatgtttcttcatttcacttcttctcctaatagcactgagcaagtgaacatcatcttttcctttcttatttattttctgctatgcctagacggaacattaaataaaagctagaagtccaggaaagagagcatgcaagtaaagaataagctgaaagaaatccatatgaccgccgggtgcagtggctcacgcctgtaatcccaacactttgggatgccatggtgggcagatcacctgaggtcaggagtttgagaccagcctggccaacatggtgaaactctgtctctattaaaaatacaaaaattagccaggcgaggtggcagatgcctataatcccagctagtcgggaggctgaggcaggagaatcagctgaacctgggagcaggaggctgccgtgagctgagatggcgccattgcactccagcctaggcgacaagagtgaaacgctatctcaaaaaaaaaaaaaaaaaaaaattctgtagagacagaatctcgctatgttgcccaggcttgtctcaaactcttggcctcaagcaatcctcccacctcggccccccaaagtgataagattagtggtgtgagtcaccttggtggaaatcttgatgagaataaaatataaatagacaatggaggtgtactacccatttctggtatatttgggttttcttccatcatctctatctcaccatcaatgacagttccaaatagcataacccagactcagttcagaagcaaactctaaaaatccatccaccactccaccaccacagttatgcgatcatcaaggatacataattacaagacctaattatgggccacacaattggcatgagacagcatggcataaggacaggaacacaggttttggaatcacagagttctaatcccatctctgccactcacctgttatatgaccccaggacatttatttaacctcactgagcctcagtttacttaacagtaaaatgaggtaataatatatacctgttcatgggatcactgtgagggttaaaagaaataatatacgtaaaagcatctagggttatgaaaaagttccatatgcatataattctgttgctatctctctgggatgtgctgactctcactctctgccttgtctggcatacagcaggtaatcaacaaatgtcaattacctttcctgctcatctcccccttctccatttcctcttcctcccctatcccacacacaaaaacagctcaatttgtagtgacaatctagattccaaacaataaaaactagacacttctcagatggagttgggtatcctctgcccaaaatgctgaagcaaaagggcacttacagtgagcattcctatttaggtttctcttaaccaggaaagttgactctaactccttattttaaacttaaaactgactttcaactccagatccaggttgtccctcaaagctacagctgtaatccagagtcaaaaatcacctgacccctattgccaaggtttctgcttctgattttggctgggtaaataggctatgtgtgttgggagagagagaagagaaagcaagaactaacttgtactgaacatctcctgtgcgccagatgctttaaatatgctcatctttcaaaccacaatgcaacaggtatcactctcttcacattacagacaactgagttagcagacagtattttttgaatgacaaagggcccttatgaaaacagctacattatactgtcattcaaagataaacagaaaaaacaagccagagtcagaacaatttttaagtaaatacgttcagataaaaaaggacttgaaaaacttacctcctacaaaccacttcttaagaagttactcaagcatgtactgcagcaaaatgagggataaaccaaaaaaataggaagacacgggaaaaggaaacagcacttccagccatggaaagaagttccaggatgacagctctgtagtgggcttagtgaataaccagttcagaacggcacagaacgagaaaggaatctcggcatacagcttagacaaagaagactcgataggttagacaagattgagagcctagaaaacttttgagatcataataatggcaaataatgcatgaacacattaaaaggcaatcagaaatactagggaaaaaatttaagaaagtcatggtccaaatatgaaaaaactaaaaggtaacacaaatttaaacaactgatgaagagtgagaaaacaaaaaatcccatttgactttggggctagatatctcatcctttgattggcccaggaatcctaaaaccagacccacagtgcaagtctaaaatccaatcctgacacacaaggcaatgaatcatttcacagaattgtagtcatgtaaatgttgcctatggattttcttttttttttttttttttgagatggagtctggctctgttgcccaggctggagtgcagtggcgcgatctcggctcactgcaagctccgcctccggggttcacaccattctcctgcctcagcctcctgagtaggactacaggcgcccgctgccacgcccggctaatttttttttttttttttttttttgtattttttagtagagacggggtttcacggtgttagccaggatgatctccatctcctgacctcgtgatccgcccgcctcggcctcccaaagtgctgggattacaggcatgagccactgcgcccggccttatggattttcaactttaagaatcatatacgaataagatggtcaactttggggcaaagcacaaatacaggttatgggttcagggctttggcaatgtggaaagcaacattgtcaaaaagtgaacagtagaactggtagcaatccaaacattactgacatacagcataaggaatcaagaaatactatccaaagttgaaaaagccaggtgtggtggctcacacctgtaatcctagtgctttaggaagccggtgggaggattgcttgaggccaggagtttgagaccagcctgggcagcataggaaaccctgtctctacaaaaaagttaaataaattagccaaatatggtggtgcaaacctatagtcgtagttactcaggaagctgaggtgggaggatcacttgagcccaggaatttgaggcttcagtgagctatgattcccactgcactctagcctgggtgacagagacagaccccatctcaaaaaaaaaaaaaaaaaaaaaaaaaaaaaaaaaaaaaaaaaaaaaaagatgattatttaaaaaaggtgacctaacagacaaatttaaaatattataaacatcaaacctgggagagaaaaaagaaaactagcttaaagagctacattctcactttcatatcaggtgctaaaagttgataaatcaaaacatggtggtaaaagcacattacttaagcttaagaaggtaacaatctaagaattaaatatgggtacagttgaaaaaaattaaaagttgccctctgtgagccttgaggaggtgaaggaaaccattgtttttcaacaaatgtcctcctgtatattggatttgttaccaagtgcatggatcacttggacaaaaataattttctgtcacacatttgagaaaaggcaaaacactaaaattgtcactaaaaatgagacgtggcagccaaatgttatagtctgaattgtatttaagaggaggataaaatcttttttcttataaaatcacgttactcaaatgaaagatttttacaagaatgtttgcgaaagagtaaagatgggaaattctactgaagctagataactttcttctttataattccccattttctggtttatgtatagaaagcatgtattctatttataatcagagaccttttaaaaatttaatgtgatcagtattcagtcagtgtgccaggttgcccaacaccccagcctgattcatgagattgagaggacagcaggaataatgaatgaacacagtggttttcagaggctaggtgttttaacattcaatctgcttcactgttactctaatttttaaaaactttttatttagagatggggtgggggtggtagtggctgcaggtgggcaccaccatgccctagtcattgttactctaaaggaatatctgaataccacaggacacctgaacaccacaggaaagctgtgaatgctcaggaaaggtgccttcaggaggttgcagaaagtgattacatcatatacctaggaataatcttacctgagaaaatgacaaaaggcttttttaaagcttcttagatgtccaggctctgtttcccattaagttcattgtttagctaaggaagtgacatgggggaaaggtgtcggtggggaaaaaggaaaactgttgcctaagtagacagcaacagattagaggtccagtccagggtccaccattaaataaccacatgactttcccaaattcctatcatcacccttccgtggcctcaattttctagtcaaaaactaaactaaacaaaattgacccttgtcattctaaaatcctttgatttccaacttataaagctctcaactcccaacagagtcaagaaaaagattcttcttctggctgggcatggtagctcatgcctgtaatccaagcactttgggaggccaaggcaggagaatcacttgagtacaggagtttgagactagcctaggcaacatagtgaaaccccatctctaccccagccaaaaataaaaaaattaaaaaaaaaaatgtatctgctagcctcagccctatttcatagatggcaagtaaagtaataaacagacataatgaaaagtaactccaagtgagtcaccatcatttttcaagcttctacttaatccactgaaatacactgccttttgaggctgtgtaacaaagtgtatgacatttacctaattccaactttaaacaaaactctacaagaaattcagagaactcttggcagattgcttatccttaaagacaatagtcactgacaaattcttaacctctcttagtcacttggccaaaatacttccagggatagcatcagagcaggccagcctactacttacacatttttttcagctgtcattttcattgactacccaaagtgaaatgaagatgcactctgctttggattggagagtggttgtggttggggggatgggcagagagatcacagcaactttctctaaatccaaggctaacttccacttttgcccttgttcacaggcagttctgagctactccaatcattcaaaacacaatgtataaaggaatttttttgttttgcttttgtttcagggtctttttcgtctagttttcctcagatattaggcaagcctagctcctatttcatatttttaataatcacagttatactgatcatataccatacgtatgtgtgtatatattcataaacacagtttagaaatcatgtagggctggggccaggcgtggtggctcacacctgtaattccagcactttgggaggccgaggcgggcagatcacgaggtcaggagatagagaccatcctggctaacatgttgaaaccccgtctctactaaaaaaaatacaaaaaagtagccgggcttggtggcgggtgcctgtagtcccagctactcgggaggctgaggcaggagaatggcgtgaacccggtaggcggagcttgcagtgagcctagatcgcgccactgcactccagcctgggcgacagagcgagactccatctaaaaaagaaagaaagaaagaaagaaagaaatcatgtagggctgggcatggtggctcaagcctgtaatcccagcactttaggaggccgaggcaggcagatcacttgaggtcaggagttcaagaccagcctggccaacatggtgaaacctcgtctctactaaaaatacaaaaattagccaggcgtggtggtgggtgcctgtaatcccagctactcaggaggctgaggcagaagaattgcttgaacccagggggcggaggttgcagtgagccgagattgtgccactgcactccagcgtgggcgacagagtgagactttgtctcaaaaacaaaaacaaacaacaaacaacaacaacaaaagtcatgttattacatcatattcttgactccaccagctacttagaagtcaaaggactgagcacatgtccaaactatcactcaataacccagagaagaccagctgtggcataaatgaccatcaagtctgtttcagaatctcagcattacaccaatctcagaaacaacaaaagaactccttggacaagatatcaacagccttgagatggggaagtaataagaattggtcactggtatgaatcaatgggctcactatagtaaacttcatccatcactgtgtattcattcttagggctctctcatagcaatcagagcatcaaatattagtgccaaagaaaggcttgattaaacttttaaaattgtacatagtgtcttcacttttgcactaaggctactctactaaagaaatatgggctttaaaatgaagtctaagtcaagttcttaggagaggagtttccctcactggcagtgcaggcaatcctgaaacaagtggttaggctggcacaacctccatctttgatagcctgaccctatgacctcaatggaacatttcaagttccagcctggtttctcctgaggaatgtagttatcttagggtaccacaattgaaacaacctcctctagtgtttgagaatatattttcctgtggggtgtaatttgaaaatttcaactaatgtaaaattcatgacatcaaaaagctggaacaatgtgaaaggaagaagagtgacaaagcaggcttgtgatttgatggtattttaggttaacaagtttaatgtaataaaactcctaacaatttccacacgattgatttgtccagcccacaactactccaccacacagttgctaataacatcactgtgctgtgtggtcattatgtcacccagctgggagcactatggcctaccaaccactgttcacttttccagcttgcttttcccaagaagatagaaactgcagaccacctacttcaccaaaagtccctctgttccccaagcttcacagcttttctctgatttatctcggtgtcacatcccaaagggcctggctctggactatctgacttagagtggccaaggaagggactaagggtctgtgcccaagagttggcttcagtcctgcagattcaaggcaaagtcacctgtgtgttttatggtggatgaacttcaccactgcttctgatccctgcttctgatcccttacaattccaacactcagagactcactccctgcttccagctctccatatctgtgaaataaccgtggaaggacacgcaccatctctctctttctctctctctctctctctctctctctcacacacacacacacacacacacgaacacacgcgcgcgttgggcactgtgacttggtgccttcttcggctccaggctgacttacttgaggaagtacctctggccagtggccgtgaaggtcatctcccagcccgggggcagtggcagctcgtcggtcacgtcgtaggactgctggcggaggtgcgcgtgctgctgcgcggggctacccgcagcacccgcgccggtgcccagctgcagggacgcgggcgacgagtgcgagcggacatgctgggcacccccagccagtcgaggccccgggtggccgcccgacgagtcggtgctggactggcgcgagtgcgagcccgaatcaggctccttaaagaaagactccggcaggatcttcttccgccacgagctaggcttcggattcatgacagagttgaagagggcttcgaggtctgtgtctaggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaaggaaaggtcgcacgattccaggacaggcagccccccgaaagaagttcagcccgagccaactccaccacgtctcgactccggaagcccgaggagcctggagccctggagtggtgccggatgagcgcgcgagctccagcgggcactacctgggcgggcagcgaagctgagcctgagcgcgcggcggccgccgtcccgcccgaacttgccgtcgggcctgggtcgctcgggtgagtcccgagattgcggagctggagccgaggcttggctgacaaatcccgacccgactctgtgcctggcagtctaagggcttcggctctcacatcccccgagctggcctaaggcgctagtgctgggcgaaaaggaggcgcaggagaagcagacagcgcggccgcagcagctcccggact

SEQ ID NO: 137 - DNA, 140868 bp, Homo sapiens
gtggaagttcaattgtctttatttttcttatacagattcagagaagtaaaaaccagtaccaaactccaggtaaaatggtttgatctgatcgatttggctgcatactttcggtacgtataacattctaaacttaaaatagaaatttttatattacaaaacgtagaagtaaaattttaaaaagttaaagtactagcacatatatgtgttaggaaaatggtctctgtcaattgcccattttcccaattaaattaacctacgatttcctttttttaacagcttatttttttcataaaagttgtactttgagaagttactttctaattacgtcatgagaacacaacttgtaattagcaacacttctgtcagtctagatcacttcttctgcagagagcttttcaaccaagttggcatcaaccagcacaataaagttttcactgttttacctgtttcctgtatatggtgtaatcagtgaaagaaatggcatttcacatcctaaataatacggtgaaacactgtctaaaaattacttagatttaacagaattgcaattaggttttgacaatgtatttacttcaagacaatgtattttatcaggaaaaaatatcttgaaagaaagatctctgaaattatttttcatttgatacgccttttctgtgacaaaattttggggtgaaatgatgatgtttactgattgatttagtactaaaaagactagtactaagaagactaaagacagttatcttataataagaaatatagtataaatagcaccttatcaagaattctgcaggggttttaacacttacaataataggaaatagccattaaaaagttgctctaactttagatttctaactttagtgttctttaacaaaggccatattttgtggccttaaaaacaaaaaattatatctggctttatctattagtaaacacaaagggtccatattttattctgaaaaaatatttattatattcattcataaatgttctaactaatttaactaaaaaaatcttctagtattttctgatgccacaagcttactagaaaattacttctaaaaattggtaatataaatcatcaatgatttacctactttaaaaaagaggggtatctgtttctcttacatttaataacctgaaaatgagtctataaaaatattttttaaaaatacagtaacactgctgagttttgttaggtcccttgtttttttaattttttatttatttatttatttttagcaagaatgtacaattctttttgcaattttttgctaacaaaagacaaaaagaaatagtgctcccttcaatttagtagcaataaaatcatctatcttcatctctctcagagggcttagggagagtgaaaggaattagaggaacataaaccatgggtccttcaggtaaaataagtcatttcatagtgatggaggcaacagcaggctacgctcttgtctgcctgtacgctcagcatcagcatgccctgcccctcctcctcccacataaggtgcaccaaagccttcttttcttctacaacagagtcttccggtataaaggtggcaacagaaaattgttgctttgtccttttggggcatctcttgcatctcctgcttgttttgcttttggggtactataacttgtctctttccatttcacaactagtatcctttccacgatattccataactttgctacttcatctctgaccttttcacttgccttctttccaacatgatccaatgtactctgtacatgtatattccggtagatcaaaaggaatcttatttaagatccccaacaaataagtcccccatggaaattgaaagtatcctctcagagactcaaattattaaagtctttcaaaaaagattaaattcatagattataaataatattagttcaaaatattaaacagttgaggacttcattggcaatgcaggcagactgcatgccagttgaacatgatgctctctcagtccttaaaagctaattaaaaatggttttggttacataagaggtattgaatacatatttcatgcctttttataccaactgtagcaaacaggattaggataatatacttaggaatcaattttactgaattcagaaacatttatctccaccatacaccctcaaagggcatttttttttacatgtcagtcagagatctgcttcatccttcagtttcatagatagaattattttaaacacttgaaatctaggaagcaaacctgacaaggcttcagaatttaaaaagcaacagctcactgtgtgtggtgtgctatcaggttgaaatctatgttgtcctgatgttttcagagttatttcaaaagacaaaaatacagttgccactgatttatcaaaaacatttggctgccttttgtcatcagctacaaaattacagtgctttataaaataaacatcaaggccgggtgcggtggctcacgccagtaatcccagcactttgggaggccgagatgggtggatcacctgagatcaggagtttgagaacagcctgaccattatggtgaaaccccgtctctactcaaaatacaaaaaattagccggacgtggtggcaggtgcctgtaatcccagctactcgggaggctaaggcaggagaatcgcttgaacccagaaggcagaggttgcagtgagccgagattgtgccattgcattccagcctggacaacaagagcaaaactcgatctcaaaaacaaacaaacaacatcaagaaaaaaaaaaaccatcagattctaagctgcaattttttaaatccccagttgtaatatttcaaaaacttttgtttgaataaaatgctcataattagtaccaaactggtctctttcacaagatctgtagtgtaagacctgtgactaatgctgctgctgctactttcccgctggagggactaagttgtctagatgctctgcagtaaaataacgaaagataagctacaataggactgtgtgcctttataaatacagactaataagagccatcagagccagcatggattcaaaattacattgtattccatacagtagaattttactatccatacaatgatttttaaagctcaagttaaatagtttttaaagcatttggtactactgtcatcaatacagtttttgaaactgtaaatcaggtcgaattttgtgcacatttcctggaccaagatgccctcagaagtaactgcctgtggtcagctttttatggtttaaaatcaattggtgtataaatttcaattaacacccataaagcttagccatggggcagcagagaagaaagagaaaagtattctgcataatcaatcctgcagacacaattctgtataatctgtcacaagaacgcaggcttgcagaaaatgaaaatagaatatttatttatgtttaacttaagttactctcaatcaaaaccaggcaatgattaaactggcaacataaaaaggagggagcacgagtcatggaggcgggaagtggtgcacctgcagacttgctctgctccatcactttttccaagaggcccaggaaatgtaaggtcatggctacatccaagttacaatggtagtgattacagccaggttagaaagggctcacttttgttcagagcagactctacatcattgaagagggggatcaggtcttcagattccaaagttcctaagtcaacgtttgttcctggaagacagtcaaggaaatcagggaaacgggtctgttggggattgatgttcatgggtgtttgtcctgcgttttctcctataacaaaatgaaaagaaaccattttaattccttcttttaggctcttgaaggaggaacagttcaagtatttacataaccctcaccttcatgtcttcaactaccacattattgacccttactcataagaggtacagagatgtggaagaaatcgaaaattatttctggataggtgtggtccagaatggaaaaggccaaggagataagaaaggagcatgtgaaaggcactgtggatctgatctatgatctgtgccttcccatgacaaaggtgtgaagaactgttttacaaaagagtagagaggccttgtctgtaataaacagcttattacagaactataatctacaggtttcattgtaagcttaggtttacccataccatccttctttatgttcaaagagaatggtgtgaagcttcttttaaccaggctattaaaaagttgtcttcattgatgactttaggcatcatttataaaggcagttctgcagacgttttccctctttctgtaatacctacaccctacaactatctgcctttctcacaagcatatgagcacagtgcatatgagcatgttaaggctttaagtcttagagtaaagaaatcttttgttttctttaagacactatttcctaaacccatttaatcacctaaacctattttggcagtatgtgtattcaaataaaactgaagttctacagaacacaggtgagaaaatgctgtactagaggaaaagtaggtgtctgggatatgacatgaagaatataggttctttatgtgtcatagtatgggacagaatgcactactgactttggtgtcattagatcgagctttgtggctgtgtaagcttagacacacttaacctgcctgattctcagtttacccatctagaaattgggatcatatgctccttttacaaaagttagagtaaagtgccatatagtgtctgccacatatccatggctctgggtgtcattgatatatacaaagttatatacatacaaaaatataataaatgttcattgtcctgagagaaagaaaaacccaggtcttcagccactattaattacacaatatcaaaacaacaggttaattcaaaaagtcccaaacaattttctgaagagataatatctacttcaaaaattgagaagcattgataactaaggccagcttccaccataacgtcattttttaaaaacttgttaaattatcttttgtgtgttacaagtgcagtagccttcctgaaacgtgtgtagggaagtttcactattttaagcaaaattgccgaaagttcactttagcaatctgtgttttccagggagaaaaattatatccttccaaatgatgaaggaaccatcatccaatttggattttggtgatagcaaaacacaatggcttttctagaagtcacaaaatataaatgactcctgggtaacattttacagtattttcattgcaaagggtagtaaactgaaaaattaaatcaaattcaacaatatgacctcaatatagtgttactgatattgaaaaataacgttaaacgaaaaaacaaaatccaaaataactttcttctacttactagagtgtaacagataaaaatgaggctttaaaaagtgtctaaaaaacaatctgatctaatgtgctggatgcctttttttctcttcatctccagttagaatcattcatttttactaatttcccattttaactttcagatactcaagaatataatttttagccaagcaaaatctctgttttaaagaattcctaggccgggtgtggtggctcatgcctgtaatcccagcactttgggaggccgaggtgggtggatcacctgaggtcaggagttcaagaacagccttgccaacatggtgaaaccctgtctctactaaaaatacaacaaacaaacaaacaaaaaaaccccaaaaaaacagtgccaggcatggtggcgcacccctgtaatcccagctactcaggaggctgaggcccgagactcgtttgaatccaggaggtagaggttgcaatgagctgagatcacaccactgcactccagcctgggtgacagaatgagaccccgtattaaaaaaaaaaaaaaaaattactcttatcctttcttctcaggatggaaggcatgaggatactggctaagcttcttcattaaagttaacaatcttaaaatagaagcagctctgcaatctcatagtaatctttttggtctttgcagtttatccacttaaaaagtggaagagacaaacacaaggcaattcttttttttttttttgagatggagtttcgctcttgctgcccaagctagagtgcaatggcacaatctcggctcactgcaacctccgcctcctgggttcaagtgattctcctgcctcagcttcccgagtggctgggatcacaggcatgtgccaccacgcccagctaattttgtattcttagtagacacaagatttctccatgttggtcaggctggtcttgaactcccaacctcaggtgatccacccacctcggcctaccaaagtgctgggattacaggtgtgaaccaccgtgcccagccacaaggcaattcttaaaagggtgtgattactgcagaatattctggaaggatggatgatttcccagcctttgctcatgttattccctttactggatcttcgcaccaagcccagctgttgctgccatgtatgttttgcaaatggagtgctcagctggctcgtttcccttcagcatgtggccagcgcgtggtccacaggcctgatagatcttttctagccacacttgagctctgcctgcccccacagcttccctcattttgctactgtataattaacatttctccccttgagaagatgtatgtccagttcctacaaagacttcacagaggtggccccacactcaatgagctgactctaacttaaccaggttaacttggcactcacattcccacactcaatgagctgattctcacttaaccaggttaacgtggcactctgacattatcaagtccattgtatgtatgacatcagtcttcttactggagaagagcactttgagctggtctctgtgatctcatgactcctcacaactctgccgtgagcatatcactcccactttatgggtgagaaatctgaggctcacggaggttatgcaacttacccaaaggcgctactaggaatggagaagcaaggattcaaatcaggctgcctgttggctaaaactatgttcttttcaggacgtcatttaattccacattacggcttcaaaataaaacactccctacttacccacttgaggttattttaaagagacatagagtagaatccatcctcttttatggttttttttttttttttttgaatgtcaaacttagatttagatctcctgagcttttttccttaactttgctttttatccttactggcttcccagtgtttagaagatgaaagtaaagaattattaaacataggaaggagccacttcctaaggctattccaaagatagcaaaataaatctcacactcaaaaagcagagagagagataaaggtggcagggggtggtggtgggggaagaactgaagtaataaactgaagaacagtaaaacaatcagtgcaaactattcctgtgtcactcctcacaagatagtctttgcaatcttctcaatgcaaagatgacaacctacacgaaagacgccaggggagcagctttaatgtactgcatttgtaagacacctggctatgagtttgactcttgatctttccaacaatttagactcacaacacaaagagaagccatcaaagagtagagtgtaaaaaactacaggcactatggcaaacactttgggggaaggaattttttattttcaacacaaaacaattactttcgtcaatgataatggagaaggaactttcatgaataactccaaatagtggacaccctggctgtcatttatttttggttctagaatatcttcttagagtttatgactttcataattaagtctaggtaaggctaataagactaacttcagtttctgcaattggaagtctcactccttgagaaaaggagaaaaagaaaggtaatcgggaagcctggtgaggctggacctgaaggatgcacaggctggggacaaggtaagagtaaccctgactctcttctctttaattcctgagggaggatgtcgttaccatgttggaacttggaagtgacaattttgaatcctctgagttgctcagcattccaaatacccactgccaattgcttttcaaatgcagtgaatgacatgaaaaaaattggatactagaactataaaccagtgtcactttccaggagaaagggtggcccatatattacaactaaaaactagaacagcataaataccccaatgtggaaacatggcaaacaaacagtggtgtcttgatgcaattgtgaggaagggactatatggagcaaagatgaattaaaaaaaaaaaacaacagaatttaaaatcctgcgcccagatgtaaaactatacttgtataatctatgaggaaggggctacagtttattaatagtgcctgggggttcagtggcttttcagctgttattttatgttgtcgttgagattgagtgtttctggttggattttaaaattgagatgaccgtactcgctctggcagcacctatactaaaactggaatgattagcatggcccctgcatgagaatgacatgtaaattcatgaagcattccatttttttttttttcaacatttttacagacactcgggactactgggagtggggaggaacaaggggtgaaaaacaaactattgggtactatgctcactacctgggtgacgagagcaatcgtatcccaaaccccggcatcacataaccatgtagcaaacctgcacatgtacccccaaatataaaataaaagttgaaattataaaaataaaataaaagaaaaataaaattgagataaccgaagagatcatttaaaaaacacaaacccattgtaagtgcttgcaggctttgctcctacctgtatccatctcatccacattgctgaggaagtcctccggagttgtggggacactgtagcaccctaaccccaggccactgtcagtgctctgctccctcgaatgatatggccctctgcaaagcaaaagatgaagaaacttcaatatgagcccactaaataaatctcaaaattaaaacacagtcacaaaagctctaaactagtgcagttgtgccatgctgcccaactttccaggttagggaggaaggaaagttttaattttgaaatacataccctcatgaaaatgaaaataatcatgtgtggccattcacagtaaattgacattgatttccttttcacctcaaaataaccatttgaacattcttcaacatacagagtatgacaccatttatgtaaaactttaaaaaaaaaaaacaaaaactatgttgaatattgcttatggatacatacactaacgggcagtaaggggtataaaagtctgtgtgatggacacacgccagtttctgaatagtggctaccactggggacagaagggaaaagaaacgagatttcagtggtggggggatggcttcaaatattaattgtaatattttatttgttaaaaagtaagattaaataaaactatggcaaatctgggtagtgggtacatgggtaattcatgttattctttgtacttctctgtgtttcaaatactttaaaatcaacaatttaaaacctccattaattattatttcagctactatttgtttttatctctatctttaataatgttcataattgtattgtttgtttgccagacgtctctgcaagggcagaataaaaggcacaggaaatacagaattgccctttttatttgatttaaaaactacttctgctcatgaagatatttctggctaaattctctttcccttttgctcctttgttttaattactttttaaattgtgaaattattttaaactcacatagaagacgcaacaagagtacagagcgttcccatgtacccttcaccagcttccccagtgataacatcttacataaccatagtgcaattaccaaaatcagaaatctgacactgtagaatattatttactaaactatagatcttattcacatttcaccctgaacatcatctcttttcttttctttcttttttttttttttgagatggagtttcactcttgttgccaaggctggagtgcaatggtgcaatctcggctcactgcaacctccgcctcccaggttcaagcaattctcagcctcccgagtagctgggattacaggcatgcaccaccatgccctgctaattttgtatttttagaagagacagggtttctccatgttggtcaggctggtctcgaactcccaacctcaggtgatctgcccacctcggcctcccaaagtgctgggattataggcatgagccaccatgcctggccgaacataatctcttaattgttctgttctcaatttgccatatggcatgcttttatcccctgttggttacataaaaccagaagattcttccaagtataagtactagacgacaccatcatgtttaaaaatataagttcatgcccattttcaaattcttgactaggggtttactctacgtcctatcaccaattttttaatttggaaattttttaacaggcagatgatttcccctgcttttcttttttctgccagctcctcccacttcctccctttattctcaccctcaaccctcaagctccccacctcttcccaatgtaaacaaagatcctattatagtctagatcacataataaagagaataaaaataagtggcccccaaatattaacttacccattgaggaaaggatctgagctattattagtgatggatctcatgtctggggtcatcgtgggtgggttgacagcagcctgaactggggcaagagtctcagcttccatggggagctgtcgacagagggcagcttcctacagtcagaatgggaagcaagagtcatgcactcattgtcacaaggcatggagcaaagtgtacttcacatcaaaacttttcaccaaatacaaagcactgtgtatttactcccagcaagtcaaaatcaccaggcaaccattagtattctttctccgaagaaagtcttacagacataagtcacttcacattcacaaagttaatgggaagctcagctattatttgatctaagggcacttaatgttgcaatcatcccacccatgcaattatttaaacacccaaatcatagaaagccctctcaaaacactttgtcagagacaaggctttttctatctcaggttctcaaaccaaatctacatcaatcaaagcaatcagactcctctggactataaagtacattctggtctttgccacttacaggccagtaaaactgtggaattacagagtccaggctctacattaaattgcatctggcagttttatgtttacagacaggaaagcaaaacaatgagttgaaagtttactttaaaaagtcaatcagtggccaggggtggtggctcacgtccataatcccagcactttgggaggtcgaggtgggcggatcactggagcccacaagttcgagaccagcctgcaacatggtgaaaccctgtctctacaaaaaatacaaaaattagttgggtgtggtgctacttgggaggctgaggcaggaggagccctgtgcctgggaggttgagactaaagtgagcagagatcacgacactgtactccagcctgggtgacagagtgagacgctgtctcaaaaaaaacaaaaaaacaaaaaagtcaatctatttgactactttgttgactaaaatgctgaaggttggggaaccatgtagatccaatccaaatcccacagacaagtaactgtttcacagcatatggatttcattagcagaaacaaataatacaagcattattttataaaagctagcattacattgctaagaagagtctatccaaaaggctacaaatttactgactgcaactactttctctaggtataatctccaggagtctctccatcttgacaaacataaccagacatcaaattcctttcaaatttgctgatgtttccagagaatacttttgtatgtttacatttgcatcccaaaccaaggttaggcctttccccatatttatgcctatcagtttcccactttccatgctgaagtcattggtctcactgtccctcaaaccctaaaaccatggctacaatggcaaacagaacatttaggacttctaaattacagtatcttcgttagatctcttccagccctaacatgatgtgactttagagggtagctgctgtctagacaagtcctagtgaagtcatcggctataaaaattttcagttactagagttggttgcactgttacaaaccatgagagacctgattgatttaaaaaaaaactgtattgttaacttatactgaaataaatctagctggaaagggtctttggctcacttctgttcatctagattgcaaataatcaaatacttaactaacaaattttattcaggaatctacaaaaagcaaaccaaaaactggagatttttttggtaaaaagtgattttcatcatctaaatcttggaagtgccttctgaataaacctagaaaaatcaaattattttctgatagttgtttttaacatggcaggcagggtgcattagaaaccttattatccaaccaaagttttcctgaaagcctcagaaggaacaacagggattgaatctggcataaaaagcctgagtcccaccagtccccatccctcaagcacactcatacaccctgagccacagtttgaaaaaatgtatctcatcaatggtaaatttctaatactttattaaccataaatgcaagaatcttttgactcataaccctcattatccaaaaacatgaactttactagaatattccatttttcaaccattctgaataaatgtgggagtttacctctaaacaaatacacttttaatttaaaagttgatgagatggctgcattcctttgtattgaaaaaactttatcaacatatgtcttaagaatacaagttgaggccgggcggtggctcacacctgtaatcccagcactttgggaggctgaggcgggtggatcacgaggtcaggagatcaagaccaccctggctaacaaggtgaaaccctgtctctactaaaaatacaaaatattagccgggtgtggtggcatgcacctgtggtcccagatactcaggaggctgaggcaggaaaatcacttgaatttggggaggcggaggttgcattgagccgagattgcaccaccatactccagcctgggcgacaaagcgagactctgtctcaaaaaaagaaaaaaaaaatacaagttgaatctgcaatttccaggagttctaaatttatatatggtaagaatcatttctggaacttcatgggataaaaaaatacactatatataacacacatgaattgttatctgtaataatatataaaattataagaacaaatatcaaaaattagatataaaataaatagttctaaactttcctattaatttaaattactcctagctatttccagtaaataaaacataaaataatgcttgtgtgtgtctaaatatataaataaaatatataaataaaatttaaaggattatttatgataaccaaagctgaaaaacctatactatattggaggaaatgtttcactgtgccatttcacatttgttccatctgttctaaatcaaagagaacagaagctctagtctccagcactgatgtttccctaactaccctgaagacttaatcaccaagtcatcctaagggcaaatgccgccttctgtctgtagggggctcacagtatcattttctaccttcaactgactaacaaataagagaaaaatcagaaagggtgttgaatgtacccggaatgattgcttttttttttttttgagatggagtctcactctctcagccaggctggagtgcagtggcgtgatctcagctcactgcaaccttcacctaccgggttcaagcaagtcttgtgcctcagcctcccgagtagctgggactacaggcatgtgccaccacgcccagctaatttttgtatttttagtggagatatggttgcgccatgttgcccatgctggtctcgaactcctggcctcaaatgatctgcccaccttggcctcccaaagtgctgggattacaggcgtgagccactgcacccggcctgaataatagctttgaaatataaattaggccagtctgagttagaaagttattatttataataggacactttgtctaagattattccaaaatcattcttaggtcacaagttattccacatagcagccaaagtgaagctcacgtgaccccctgctctaaagcgacctgcttcttgttccacctggatggtaaatagaggcaggtcctcactgcagaccaccacaccctgcataacagccctggccaccctttcctcccatgtctctgatgtgctcccctccttcacccccttccagtctcctggtttctctgctgctcctcccacctcctgcacctgcgccaactgttctatctgcttgcaaggtgttcctcgagtcttcctaaagcttattccctcacttaacgcctgcctcctacagacgccatctcttcagagatgctcctacctcacccctgtctaaaatggcctcacccctgtcattttctgtctcttaatctgcattaattttcttcagtgcaacttaagttttcattctctgtctttcctactagaatgtaagctccacgagggaaggggccttgtttgtcatgttcactcctgtacccaactaccttaacagtgctaggcatacagtgggtacttggaaatataaactaagaacatgcaatctcacctcagccacaaatatgagagaaataatagcctattgtatacaacccaactagccaggtgcaggctccatcctcaagaaatggtcctgctgcactctttcctgctcctcacataggatgaacaggagggccgagtggccaggagctagatgcttgaattggaaacctggtcctgctatctaacagaaagttatttaaccctctgttcttcatttgtaaagtggggataataagagcacccacccaagaaggctgctgtgatgataaaacgggataacactacaaggtgcttagaacagtgccaggcactcaagatcacataataaatactgaaggaattattattatttcattttctgaattccaatctcaaaaaaaacaaaataaacaattttaaaagtcacactgtcatgtggaactgatccactttaagtggtgagaggtttcttcctggtcaactttcaccttggagggattaaaccaaagtgtgaaattcatcataatggtcaccaaggctaagaaaacaattttttttaaacaaggagaggtttataaaccatttttatataacataaaatttgttcgaatataaatggaaagtagtgagatgttttacttcacttaaattttataatacgagttctatatttagaactttaaaaattctagcctttttttgaatgaaaatacttccctattccaactcatgaactgaaagagaaaaagaaactgtacaaaacccgaggtctgaaaataaaagggctaacctcaccaacatgttgccatccaaacaggggagggttttgttttaaactaaatttaggtataaaattaaagcccagacccagtaggatttggactgccacatgacatccactacccttgcgtgggtaaaaatgaaaggcaaacgtctgacttagaccaaacagcagcagtcaaaatggatgaaactaaagcagctgaagcaaagacaaagacaggcactggatgaagtaagcttccatggaaacagaggggtgacagttggtcaaggctggctgagggcataactcaaggcctctgccgctgagcatcggtggtgcagctgccttcactcagcaccccttccttcctctgctccctctagtcgaggcaggaaaacaaacgctaagctggcttgtcactcatttcccactgtgctccagttaaacatgtatattcacagatcccttccagggtcccctctgtgtccaccctgccctccaaacaaaccttcagtttcctagaccaagctcaaaacctgctttctgtctcaagaagcaggtcatcattgcttctctagctagtccaactgacctcttcctccaatcaaccttcaagtgcaaggctgcatccaggtccctacccaacactttatcttactgaaatcttttcaaagagtgaccagagaccaatcaggatagagaggggtcagggcatcacatcctatgaagaagagtggggctatttaaccacaggggaagactagaagggcacacagtggctctcaaattattaatgaactgtcacaggaaagaaggaagatctcttctagcctagatttgaggcagatacgatgaagggctttctagttacttatcagttcagggcaggaactgccttcttctcaattctccaggctattagccaccggatttctgaaacagtagttggggtttaagttggggtccagagcttggcaccgaaaaggcagcatggcacaagagcaaaactgtctttggaaccagaaagattggagttcaaatcccagttcagttactacatgttgtggcatcttgaactaaattcttaacctttcttgacagtttgttcacctgaaaaaaaaaaggtggtttataagactgatcttgctgggatgctataaagattagaaagcgtacttataatggacctggcacattgacgcagttaacagaacaagctgctgatagtgttaaatggtgtgggaggcagagatactagctaaaaattgcatattgcttactgtgtgtgaaacactgttctaagccctttaacatgttatttcccatcctggctaacatggtgaaaccttgtttctactaaagatacaaaaaaattagccgggcatggtggcatgtgcctgtagtcccagctacttgggaggctgaggcaggagaattgcttgaacccaggaggcggaggttgcagtgagccaagatagtgccactgcactccagtgtgggtaacagaatgagactctgtctaaaaaaaaagaaagaaaaagaaaagaaaagaaaagaaaaacgtgttatttcatctcttcctcgtgacaacccaattgtctccattttacagatgaggaaactgaggctcagagttaagagtgtggcaaagtctcagtgtggcagagaaagaaaagttgagggttgaggttgacagacctcaaattgtcaaccctttcacctgctggctgtgagaactgggcaagttacttcacttttccgagcctgttttcccagcaataaaatagaaagaccaacccctctacctcagacagttcagaggaaatttaatgaaacagccgatttaactttcctgaacatagttttcctccctgaacagggcaacagaatgaactggatgtattcaatgatagttttcaacgtatatgagtggagctcatgtcctaggaattcacaacccatcaagcaaagttacaagttccaatttcaagggcacttttcagaaggaaagctctccctgctgaccctgacccaaccctcctccaacaaatttatttttgtctatgtccaagcttggggtggaaagacttgcaaaataagggctcaagaatctcttggtgagtttgtggtcaactatctagctctctgaagtgagtaattatttatgggctaaaaaataccctttcctagcagctggaggacgggtgatgtgtaaaatagctgaagaagtaaggatgtgaaagacaaatgattatttgtgagctgaaggtgtcccaggaagcaaacctcaaacctcctctccttctaggtccttggcctgcagcttgcctgtggaataaaccaacagaggaggtgagaaagtaaacggcagctgaaagcatctgcagctctgtcccgccttggctgagggaacactctgccagccagctcctgccctcaccagaatgcacttcaaaagggaaacaaatgacaatcagctcttcagaggctgctctgcttgatttaagtgtgtgtggccagggactctacaaacatggaagattggattgttttaattataaagggtggggtgagtagaaagaaaatgaaaaaaaaaaagacagtattttgaaatcctaacattaaaatagttattctggatgcagagaaattgctttctctgccaaaaccctgagggacttcagagagagaatgccgaattatttaccttctttacgggggacggcggggggaacaaaaaaaaattactgatgtatatttctttttaattcggtgccaagggattctaaaatgcactgtcacacttcccggagactgcctttttgaaacaactcatcactaatgctcagctgccagactgtccctacaaaagaacaatcgaaactgcgatacttttaggaagccatttactaagtttgtcattattatctatggtctatttgttgctctttttactcagagtgcataaagcaaatttgtattattccacaactggtttctgttgtcctttcaaatcacattaaagaaaacattataatttagatactcgtctgtcttcacttaaaaaaaaaaaaaaaggctgaggcctggtgcagtggctcacacctgtaatcccagcactttgggaggccagggtgggcagatcacttgaggccaggagttcgagaccagcctggccaacatggcaaaaccccgtctctactaaaacacaaaaaattagccaggcgtgatgatgcgcacctgtaatcccagctactcaggaggctgaggcatgagaatcacttgaacctgggaggtgaaggttgcagtgagccaagattgtgccacagcactccagcctaggtgatgaagtgagactgtgtctcaaaaagagaagaaaaagaaaaaaaaagacttgaattgatactattgttcaacaacaagggcacactgggacattttggaaaatggattatttctgggacatgtaagcaaataaaacgcttgacacaagctagaatggaagctctgtgagggaaggggctggggtctgttgttcacagctgtacttttaatgcctagagcatttgtaaaacaaatatatgaacgaatgaacttaaatagccaagcttatatggagggatttatagattcacaaaatattagactacgtgacctctgttaacccagtcaactctgaaacctaatgctatgaaatgcttttctaaaagttaaatagtcccctgttctgaagcaaaggctatgaaatagcctacatttatgcttcatgatctgctccaatacgacactctcctagctcgctaaatagctattctttgcatgacaaaaaaaaaaaggggggggcctcagaaccttccccaggccagtgctgctcacagccaggtgtgtccccctccaggagccctctgtcaggatggctgtgcgaggtcagccagctggcccgccgcgcctggtggctgtcaagcctggcagaaatcccacagacctgccaaaagaattccgaggcctccctcttttctcgtccctgttgccccggcgacccgaggccaggcttagtcagcatttttgtttgacaaactgcattctcctgtcccccaacccccaaattaaaaaaaaaaaaaaaaagaaagaaaaggttgagggtaaaagcagggctgaatttgctttgggaataatgatttctctacaaggcagcccccgtgaagggacaagggggagccaaggctttgccacttactcgtcttccaggtcctggtcctcgaggttaaaatcttccagaaagatggccccaaaccgttatatttaaatgaataacacacatgaaaagaaatactctcttcaggtaaagccatatgcctgttttcatgtcaaggaattgttcttttagataaacaggcattgagaagcctgtttctcaatgtctgacctgtgactacgatttcccacttcatttggtaaagttgcaattgtgccttttaggatactgagcaaatattgcgttgaatttttcagttgtaacaacagaatactctgtagtcattgtgggtgtgtgtggctcatgacatttaaaaatttatgtacggcctgttgtagaaaggattctaggcgctttggaatgggtacatacaaagtcacagcacaacttcatggctgacacagaataaaaaaatgacttcccaatatattaagaagaggcaacaaagcagtattaaagtatgctaccacttttgtgttttaaaaaacaaagtagacacattgatacacatgatacatacaaaaagactagaaagaaatcatcagcatatttacagccactctttctaggtaagagtataggtgattataatttccttctttgttgtttagtattttatacattccgtaccataaacatacgttttgtctttttgtgtgtagcaattcgttttcttttattattctttttgtttacatacagtaaaattcactctttgtggtatacatgtctgagttttgacaaatgtagagctgtgaaatagccaccacaaccaagacacggaactgtgccatctgccccacaattcctcagtgctgcccctttggagtctactctttctgtactgtcaaccctggcaagtgctcatctcttctctgtccccatagttttgcttttccagaacgtcacataaatggaatcatacaggatgtagttttggggggaagtctggtttcttgcacttagcaaaaacacttttttaaatgctaatcactaaagtaactcagtaaattatatttttaattttttttttttgagacagagtctcactctgttgcccaggctggagtgcagtggctcgatctcagctcactgcaacctccacctcccaggtccaagagattctcctgcctcagcctcctgagtagctgagactaccggcacccgccattatgtctggctaatttttgtatttttactagagacagggtttcaccatgtcggccaggctggtctcgaactcctgacctcaagtgatctgcccgccttggcttcccgaagtgctgggattacacgcgtcagccaccacgcttagtcaaaaattaaaatttttttctacttaaaaaaactcaacaaatcaaattttaatttccttaaaaaaatgaagagaaagcaaaacttcaataagaattgctttttttttctagagttgccatttctttggtgaacctgaagtagcctcacagcctttgggaaattcagtaaaaataaaagaaaactctatcacagacaaaagacttcctttcacagaaatgcactctttatgtcttccatgttagattcctggtacccctccacttgaagtgtctgccgcattccaagataattcatcaattatcagatacaagtagctcagctctgttgctacaccagccaatgctagattggagggactgcatttaaggaaattctcctgcttcagaagattccttatcagcagagataccaaaccttactggctcttttgatcctaattctgtagccagtaacctgaggggtcactggaaagaaaaaggagtatctgatgctcactttcacagaactctgctcaggtgcatctggtctcagttccagtaatgaaagtcaaagatggtagccactgggcccctgtgaagcagggaatggttttaatttactcttctggtctttaacttggattaaagttaattatttttccttttctgcaaaaatacaagttatctgaaggcagtcacatcccatttacctgtctgttattttctactaaataaatattgattgaatgaatgaagagataaaggaatgaaggaaggaaaaaaaatatgagcttccatactgaaataatgaaggctcactttagatttgtaatcaaagtttcctcagatccattttgttaatgttctcgcatgatttcaatgccaatgagttaataggtgaccctttggcattgtggtatacatcaaatcatgcaacaaggaccaaggagttgtttttttcatggcacaacatcatcaaactatatgcctagtggaacaacggcatagcagaaggaacaggaagaaaaatgaaacaatatttatatagcatattctccacagggatctttcagattcgtcgtatcattcaagaatgataaaactatagacagcgtgataatttattagtaattaggggataaattcatctacttattaaattttgccaacctccctttctactacagaaagagagcatagcctggggccttgctcccagacaggctcagttggtagaagggcaggtaggtctaggcctacctgcagggcctgggccccaagaagacaggctgtacaattaaggccgcctacaagcaagaggagagccagtgtaattacaaactgtccactgagcaagggatattcaggcagttgttgactacccaggacataggggtaggacagagagaacaaacagaagtgtacagataatctttaaatttcaccagaaccaccacttcccccatctctccaaattcctaccagatgctggaaggcaactaaacaagtgagccaaagatcacttttaattccagtccatttccctgctgctgccatggcttaggttcaaaaagtgaagcagaaaatcaccaaaagagttcaaaaaatccaccaagatgaaacacagagcccacacctgaatactgaataatcaggtgtcctggcaaatgccccagaaaactattatagaacactccaatgccatttattatatggtcttaaatcatatctttgacaatcaggagcatgctgcttctgcatggggaaaaaatctgccatgattaaaaagtctatttagaccttttcctgtactccctaacaaaaataaaaaggcatcagaacaccagaaccaaccactccaccattccatctcctcctaactacacacacacacacacacacacacacacacacacacacacacacagagtcaaggctgaactacatgagtccctgtgagcaaatctggacaatcttttctcctgcttcatatacaatgcaacaatgcaattgctcactatgatgcagcacaacgccccacgttccacagcctccaaggatcagcatttaaggaacttggttggcatttctgtaatatgaaccatcagtactacatcctggttcaaaggcacctacagctggaataaaggaaacaatttggggcacttttcccaccccttttcagaaatactttctgtgggaaagaaggaggagaagcaagagaaagagaaacacacccgcaaaaacagagaagcaagtcattctttgcagaatggtcacaactttgtgtaaagaaaaaactcactaaagctcatttaagtataaaactgagaatgtataaaatgctgttgggatactgtttaatttaccttacattataaaacagaaaaattattccaaataaaattattattcaaagacagaaaacaattaacaatacaattacttcccatcaagaaacatgacactatatatctaaaatcagtataaacaaccgttagcctgaaataaccgtgaaagttcaaacataaatcctcagggtaaaagacacaactgtagttacctaattattaagttgtattcctcaaatttggaggaaagttcagctgagcaacaaagcacaatttatattcattttccttattttcaaagactatatctgagaaatgattttaatttaccatgcattttaaacctcacacaatatagatttcttatatcctggaatgtatttgatgagaaatacattattcattcatggaagtcaatgtgtatttttgaaagtatcaaatgtagctttaaaaaaacagcatttaccctaacatgctcggtcctttcctccaagaaagttctctggaatgttaaaactacttatttctctaatttctctaaagtagcaaaaggaagttattcatgtatcttgcttcatgtgagtcacaaaacaaagtctgaaaagttaaaacaataaactgaagcttttctccccaaaaatgtagccagaaaaaaagcatgagacctgaaaacatgggttatattagtttagcaacacagaagaaagaattctgctcttccatagaccaagccactgaaacagggagagcactgtgggttcttttaggaattctcttgtattcgtttttgaagtacagcactgagcctgacccacagagggcacacggcaacacactcctgactgacggaatgaaaactgaatgaatggagtatggtacaaaagtgcctgattgatgcccaggcagttttgcagagcactctgttggagtccatatacaaaccactttcccttctcattctcccttcagcttccctctttttcatgctctgtggtggaccaagatcctttgtcatttcttctgaggaacatccactccactatctgcttgaatctcggggggttctctgtgactactttgaccaagagagtgtggcaaaagcgactccacgaccgtttccagagctaggccccaagaaattggcaacttctacttcctgtctcttagaatgctttttcttgaaaacccagctgctatggaatgagtaccactactctgagatcgccacaccatagatcccaggcttttgttccagcttagcccagtcttccagcaatcctcaccatcatgccacccacttaggtaaagccattgtgaactatccagaccaacccacctaccagttgaataccactaaatgacctcagtcaatgccatgtagagcagaagaatatcccaggtgagccccttctaaattctgacccacaaaattgtgcgatataatgaaatggctatttaagcaactacattttgggataatttgttacacaacaacagactcttgtctctctactttctcctttctctccttctaaagactagcagtggaagccaaaggcagccatgctaatacagctcgtccttgtacccttaagcttcgttctgaaaaggcaggcagaacactgagagaagaaactggattttaatcaagaggcttggagtagggctttgagccctattgtctcttcttctctagaagaattaccctgaaggtaagcagctacctacccatcagctttggcaccaaggccagggagcctccaccagacaccatggaaagccatacctgcctcatgagctcctcttggcgcattcgaatcctttctctctccatctggattctctgaagccgcagtttctgctgctgctgctgctgagtggtcagcgcattgggcatactcatgagccctgcgggtgggttctgagtggggtggttctgctggctcagggtactgggggccatctgctgctggtgttggtgattcatcactgcaagagggaagaacatacagattaatgaccagggcccacaataccttatcaaaaatagaccatcagaatgttttctgctttggagtatagattcctgagattccttccaaagtactttcctgttaaccattactgtttaagtaattattaccttaattcaattcacggaggctcgaatactggccccaatcctgactcatctagcctcggcttttgtttctgttaaaatctcatttcacacctccctgtctagagtacattttaagccttacatagaacatagtggtctaaagcaaattccacaaaggttatcacaagttatgagataatttcaccagatcatttgtgtgtgtgtgtgtgtgtgcatgtgtatactttctcagttaatttgtgtgtttatggcagaggtaaggagggcatgtgatctttggtacacaaaccagtgaattgacaaacaacatgtaacacaaagcacctagatcaggagccgacatataaggaggactccattaatcctttgtttgaaaagcatgctgcaaggaagcctgagctatgagctaaactcaggaacaaatatctgactgagaaaaaaatgtttgtttcttcaaagggagaaattagtgagaaagaaattatgcagaaatgctaaacatgttgtgcctggataaacgcatgagaaatattttcaatttttttaaaatgctctatttatctgcatttaacaaccagtgaaatttcagcatatagaacttcactttacggccaggagcagtggctcacgcctgtaatcccagcactttggaaggccaaggcgaacggatcatgaggtcaggagatcgagaccatcctggccaacatggtgaaaccccatctctattaaaatacaaaataattagccgggcatgatggtgcatgcgtgtagtcccagctactcaggaggcaaaggtcagggactcgcttgaacccgggaggcggaggttgcagtgagccgagatcgcgccactacactccagcctggtgacaaagaaagactctgtctcaaaaaaaaaaaaaaaaaaaaaaagaacttcactttacaaaaataattttaaaatccttaaataaattttataattggtatttctgcaaaaatgcatttataaaagtgctagtttttctcaaaattgtttaccagtcaaatttgcttaacttctgctgggcaatgtcatgtaataaagaaaaccatgcttttcagtctatttcctcctaggtcagggtcaaagaaaacaaggtataattttatatactcacttcatttctgagaaaaaaattctcaatttttgctatatttggtatcattaactttaaaacattttataatatatgtatattttttataatatttcatatatatgtatatattttaaacatagagacgaggtttcactatgttgcctaggctggtcttgaattcctgggctcaagcaatcctcttaccttggcctcccaaagtgctgggattgcaggtggaagccaccacgcctggtggcttaagttaaatacttttcatcttcagtttgctatgcatattatgtagaaatatgatttacaagtaaatctccttaaatgaatttaagtagcccaaatctccatatattaaatatatgtattaaatgtataatatatgtgtatatttgaacgacatatatgtacatttgaaagacaataccaacactgaagcttttctagagaagaatagatttctttgaggaagaattcaatggcaaagatttctccaggatggaggtgagggtgggataaaaatgttcttttttgtccatacgctcactgaaattgttattgcaattcctgctgcgtgtcatgcactgggcttaaacttggaaaaatagctcctgccttcatgagaactaacggactggtggaagagaggtgtgaagaaatgagatggatttttatgagtggcttatggaacatgaaactgttaggctacataaggaacctgggagattatctagtccatccccttattttatggaatagggactgtaacccagaaaggttaagggatgtgccctggttagtggcaagtagagccaagaccaaaatcgagatcctcttgtaccccgtccaactgtccctagccaccttctgtcacatcttagactgaagaagaggaacaactgctgaagcctcagagcaaccctgtaaagacaatctgccttcaattgtttgcaagaaagtaccacacacacagcaggtcatcaaaatagggacccaaatgttgcttgcgttactaagaggaagggctcgaggaaagcctggatagatttacaactctgggcccaataacatgctagtaaaagggaagatatcagtgtatattgcctagacagtttaggtttcccccttagaattaagcctgccaccaaggactctcacctcctggcacaatcccaggtacacagggaaagctcaggaaacgatctgatgaatgaataaaatcagttgggcatttcttacactcttagattaagaacaagagaaaaagcacagtcatgattgatgccaaaaaacctgagatgagtatttcacttctagagcttgttatagtataattacaacttctacttgaaggcctggggtgggaggtaaagggttttgcacagatggtgtcgcaggggaaaagttcccttaagtacagattcaagtaagacaaaatccagacatccagaagggtttaattcatgaaacctatttcaagccagggaagagaggcgcagatggaagaatgataattatttcaaggaacaggcatttctgaaccttctataaaagtatgttcttactagtagttatatttaatatggtagtatctgacacaactactagagacaaaaaagatgcccaatagttctgatatcagaaatacccaggttaggaaaacaaggcttcaaaggcacaggttgttaaccctatgttgttgttgttattgttgttttgagacagagtgtcactctatcacccaggctggagtgcagtggtgccatcttggctcactgcaacctctgcctcccggtttcaagagattctcctgtcttagcctcccgagtagctaggattacagtcgtgtgccaccctgccccgctaatttttgtatttttagtagagacaggattttgccatgttggcaggctggtctccaactcctggcctcgagtgatccacctgcctcagcctcccaaagtgctgggattacaggcatgagccaccgcgcccagccctatgttaatttttataacttagatactttggaaaattttataactgactcaggtgacttactgacataacaaattctagtaggactatcatcagtcacttaggtagactgcccttgtcggtgtacaaaatgctgcattgggcgtactctcaagcagtgtactgtattactgaaagccacatagcaaccagatattgctcagcagattttattaatacctgaatcctaatctggaggagtttcagacttggagaggagctcttcccaagccacatctatgtgagtctttaaaacacttgcccctacttgagacattcacaggaggtaatggtggaaacactggtttcttccatttaatttagatttgatctttcagactaaacatctctcattattaactgtagagtctggaaaagggtggaacttagatgatagctttgttttcaaagtaaagcacatatcaacagagcagtttgtacaaggatattcaaaacagtattgtttataattgcaaaagattaaaaatgatcttaatgtccatcagtgggagatatggtccacccatttagagaaattctgtatgatgattccaatgtttcttagagatcgtccagaaggggaaaaacccaaaggacagaactgtattatgagcatgttactagttgtggttagaaaaggtggggcatgttatgcatgtgcagcaaatctccacagaagggcacacctgagaccggcaacagcgagcacctcggcagaagaaactgggtatcagggatgggagatcttccttttccttttctgtactattttaagttttcccacatgaatttatcatttaatgtaaaacataagtgaaaataaaaattttaaagcataaaacaaaaacatggccatgtaagcttcaaactcaatattttgttggtagagtgaaagaaagaagccccaaattatctgaaaaacaacaaatacagcttaggatataatcaagactgtcaaagctgagagtctgcttggtgcaacctctccttatggagatgaggaaaccaaaactcagagaaagtgaattttatcaaggtcataaaaccggtcggtatcctagaagccaggtgacttgtctcaacccaggaacccaccattcaccttgccactatgctccctctagttgtttaatttcaaaccatactgaaccatcattgacactggagctcatgagcttcacttgtggttgaggttccttaaaaccaccgcttttgacactgagggcagaggaggcctaaggcagagaaaaagagaaacaaagtcctcagcagagcatgggaaggcaaaacatctaaatttgtgatgaacaaaatactccttgggataatattccagaacattttagggagagaacaatagttccattaaaaaaaaaaaaaaaagagctaggcgaggtggcttacgtctgtaatcccagcactttgggaggtcgaggcagatggattgcctgaggtcaggagttcgagaccagcctggccaacacagtaaaaccccgtctctactaaaaatacaaaaaattatctgggcttgttggcaggtgcctataatcccagctactcgggaggctgaggagggagaatggcttgaacccgggacgtggaggttgcagtcacccgagatcacgccattgcactccagcctgagcaacaagagcgaaactccagcttaaaaaaaaagaaaagaaaaggcagagtattccaaatgcagtatctgaggccaagccggattaagggcagactgccacaaactgcctcaaaaaggctaaagacctcgtcagctctagaccgttgccagtccccccagaaaggaataacccaaacagaagatttctccatagaagcaggaatgcatcaaagctaaagcagggacatcttttttgtttttccttccaagagagtcagaatttaaatttagattcccatttatctttttctttttcattgttttcatctccttttccctttttcttttttttttttttaataattggctttctcttctgtgtttggaaattgataaaaccatgctctgcagatgtgtgaccagaaacatttaattggcattattcaatataaaggaaaaaatcacacacacacacacacacacaaaaccgccagtgccaaggcatctgagatacaaacacacttttgattcaatgactgtgtccttggtgaagcaaacagtcaacacgggaatggggcggggggtggggttatttacgtaggacatgaccctctggttagtgctgcctggggcaatatacacttggtcatttctacaaagctctaagtgtatgctcaaggcaagaaagtcgcccggactcaattctaagccagcacaagatttgctatataagaagcaaacatggaaaaggtaaaggcttcaatcctgaacttttgccttttgcaacaccaggaaacagagagccacagctcgtagagaaagtgcttttggcagcttccctaagccaggagctgcagacgatgagggaggccagtgaatcagaggctgcccagagcacctcctggaatgtttcacaaacgtctttttggcctcggcaggtttcagtggcttgctcttctatgtcctgggcttgcttccctcatttttaaaataggttttagttacacacatacacatatacaatgccaagtgaagaaaacaaaaccataagggtaggctcaactacgaaaaccatagcggacaggcctgcaaggggctggctctgagtagatcatggaaagaacagctggcgcccagtggctagaagtcacacctaagtgctaggaagacacagaaattacttggctcccttcaaatccttctcctcagttcacatgtgagtcttggaaggtgaagaagaatatcttcggctagtatgcgtttcttgttgtatctccctcctctctcctttcgacaacaaacttctcagtggaggtatctctactcttggcactttgaggtgaattttttagaatatgtggttttgttaatgtgtcagaggcacaattccatttaagtgaatgggtaaggcctccccaagccctccatgactttttccatccccagcacctatttcctaacagtacttcggttccaacaataatagggagttttcacaggctgtagactgtggttcattagtttactaaaaatgtaatttccacaaatccatattcatatgaacagataattaaacaaataaatggatgaaggagagacaaatctcccttacagaggaattcaaaatcatttatgtagacacaccatgctcaaaggccggggggatgggaggcaacataactgcaaatagtgagttcattccaaagaacacaggattgaatgagtggtggctgatgggagttggggggcaacattactgtgcaaaaacttggaagatactaccttggccaggtgatcaaggtcaacattaacagtgacaagtcatgataatggtgtgcacccttgatgtgatgtaattagaataacactttatatctgtagtcttcctccaaaaacctataactccagtctacctaagagaaaaatatcagacaaatttcaatagaaaggcatcttacaaaatacgaaagcaacactccttaaaactattgaggtcatcaaaaacaaggaaagtttaagaaactgtcacagccaaaaggagcctaaggagatatgatgagtaaaggtaatgggggctgagcgccatggctcacgcctgtaatgccagcactttgggaggccgaggcaggagaatcactggaagccaggagttcaagaccaacctaggcaacatagtgagaccctgtctctacaaaaaattttaaaaattagctgggcatggtggcatgcattcgtggtcccagctacttgggaggctggggcaggaggatcacttgagcccaggaggaagagactacaatgagccataatcatactattgcactccagcctgggcaacagagtgaaaccttgtctcaaaaaaacaaaaaacaaaaaacaaaacaaaacaaaacaaaaaggtaatttggtattctgtatgggactctggaacagaaaaagatattagataaaaactaaagaaatctgaataaagtatggatttaataataactggctcactaattataacaaatgtagcatattaatgtaatacactaacaacaggggaaactgggtgagtgagtgtataggaactctcttctcaattttaatataaaactaaaactggtttgaaaaacagcaaattttaacgtgcccagtgaataccaggaactttgctggctactctctttttaatagtcaatattaatttaatagtcaatggttggggtatgtacaaatggacacaatctttaagagaaaatctggtctataatgtgtcccaggggaataaatagatattaagctaaaactttttaaattgcttctagaagtgttccctggtctaataagactgggaaatgttgggctaaagaaagttaaaataatttattttattggaagatttgtcagtctttagagtaatagggggtaccaagactttctgaaagagatatatgaattcaacaactcgtttctcaaacttgcaaggctgatattcttctggataggaatactaggaaatgctggtccactgtaactcagtggatgtcttggcagagtactgaattataaattaaatatgaatgaatattatattaagtccctactgtgtgcttagctctttaaaattaattaaagaagctgtttaggacacggagccagagaagggaaaaaagcggacagggaatgttgaacaaagcagtttcatgtgcctagaatgagggactgctgttcaagatacagagtaatagaaaaacaaagcaaaacaaaatacaggaaaagcaagggttataaaagactgcttgaatatctgctgacattttccataagcacgtgatgatttaaaaagaaaatttcaaagatggcttaacttccgtatcagttttcacaggtagttagcaaagccttgctaaattaacttcagttacatatattccaaattatctatcttttagtttttttttttctttaaaaagcttgcttctataataaaaccacatcaactattccaaataacacttctaacatcatcctttaagagtagaacaggtaaagccggcacggtggctcaggcagtaatcccagcactttgggaggctgaggcgggcaaatcacctgaggtcgggagtttgagaccagcctgaccaacatggagaaaccccatctctattaaaaatacaaaattagctgggcatagtggtgcatgcctttaatcccagctactcgggagtctgcggcaggagaatcgtttgaacccaggaggcaggaggttgcggtgagccaagaccacgccattgctctccagcctgggcagcaagagtgaaacttcgtctccaaaaaaaaaagagtagaacaggtagaggctgacattgtttttaaaacttgaatgcagtctcttcaaaataggtaaatatgcaacattcaaaggcatacactgggtaatacacttgatatggcatctgggaaacttcctccttggaacaagtgtttaattcagtttgatatttgggccagtaagttcatataaacttcatcagaaacactttccaggaacctaaacccaacatgagaggggagcataaaagcttccaaaagttagaatgcaaagctttacaatcacctcattctcttcttctctgtcacagagggtgaccaattatcctggtttgcctgggactgaggggtttcccagaacacaggtcacagtgctaaatctgggaaagtcccaggcaaatgggatggtttttcactccaggcctatggccatccatagacctagggctaactcagggcagcagaactcaaatttcctatttccaccctaatgccttcccttaaaaagagaaccaggagccagtacaaaatgacctttcattattcagaactgtcaggctatccagattagctgtcagtgtgtcctccttggattaaaaattggtggttgtccttttgtatccatattatgtgataattggaatgggaatattacatactcattttgtctgtaatttttgaaggaaatcaagcactatttatgacatttattttatgactgcattatatcacccataaacatgcacttggttaaatgcaaaagtcaggaaaacctttcctgttggactcctggttgagccatacatctgaagtaaagctcttttaagaaacattgaactattctcttcctgtgatttgaactaactctcatgttcctggacttgtgctctttataaacaagacctgggaaagagcaaagtctccccctacccctcaggaccaatcacaatgatatggatcttcctttcttacaaaaatggaacaaaaataattttagtgcatttcaaatctgattaaggcacagagtaggcactaaatacattctccccaaagtaaggttaagggaggttagaaattggtaacaaaatatcagttccatttatagcaagatgatcatcataggctttttaaatttcaaatagaaacataatcaagatgagaactgagaaaaaaactggcaacgcctcacccataactcatcttctctagaggatgcattttaacccttacctctagagtttcataggggaatatccaaagggtaccacattctagttgctgcttcctcttacttccagagcatagttgcctgcttagccccatttcattctgagtttcacacatgatttacaaactcatcactttccccacagcactcattataggtgagggccatgtatttacccgagtttgtgctatcaccatagaaattcaggatagaagggtcttagtccatttagagcaatggttctcaaacttttctttagtagtagaatccttctccagagccaagtgtacggcttgaagcagaggctatccttatgtcccagggttctttcatcagctgaggaaattagcacttaaagtcagcacctttgactgtcttctctaaatcatcttggtcttgctttcactctgctttcccttcaggcatttctcaagtgtcatgctgaaactttaaacaaatgtttaaaacacattgaacagggcccagcttttggaaactgaacactaaggttagcttctgctcacatccccctgagattctagcatgggactttgggacagactttaaaaccaatgatttagactaattcagttattttagagatgaagaatattggaagattaaatgcctcagcccagatctcaggaacaggctgcgacaaacctaggaaacccggaacgcctgctagaatactacagctggcatcagctgcatggatcaccaattactgcccaatgatcaccaacggatcaccaatcactgcccaatcctttttcgtagtcatcaaaatatacgtgataagttaaatttggtgatgaggccaagtagtgtttccttttccctatttcatgaaaaagtctaacagactattttaattaacttatttactttaaaatgatgggatcaacgtgaatcgcatgttttgatgacaccatttgtgtgacctcactttatagaaatggtagagcattttgttcttcaatcctccaaaaaaaaaagacaaaaatcaaataaactttgaaaactcacatttcataatttagaaaggcttatatatgggaaggagaggtgctgccatcagccaatggtagaccttctggccatagaggctttgtgggaataatgatatgcaactgaaagaagcaagccaaaacatacaggtgtaaatcgtttctgacttatgtgcagacccagccacatcaagctttgaaaaatatttcagcatcaagagtgtctgggtgcagctgcgggtcttttcctctgtttatgcgccgtccatggcttaactcatgtgaactggccaacgtcaggtgtcacgcagccctgtctgatggaaaacatatgtctacagaggtaggaagaaaaacccagccacaatccagccttgactcagtcacgatacaatgaagggaaaaaaagggctgcagacgcgtctctcgccctccttgtgtctctctcagctcctgccaacaatgagccgcttgtttctcttatttcccagaaacagtattagccatccaacaaggtcagcaaaaaaaaagcagcttttcacttcagggtgcatttggttccaaaaatctgtaaagtattaaaccgagaagttgtactatcccaacttcacactgagccctttattccaattctgggtgagaataactgcaaggaaatttctcagccggctcagttgataaggcacagagctctggaatatatgttgattcagccacactttcccagcttcactgtttcaagccttaaaaccacttccaggtgccccaaagcttgccagatgggcctccggtcctccagatgccccaagcctgtctagttttagacttgtaacccaagcttcgtttacttcacaggaaaccctgaatttttagcaccaggaaatgattttcctacttgctatcctgcctgcccatccaaacaataatgtagtccacacaccagtgtgcaagtatctaggcaactctcctttttcaggtgtaaaatagaaatgcctgtaacactggcttttatattttcataataactgcattaccccaaatgtatattttattggcatttaaaggattcagacattagttctcatcattataatatatccagggaagtctagggaaaaaaaaaaatcacatctttctggcaggctgatttcttctggatcctttttcctgtaaagaaagaactctttcttccacctaaagcagcatcagaatgtgctactctgactccatttgattgcagggatatctcaagatttatcacaagtggcccgtggcaggaagcacctctatggagttagtgaatttagaaaaacaattatctagcctgtgaaaaagaggaaatttagttattcactttgctgcttcacaaagttgtccttgtgattttgaatataattccatggttgggcaatagcagtacaactacaactgttttgttatcttcagacaataggtatacttttatccagcaggaaatggaaactctgattcatgcatttatttttctttagtcagtagagagtttattgtagctttttattggttagctttcctgaatcattttaaaactactccaggtgcgaagtatggcagttgcccaagctaagagaaaacgaatctacagctgtgttccacacggaatggaagaaaagttgccagcgtgagttgctagtttttaatgtgtgcatgtgttttttaatagcatgcccttttagtaaacatctttattatggagatcatgtaacagatactaagattccaagaggtagtcaaaagacttgaacgattcataaaagagaacatgcaattagtaataaaatatggcaaattatcagcttcgtaaggaatcacactaatgcaaattaaagaaacagcctttttcagcaatcaaataagcaaaaacaatagtgtggtttaggtgctttgcattgggccaggaccactcaggaaaaaaaaaaaaaacgaaagaagaatgtaaccaggggtaacaggattaggaaatctggtagaagtatatgccaaattttggaaacctgtataaatatgcatttcattgaggactgtacccatatatcttataggatttctagtgacccccaaaaagttaattacctttgaaatgaaaaagtattagaatattaacagtggtggtgtttcgcttatagaactatagatgattttttttctttccaatgatctacggttcacctagctattcatttcccctgtttctaggaagtagagatacaatgatgaacaagacagcaaggtccctgccctgtaggagattatcgtctaacgaaaagacaggctataacaaatgtacagaataattttagtgataagggatttgaacaaagaaatgtggagctattttaggcagggaagttaagaaaggcctctgtgaagcagtgatgtgtgctctaaatctgaatgaagtatggaaatcagggtgggggacaagtacaaagatcctaaggtggaaactgtgagcttggagtacttgtgcaaaatcagagcagcccatgtggctgaggagcagagggtgaggggccgggaccaggtcccttgaggcctcttgcctgtggtgagcactgtggttggcctctattccagactgatagaaatctccttccagctgactgcctggactgcatgggaaactgccagattatttcacactctatggtaaaatttaaaattctgaagaaatccagagactctgggggcacacagtgaagtgagtcaaaaagtgtgaagcaggccgggtgcaggggctcatgcctgtaatcccagcactttgggaggccgaggtgggcagatcacaaggtcaggagttccagaccagccttgccaacatagtgaaaccccgtctctactaaaattacaaaaattagctgggtatggtggcacgcgcctgtagtcccagctacttgggaagctgaggcgggagaattgcttgaacccggaaggtggaggttgcagtgagccgagatcgcgccactgcactccagcctgggagacagagtgagatgccgtctcaaaaacaaacaaacaaacaaaccatgaaggaaagaggccactccttgggatcaatgcctctcggtttgttgtctctcagccctgtaaagtggttcaggatctttgggaaggaaaggaataaggtttggggcaaggatgggggaacagacagaaaccaaagcagctctgcttttaaacacttacaaagaggagattctgatcccaagcaaaacaaaataaaagcctgtagctctaaattttatttgagaaggtgtgtcaaaaggagcttccttcttaaaaatgaaaacaaaacatacaacaaaaaaactacagttctggattttctaaatgttatccttgaatcaaaatgcatatgtagtatacactcattttggtcttctgtgaacactggctggtgctctgagatcatgccactacccagtatttaaaaagactatagaaaacttccccataaaactcctagtgttccctactggaatcttctttttttttttttttttttttttttttgagacagagtttcactctgtcacccaggctggagtgcaatggcacggtctcagctcactgcaacctccgcctccctgattcaagcgattctcttacctcagcctcccaagtagttgagattacaggcgcccaccaccacgcccagctaatttttgtattttttaatagagatgggatttcaccatattggccaggctgatctcgaacgcctgacctcagctgatccgcccgcctgggcctcccaaagtgctgggattacaggcgtgagccactgtgccaggccactactgtaatttcttttttaaggacattgtcccctagatcacagagtctagatgacttacggggaagtacaggagaactccctcttacatctctgtgtctagaaaaactacatttctcttcaacaccatgaaagcctttatctcttgagtgatctgactcctataacagagcatattatcttctttacaagatcccccaggaatctcacagccaaatctgtaggtacctctagcaaccacacaaggccccatggtatgcattttttccctggctttttttctcagccacagtcctttaccccaacttaattcaattatttatttttatccttttgaattacatgttttggccaggcacagtggctcacccctgtaatcccaacactttgggaggctgaggcgggaggatcacctgaggtcaggagttcaagaccagcctggccaacatggtgaaaccccatctctactaaaaatacaaaaattagacaagcgtggcggtgtgtgcctgtagtctctgctactggggaggctgaggcacgagaatcacttggaccagggaggtggatgttgcagtgagcggagatcacgccattgcactccaacctgggtgacagagcaaggctccatctcaaaaaaaaaaaaaaaaaagaattatatgttttttaagatgcaagagtagggaacaaatgaatggaagcatcataatttcattttaaaactactcgtgtgtcagtcacagattgccctcaatgagaaacttgtaaacctgtgaatgggccccaagcagtacacctgccagtctaggactcagaatgaagtgaaggagaaatgggttttttgtggtcttgagtcacactgagacagtcaactgcttgtgactctaataaacatagcctaccttttgtaaataaattaaaaaaaaaacctacctgtgtgtatatagctgcacagatatattatgtgtcaaataaataatgttctgtgaagcttaactgagcaggttggaaattttacttgttagtcatcccgaggggaagagtttacatgattttaggccataccttatagagacctggtagaccaaaaagcctttccacatatttcattagctttacagaacatattcattagaggagccatttggcacaagcatgctctgctgcccccaccccaccttccatagacactaccttcatcaagtgatcaaagctaatgtcacctatagtggaacaaatcgtgtgcctcctgataggattcaatgagaagaacacaacatcacttccatggtattcctgccaaaaatttataacctaaaccaaaatcacgaagaaatgccggacaaatccaaatttaaaaatgattcacaaaataactggcctatatattcctcaaaaatgtcaaggtccagaacacaaggaccgaagacttgttccaaattagaagagattatggaaacaggacaactaaatgcaatgtgagatcctcaatcacatcctgggccagaaacaaaaatagccacaaaggacatcaccgggacaactgaagacatttcgaatctgggctattagataagagtattgtatcaatgttaaatttcctgattttgatacctacactgtgcttatataagaaaatgtccagctgggcacggtggctcacgcctgtattcccagcactttgggaggccaaggcaggcagatcacctgaggttaggagttccagaccagcctggccaacatggggaaaccccatctctactaaaaatacaaaaatttgccaggcgtagtggcacacacctgtagtcccagctacttgggaggctgcagcaggggaattgcttgaacccaggagatggaggtttcaatgagacgagatcatgccactgcactccagcctgggcaacagagcaagactccatctcaaaaaaaaaaaaaaaaaaaagaaaagaaaagaaaaaagaaaaaaagaaaaagtcttttgagaaaatataagtatttctgggtaaaggagaatgatgtctccaactttgtctcaaatggttcagaaaaaaaaatatgtagatagatagatagatggatagatggatagatgcaaccgtggctatgtttataagcaaacaattaacaaaggcagatctggggaaaaggtatatgggaattccttagactaaacttgaaactcttctgtaagtttacaattctttcaaaataaatagtgacatttaaaaaaataaaacctctctacacatacctcaaacctcctggagacagaattctcagtccggcagggaccagagaaactgtgttatgtatgggccattgttctgtggcactgttgaactttgaggaaactcctattaaacaatgcttttgataactgattggaatttggatggaacagaatcccagctgcaatctgtgctacataattctgatacctcatactcatagttccttccagcctcccacctctatccccaaccccaactgttaaatgattctaattttaaaacatagacagcctaggaagacaggacaaagagctaccccaacagaccggttggaggtctttcagaagaaacgccactggatagctgcccctgaggaccagacacccagaataggaaattgcaggttttcttgggaaggacctgggacaccaagagagttgactgtcaagcttgagatctgttgtgaaaggtccttacatcccagggtcagagctgagacattgctccatttaggtcttcttgataggaggaaaaatgagcaagctaagagtggaggatggagaaggcaccagtgaatgcaaacatatgaaatagggaatgcctcaggcgaaagccatctgattttaatatatcgtagtttcgacactgagattccctcaaattgcaggaaaaatataatgtgtacttaaaactagaggagacacagaggagaggagaaagcacaagcaaagaagacatgctgaggatcccagaagagaagtctcccaaggggcagccctaggctgcagtgacccaggcagaaatgatatagggaaggtgtccagaaacctccagcatggagccgccctgagcatttgttttgttaggatgggatgatccaattccatttggagagaaattatagttccattctaattaattcaggcattacagcagttgatacggcagaaattaagagaatatttttcttgacatttgaagtgtgagctttgaagcagctaaatgaaggccttgtgaaccaagactaaatcagccacattaatttttttttaactttctttctttccagcgctgcaaatatttaagtcttggcaaaattcaaaactcacaactcactcttcactggtatctgagaaatataatactgaaaaggaaaaggacgaaaataatatggaatgaaatgcatgacatgtactgggaagcaaaataacttccaacgaaacttccatttatggcttagtcaaaaacatatggatatacaagctgaaaaacagagttagtgggaaagctaggtggctggttaaaaatacactttttgtggtaatgttacattattttttaaaagaaagtaacacccccccccgcaaaaaatcccctgctccaggatctttagacaattccttagtttgataaaagcaaaccatgtcaaaattgtattttttaagaaatgtttatattttattcagaaacattccaaagaaactggaaaagtgaggaaattaaaggtgggcacaaaaatgtatgtgtgtgcaagaaaatgtattgaaacatcatttataatgataaaaaatagaatcaacctatatgtctctcaatagaagaattggttaaataaattatggcattattggttaaataaattcacaaaaggactactgtgcagccattaacatgatgtgatggtttatgaacaaaagaagtatgtccaagtctattcataagttaaaaaaaaagaacatactgagaatctagtttgtagctatcagaatagtaaaggctataagtttaatcatagatattattggccagggtacggggaagaaaacacactttattggtaggggtgtcaattggtatacctttttggaaagaaatggaacaacagttttaaaaactttaaatgtacatactctttgatccaggaattccacttctgcaaaattatcctatacataaacagcatatggcacaaggatttatgtccaaggctgcacactgtggcattgtttagtaatagtgaccaaccagaaaataaactaaatatccagcacacaggactggttaaaccaagtacagtatctcaacggagtggaacattacatattgctgacaaacaatgaacaaatcagtaagtactaatttggaaggctctctaagatatgttaagttttaaaaagacatactgtatatgcccaagcatgcatgtgtatgtagagcatgtctagaataatgctcaggaagctggtagtagtgtttccctggaaaggagaaaagggctgggggtcatggtgggaaggagacctaatttttcataaataccctttggaactatttggattttttgccatatgcgtgtgttacttttctaattaaaacaactcatcaaaaaatattatagaaaaatatttactggccaggcgcagttgcttacacctgtaatcccaacactttgggggccgaggcgggcggatcacctgaggtcaggagttcaagaccggcctcgccaacatggtgaaaccctgtctctactaaaaatacaaaaattagccgggcatggtggcgtgtgcctgtagtcccagctactcaggaggctgaagcaggagaatggcttgaacctgggaggcagaggttgcagtgagccgaggtcttgccactgcactccagcctgggcgacagaacgagattctgtctcaaaaaaaaaaaaaaattactgaaatgggaagatgctcatggtatattaaaaacaagctacaaaaaagaatatagaggagtttccaactatttttatgtttgcattgaagaaagtcaagaaaatatatgaaaacacactagtgtcattttgaatggtaccatggctttttattttctcatgttttgccaatcagcattttctacagtgaccaaatagcaattatgtaatatggaaaaaaataacattcttgaatcttgctgcttcaaaaatgtttagaaccttttttttttctgccttaaaatacagacacacacacacacacacacacacacacacacacacacacacacacaaagggggaggggtgatcttctttttagcacttaaggagaaagacaatcaaggcttttgttttcctgaggcttcacttaaatgatattgttttgctgacttcatcctggagaactattcagaataaagcatggaagaacagctgttcttgaccaccagcaactgcaaaacacccagggaataaatttagacttccagaaaggaagaagaaatcaatcagttggtacctgggtgggagaggtgatgatcacacacaggcgggagcaatattaccagggacgccaaagaggagatcaaagagaagtgtcaaaatatcactcagcacttatcaatttggaacaagtggctgaatgacaaaccacctcgaatcccactgcctgcctttcacccttaactgggtgaaattctccatagcaaggaagctcctgagggcaaacttttggaagtcagccagcaaacaggatgaaaattgtcaaaattatttttaaaactctcaacagaggtctacagctcggtgaagaaattagactccattacaaattaattaattaactaattaattaatgtggtgcaaacaaagaaaggactaaaaaagaaaacaagtttgacctagccttcaccttcctaaaaggcctccctcttccccaggtgtgggggtgcttctctggaattcgtcacggtttaggcttacgaaggcctgatggattctcaggcccactctctgcaagcaaaactgaagcagacttgtacatttacccagtggattaaacaatacatttcaagaatctggatcccaagctataattttcctcctcatttttgaagtttacttggaatatttggggtcaagatgctctgggaagccgcttcagcattcacttacccaatgctcatgtgcgcactaacaccaagcaccaaaatgacaaaagtcaatgccctagtaaatgtctatttcagacaaagaatcagttaaaaagttggtgggcatactccaagtccttttcagataaattaaagactgaacgattgagtaggttcttgtatttttattatactggcattttcccatcactgtgctaacgtacacaattctttttttgttttgttttgttttgctttgctttgaggcggagtctggctctgtcacccaggctgcagtgcagcagctccatcttggctcactgcaacctccacctcctgggttcaagcgattctccttcctgagcctcccaagtagctgggactacaggtgtgtgccaccacacctggctaatttttttgtgtttttggtggagacggggtttcgccatgttggccaggctggtctcaaactcctgacctcaggtgatctgcccgccttggcctcccaaagcgctgggattacaggtgtgagacactgcacttggccttaacatacacaatttgattgtggctcccacacctggctgatgatcagagtcatctgagcactcgaaaacagcatacctttccagattccaccctacatttactgacacagaaatttccagggcatattcctcctagcagcagcccaggataattcttttgggagcaaacaaaccactgtattctaaaaatgtatgtttaacaaatgcccccaagtgatccagctagtggtagatctggaccacgcttggataaacactgatcttagagactagtgaataatctatttgccacaggcagacttgctcaactgcagaggcctgagcattcttggttttgtctttaatacacatggggcctggagccttttttccaacacactgttctcctcttccaccacaaaaagctcaaggttctcccctgttgttctcactctttttttttttttttctccttttggctattacaaaagtaatataaccgcattacagagaaaatagagggaatcacccttaactcaaaggcttaactataatcactattaacatttaaaaatacataactgacttactcaacacatttattctacagaagagtacacctatgatgcctaatgagctttgcttggggctagaaatacacagatggagatcaagttcctgtcctcaagaagcttagtcttgtgaaaaaatggaaagaatctaagcaatgtgtttttcaaaaaaatagaagtataattatagcataaacaatttgtcatgctgtgtaaaattagaatgttacaacaaagttttccatgtgtctacatggtctatatccattatttcactgcttataaatatatttgtggctaggcgcagtggctcaagcctgtaatcccagcacttactttgggaagctgaggcaggtgggtcacttgaggttaggtgtttgagactcacctggccaacgtggtgaaaacctacctctactaaaaagtacaaaaattggctgggtgtggtggtgggcacctataatcccagatactcgggggctgagctgggaggatggcttgaacctgggaggcagaggttgcagtgagccgagatcacaccactgcgctccagccagggcaacggaccaagattgcatctcagaaaataaataaataaataaatttatttattttcatatttcaggcatttgtttatttactggctattataactaacacatctttgtgtatggttcccaaaatattcacctagcatactactttttttttttaaggaaaattgtggcatcagacatttttcatggcttttattatttcttatcaaagaagaaattttctacctaaatttctaaatttcatataataaaacctataagtctccatcacctaatcttaataaagactcatccacattaagataagtggaacatagccatgaaaacataagatttattttttatatgctattatgtcctgctttattacataaaaggaactcaatccgttgatttggtaatttttttcagtctcatttcacatattccttaaaaaccgtaaaagaaaggaactataaagaatgtccttttcaggccgggtgctcgtgcctgtaatcccagcactttgggaggctgaggtgggcggatcacctgaggtcaggagtttgagaccagcctgaccaacacagagaaaccccgtctctactaaaaatacaaaattagccaggcatggtggcacatgcctgtaatcccagctacttgggaggctgaggcaggagaattgcttgaacccgggaggtggaggttgtggggaggtggaggttgcggtgagctgagattgtgccattgcactccagcctgagcaacaagagcgaaactctgtctcaaaaaaaaaaaaaaaaaaaagaatctcctcttcgaaaccccaaagaaggtagccttcaataatgctgattaactagagtgtatttgacaatagatagcttcctcaaaatctaagaaaattgagggcacagtggctcacacctgtaatcccagcattttgggaggccaaggtgggaggatcacttgagactaagagttcgagaccagcctaagcaacatggtgagacgccccaatctctacaaaataaaaagaaaattgattttctacagtgtttagaaaacttttccttcttttttttaatcaagaaaatcatttttaaatagaaacctttccccctgtcctgtgcccaccagtgttccttttcttccataaacacaaactttccaccacaacaatcctacaacacctacaacacccacaacacccaacacttcacttccaccatctcccaaaaagtgtatgggtatttttttgtttgtttgtctctgggtttgtgcgtgtatgtgccggtgcactttaggctaatctatgctgcataaaccacaaagttccaaaagcagtgagaacatcagagctggaaaaatcacagtagccagatgtgtctgccgtgaactcaccatgtaaatttgattaagaaaaaaactaatggaaaaaaaggaaaacataagatgcctaagtagaaatctgacttctagtgaactttcagcatgtctttccaagtgctttaagcaacccagggcttcgatatcccttagctattttatttgctcttgatacaatgctaagcctctttgtatacttcctagagagaacagcaagccaacttagcaaactgagcacagacaagattttccatcttgtcttgaaaagtatgccctgaaaagaaaaaaaaaaaaaaacacacatgtgtttataatttgaagtacagctcgagacacagacctggaggacttagactctgggctggtggatggcacatcttcaaaggggtaagtaagtgcgtgtgtgtgcatgtgtgtatatgtaactttaaaaatttcctatagtattgaaaatacactctagttgcactttaccaaaagtttctgaattggctagggttcgcaggctggtgaagttgttatagtctttattttttcctgtactgtcaggaaggatactagcatctcaggtcagggtctcattccaacaaaaagcctcattagtgtgtgacagcagctcagcacaccatggtttatgatcactaggattatcaccaaaaaggcaaaaaaaaaaagaaaggaaaaaagcatgacactttcttttggtaaaaacattttaaaatatggagctactttaagttgttgcatgttttcagtatttgtctgctgaggaatgggaaaatctaacacttcactacttgcagaggggaaaatgttcttcacttagaactcagaagtgtgactgctcttcacaaactccctctgtgaatgacctgacagtcacaagcttgctcctcttcatcttctcacaattgctgtccgaggttaaatgttattttttggtaccacaccagctagtttcacaatttgtaagcaaaagtgcccaaacaaatataagttgcagtaaccatggttgggtcttcctgaaggaggaatggaatggctttctaacagagcatatcaaaggatcttcctctgattacacaggagccagaaaggggaggaaaaatgaggcaactggctaacaataatagctataacaatacaagtgctggcagcttactatacatcaggtaccaagacatggactacctaaatactcaaaacaacgttatcagataggtactatcattatcaccattttacagataaggaaaatgagactcagaggttaaataacccaatacataaacgtctaaattaagagaaactcagttctgacttcaagttcttccaaaacagtccccaccctccatcccacttccatgcccacttcgccaccactctaaccaaggactaagatctgcagcaggcttcattttctcaagcccattgttttatacattataacagagcctgtgtaggcagtctatttttttccctcttttgtttccctcttattctcttttttaaaattttagtaagtattaatagtaaggaaggcccacaacctacttaaaacatacaaacttctggctgggtgcagtggctcacgcctgtaatcccagcactttgggaggctgagatgggcggattgcctgaggtcaggagttcgagaccaccctggccaacatggtgaaaccccatctctactaaaaatacaaaaattagctgggtgtggtggcgggcgcctgtaatcccagctactccagaggctgaggcaggataattgcttgaacctgggaggtggaggttgcagtgagccaagtctaaagtcccccaaggtcgtcttttcttcttccatttattgcatatgtctgggaattcaggcttaaaggccattactctgctcagacagaatccaaattggtaaagcctgatttggcaaatacaaaaactaaaattttagttttaagctagacgaaactggagatggctatttgaattaaagtgcaaaaaaaaaaaaaaaaaaaaaaaaaaaaaaaaaaaaaccatatttttgcaattttccccttcagagcttatttcattttacttagactcagtgttcaacaaatctgccaacctgcagaaagaatcctctgtttttacaaagtcactcactccaggatgactaagtaatgggtctttcctcttgcaataaaaatatggtttgatttacaagtcgcattacaggaatacatctaaagctctttttgttgttgtttttgttgttgagacggagtctcgctctgtcgcccaggctggagtgcagtggcgcaatctcggctcactgcaagctccgcctcccgggttcacgccattctcctgcctcagcctcccgagcagctgggactacaggcgcccgccaccacacccagctaattttttgcatttttagtagagacggggtttcaccgtgttagccatcacggtctcgatctcctgacctcgtgatcctcccacctcggtctcccaaagtgctgggattacaggtgtgagccaccgcgcccggcatctaaagctcttataaaaaataaggtgtctagtgataagaagtttctcctgggagaggtaacttaaacatttccaccagagggcactatcctcactgaaggtaatgaatacattgttcctaatttaaaacactttgcaatctaaccagcccaaaataaatcatttttattctagaaagcacttataaagaacagttaaattgtcttaaaatataacatgctatagttaaataaaatataaaatattttttgccataaaaataatgataataaacatatattttagcttactatgtggcaatcatagttctaagcactttgcatatataaactcgtaagttcctcatatattaataatccccattgtacatatgatgaaatcaaagcacagacaaataacttaagggtcaccaaactagtaactacagagccaggattcaaattctggcagtcagacacccaagtccatgtacctaacctacagaaacatacagggaccaaatacaagatttgtttctgaatgtagttaactatgccactgattatatcacggctctagaaataaataaaattagttataaaaggtactattctatcatctgatagtaatgctattaactgtattttgacatccttttcacatgtatataaatgccttgcattaaagaagacctatcactttagttcacttatttgacagctacattccattgaaaagtaccaaagttctagatttaagaagaaggaagagtgggaggagaagaatctgctcttttctttttctagtttttaagagttgggggtctcactatgttgcccaggctggcctcaaactcctatgcccaagagatcctcccacctcagagccttccaagtagctgggactacagggatgcacctctacacccagctctgctctttttatttttatatgtttaaagatatataataaagactatgaaccacaggcagagttatggcttgaaatgaaatagtctgagtaaatcatttattattctgactgtattgagactctctaaattaagtcctggtctttggaacttacttggcattccaagttgtatttccatccttcagacacatctgtgattctccataagctagaaacacactttgcaatgggcaaatacacaaatattgttggaaaaaccccagaatgtgcgtcttgagaaattcactgccttattagaaatctggaaactgctgggtgccgggtctcacgcctgtagtcccagcgctttgggaggctgaggcaagcggatcgccaggggtcaggagttcgggaccaacttggccaacatggtgaaatcccgtctctactaaaaatacaaaaattagctgggcgtgatgatacatgcacatagtcccagctactggggaagctgaggcatgagaattgcttgaaccaggaggcagaggttgcagtgagctgagatcgtgccactgcactccagcccggatgacagggtgagcctctttctcaaaataataataataataataataataataataataacaaaaattaaataaaaatagaaatctggaaactaaggtattttactgagctacaggtaaatttgtttcagaatgttcagattacaacttctttagatatactttactagtgcaattggactttgtgtgtgtgtgtgcatatgcatgcatgtatgcacatacaggcagactcacatgtgccttcaatatctagttccaagcattcaagcttcttttaattagtccacttcctacatatcgcacaaattttaaaaattaaggagaatgcataaaagaacatgacaaaggatatccactccagtatttgtatgctagcaacacactagtaacaacctaaatatctaccagataggagttagttaaataaactaattatagcatattaatatagtagactaataggcaaatttttaaaagaatgaagcagctctatatgtatggacaggcaggtgaaaaaagcaagatacagaacagtggttatgatatgctaaccttagtatgattaaacatacacacacacacaactagaaacactggttggctccaggaaacaaacttggggactgaggaaagggagattggaggaagtgtttgaatttttttttcttttcttttttttttttttttttttttgtaaactgggttcatgaaagatttttttccgattataattgattacaaagttaaagttaaaactttaataatcagtttttagaattttcgatgaaaattaaatggttaaacaaactgtaaaaaccagtctaatgccacctaatttggggtctctttactacagtggcatctgatttctacacgagctcctgtatatttgggacaaaataactcactggaggctttggtttaccactgctggtaccagaactggttgcattttctttgatctgccctttagataaggaactccacagaggttgttccatgtcatttgctttttggaaactgtacatctgcaagctttaaagcagtaggttcagacttcctggaagaactgacacttgaagctgactagggtctacttgagttcatactcactttggctaagccacagtatgagggaagggtgtccaggaataacgcttccatttttatcttgttcattcctgaaaatccaacaggagattcttttcactccctaaaattaactgttctgtgtataaagcatatctggatatctgatcttaaatggaaatgttatctgaaaatggcaccaacttttctaaaactttaaaattggcccttttttatttttagccctgggggagaaggaagggaatgattaccaaaaaagctgactggttccgttgctgcagtgtattaattcactggtgattatctctagtggggataattttagcagaaaatattctcttctcaagtctaaaatcgcacttattaagtattgtaaatgaagtaaaaagtgagccatattatcccacggcaggtatggggagaagccacctgcaggttatgtaatggttaactcccttctaaaatcagactagcctgctctccagctctgctctccacaagctgcaagactttcggaaagtttcttcatgtataaactggagagcctgctactttttgcaggggttttggaaggctttcataaggtaaggcatggaagcacttggcatgctatctgacacatgttatgcagcaattatgaaaaaaaaaggaaaaaagggaaataaggatagggatttgagactagaattgtacctgtaggcagtcgccaggagccaaagtcacccaaagcgtgtatgtgtcctacttgcctcaggctagatgaagacaggaggcctaactgatttttctaccccaattaaggccattggagggaaggtcagaactgtagtttaaaactgaggcagcagtatcatgagttggtggtaaagagaccaagtaaagaagaaaaagccggcagaagggtaacacggtattgcagccaagaagaaggagcaaacaccgtctgggtgcatgaagagacatagaaacagccagaaccacttatgagccccgccaccccttgattgaacaccatttcttcagcttggagtcaaagcttggggctccaccaggcacagtggttcatgcctgttatcgcagcactttgggagactgaggtgttaggattgtttgagcccacgagttcaacaccagcctgggcaacaaagggagaccccaactctacaaaaaaaaaatatcttttttaattttaaaaaagcttgaggcttaccgagatttggctgggatactgccatggacctctgaggcactggtgtggaactgacggcagggtggaggttcatatgattcagaggctgattcatcgccttcctagggtcttgccatgtggtgattttttctatgtgactaaaagaaggaaaacaattaattatctttttaattgtcagcatcattatcatcatcaccaacaacagcataatagttaatgacactaattcttcccttaggatctgcttgagtggttgatagattgtgcttggtttcatccaaggacatacttgcctatttttccctgcatcctggttaggccacactggggattctgcaagcagctctctaaacacaagcccaagacatcgctgtccagacagcccttgcatgcagtgagccccagtgaacttcccctcggcccgtggagcttgtattccccagcacctcagttgcttctcagccatccaatcactggagtgccatagtgtgagctccttcctggaaggggagccatgctcaccttcccagccagtaccccatactctcctgactcatagaattgacataatgaggatccctttggctgtcatcaagcaaaagatgggcccatgaaaccagcttctgaacaccacattagtgagctctcacagtaggagtgtaaggtatttcaaggtccccaaaggtgacacataaaaccctcaagaagctcactgtcaccaagcaaggtgacaatagggtagctggaaggcagagtattagaaaataatagtaggaaagtcaactagtgccagcttatggagaaacttagatattgaggcatgaaggtttacaagggagaagacatgattacatgtttgatcacatacaacttccagtttgttactgtgacttaatcacagagaaactaacccaacatgaaacatgagcttctgctcagagtttccagtacattctaagaaaggtggacatggcctccagctttgcctaccaccttccaaatcacattgcaggtcactcctggtaccttagagactctgtcccactccatcaaactcttcctttagtgaaagtttgtgatatatatatatatatgatgagtagattcatcccgttcctctactttgttttataaacagtatcagaaatcttccttctcctccttctccttcttttttgttttttcgagacatgatcttgctctgttacccaggctggagtacagtggcataatcatggcccattgcagccccgacatcctgggctgaagcaatcttcccaccttggcctactgagtacctgggaccacaggcacctgcgaccacacctggctcattttttttaaaaaattttttttgtagaggtgggtgtctccttatgttgcccaggctggtctcgaactcctgagctcaagtgatcctcccacctcagtctcccaaagtgctgggattacaggcacaagccaccgcacccagcccagtatcagagatctttccatatccatcaaagacaacaaacatgatagaagaaactgaatgttagccctttgttttgggcctcacaaccaggtgggtctcttccagtcaggcccccaccattgaccttccttagacatacaacaaaaggagcatgattgttgtttctgttaaacacacctcacttttgaataacaatggcctcctttgaatctttaaggtaggaaaccacttttactttcgttatgtttaatcagtctagaaacttccttgcattgaagttgtatttgtcttgttttcttttcagtctgtctcctcatttttaaatgcttcctctgctaaaattgttattcagatttcttaatgcaagacttgaaggtattgccaaggggaactcatccattgccttgcgtgaaaacttgggtctaaaggtctaaggttttagaataaatgtgattaaaaaaaaaaaaaaaaaggccgggggcggtggctcacgcctctaatcccagcactttgggaggccgaggcgggtggatcaccacaggtcaagagttcgagaccagcctggccaacatggtgaaaccccagctctattaaaaatataaaaagtagccggcatggtgatgcacgcgtgtaaccccagctactcgggaggctgagacaggagaatcgcttgaacccgggaggtggaggttgcagtgagttgggatcatgccactgcactccagcctaggcagcagagtgagactccatcccccccaaaaaaaaaagatggggaaatactgaagtaaagagatgaaaatcatttccctaagtataaagtaaataataataaaaacaatagttttagtttacactttcagtttcacaattgtagttctgtttaaagctttcataaaatccatcaacttctgggcaggtggaaactcatagccagcctcaggcttgtcacaggccttccaagtgaggaactaattgatgaggatgtcaaaattaagtaactccctttagcaaaataattagacctaagaaatgctttgattattccttcagaactcattctattaaagcagcatgttttccaaggcagacatgtgctacataaatagttttcactctggtaccagaaggaaaagaatccttctctctttcataaacctttcttagactctctgacatcatggatattgatgctgtgctagaaccaacatcagcacaggccccggtgagatgtggaaatatacatcatttgctggaagatgttcaaggacacttccgtggtcagaatttcagctaccagctctaggaataatacaggagctggaatgatgcattcctaaatgctcgtcccccactctcccctcccgttctgaacaagtgggctgtggctcctgaatgcggcaagagcaggaacatctagcataggaagcccagcatctgaagtggcagatgagctcatcttgccccaggagtgccagcacagcttgccagcctaaatcccctgggacagagtgtggggccttctgggtggacctcatcctgacagttctgaccgagcttacccatggcttgaagtcccagcactcctgcagtgcagtgggagcctccacggcccacccttcaaactccacacccagccaacacatttaaaggagttttgttcccagtggatttgttaattaaaagtgtcactcacagcattccccaaaggctggagtacaagagggagcctttcttaagtgagcagttctcattgctccaaaacaactctgagaagaaagcccaaattcctggctctgcagaccagtcgacctgacatcagctgtaaggctgcgctaacatggtgtcaagagtggctcccaggctgaatgcaacaagtaagagtgagctattgctcacaagaggcacttaatacagccttgatgatttcatctgaaaactaaattctcctattgttctaatcacttagtgcctcaggctccagctccccctacttcccaccacttcccaaacccaggatacgccattcactctttcactctgctgtctcatctctgctccctctctcaatgttactgagtcatttcctttctcgtatttcacagtgtaatctcagtgtttgccaggacccacaatttagctagattaatccccacttccccgctactcccacctccttcctggcttcactcccttgcttagtctacttcaagaaaaactctctgctgttttaaaagtataacttcccttggaaatgcacacacatatacaaatatatttaacctgcctatatatgtgtattgtataaatacatacactgtacaggtttcatatttgaaaatggaacaaaaaaggaaaaagaaacatatcaaactatttatggtgatatatgcaaataacaggctcactggtaattttttttttcttatctaaactgctttgtactttccagatttttagcagtgattatgtattgttttcacaaccagtaaaaacaaaaatactaatgaaggtacaaaaagacaaaaaagaaaattgatgcatgaatacacaggtcataaggtataagcagcactttgggaggccgaggtgggcagatcacctgaggttgggagttcgagaccagcctgaccaacatggagaagccctgtctctactaaaaatacaaaattagccggctgtggtggcacatgcctgtaatcccagctactcaggaggctgaggcaggagaattgcttgaacccaggaggcggagattgtggtgagccgagatcgcaccattgcactccagcctgggcaacaagagagaaactcagtctcaaagaacaaacaaacaaacaaacaaaaagagttcctgaagataaactacacttttggctcctatcttcgtgtggctcaaatcaggggacaaatggaatcaatcacctgatcccatgctgtttataaagaaaaagaatagcagttcctacggggaagaaaagcttttcttgacagtaaacatttttttcctcgacttaaaaaaaagaaaaatcctctacaagtgcttcccatggagagccctggtggtatgtggggttaacggtacctgtaacaaatataagcgggagtgggctttttccccttccttcaagagccccttggaccactacttcccagacagcctccttctctcagtcccagaaagaccaaccaattcctggcctccaattacattatgagtctctgcttagagaactgcccaggttggacaaaagcatggagtttgctaaggggcaagaaaggtcaccacgtctctgagaagatatttggctggaaatggtaggttatgaaaaaccatgtcgtgtgaaatcagttttccctcatggattaatattttcctccagaaagacgcaaatgtagaaagccattttatttaacaggtaaattgtgtgtttggggttaaaatgttttgaaattggtggggtggcactcccaccctccaagtcaccctcccctcagactggcctccccatcagcctgcggagggggtgttaactttgctccagtttcctcctctcaagccactgctacctccttctacctccttcatgacctttcaccttgatgagggcaatggcctctgggcttcccttctgccaatctttctggttttcctcccttcctccttccctccccccaccctctctgcctgacaatccattcactatctcacctccaggcacatatcccaaggacacctggtatccaagtccccctgggtcaccatggcccatgaaataacagcacaactcacataggcatctcccagacacagcagcctactgccagactctgtgggctctgcaaagaccacacgcagttgtggagtcacatatacctgggtgcccgggtttaatattagctctgaccctgtgtgatctaattggatatcctagtcacactacccatatgcatgagacaggggtaaaaaagctaacaatatactggttcctcactgtgaggataaagcaggtctgttctgggaatattatgaccaccaaagtcacttacagatttcatggccagttctcctggcttcccaaactcactcagcagtgagtgcagagaaggcagctctggccttccaaggttggcaacacttggttcaagttttttcaacaaccatagatcgtatacctattatgcatgatgggtgatgtactggttaggtgtaaaaatcaaaaacattgtgcaaacatagtaaaggcaaagataaaaatcttatctgtaaaaatagaataatcaggccgggcacagtggcctgtaatcccagcactttgggaggccgaggcgggtggatcacctgaggtcgggagttagagactagcctggcgaacatggagaaaccctgtctctactaaaaatacaaaattagacaggcatggtggtgctactcgggaggcagaggcaagagaaacacttgaaccggggaggcggaggttgcagtgagctgagagagcgccattattgcactccagcctgggcaacaagagtgaaactccatctcaaaaaaaataaaataaaatagaatcctccagcttcttaccacccaggaaaaggcctggtgtttttggatgaatttacccacactaactttatgatgaaggaagccgtataacaaggactttctgaaatagagaatcccatgtaatgtattttgtattgctggaagcatacaaagatataaaaataggaatgattacaagtgcttcattttgaaagaatttaaaactattagcagcatgttgcttatttctatgggcaaagattttgtcttcaaacataagtgttttgtcttttttctgcccaccatttatttaataaatgagagtttcatacagtgtcagacatcagggctcccctccatcagcagagtggttaggacgggacctggaagcagcctccaaactgcctcttcttttgccacaacctagctgagcagttaaagagaaccacaccaatgagatgagaatttaaagacagcctggggtcataaaaccaaggcagactggtttaaaactcaatcatactcactgctccctgtcttcatcccctcagtgaaattcctctgtagcctctgtccttactacctccttttttctcttccagtagaatacaagctcttccagaagaaatgttccacagataatgctagccaggtgtggtggctcacacctgtaatcttagcactctgggaggctgaggcgggaggactgcttgagccccagagttggagaccagcttgggcaacataaaaagaccctagctcttaaaaaacaaaaaagaaaaaaagctgccaagcctatgatatttacaatccccatttaagtataagcaaactgtcttatttcagaaaatcagatttttaaaacttttttgatttactaggccaattcaccatcctcttaatgttaaaacaaatgtacatactgaagacaattagcttaaaatttgctaaatgaaacagctttgcaacttgcttcttgtgactcagtccaattagacccactagtgttaaaaatggaaactgaaacagatttggatgaggttgataaattcccagatagggcctgccaagtaaatctgacccactgtcagtagacaacaaatgctatgccaatttttaatcctgtaccagatggcaaggagtcttgccgaagacttatattaaacttttaaaattttcctcaactggaattagaatacaagtatgcaaaaggtggtttactttctcgttgtatgttggggataaatactgtttgcatttaaatcaaattaaacattctattagtgtgatcttatttagatttcaagacctaggaaatgacatatatcttactcatatcttacatttcttttagtagtaccttttgttttgccaacggtacttagctctgctaaccaacaccagagatgagtcttaaccacaagaacaaagacaggggtggtatgcacacttactaattctcccaggcccagatgcacactttctccaggtagtccctctgctgtcacctaaaaccacaatgcaatgggagctgagcacagtggaagcccattgcagtgggagcccattgcaggagaaaccccagggagctcatcacagaagggaggccacatcacagagggagcccatgacagtagaagccccatcgcagtggatgctcagctcaccacccacatctaaactagcaacccgacctgatcatgtttgtaatactaagattaggttttttgtttgtttgtttgtttttgagacggagtttcgctcttgtcacccaggctggagtgcaatggtgcgatctcagctccctgcagcctctgccttccggttcaggcaattctcctcctttagcctcccaagtagctgggattataggcgtgtgccaccacacctggctaacttttgtatttttagtagagatggggtttcaccatattggccaggctgatctaaactcttgacctcaggccatccacccgcctcaggctcccaaagtgctgggattataggcgtgagccaccgcgcctggcgacaatattaagattagtagccatccagtacattgatctcctctgcttaacgttatcagtctatttgcataatgtggagtcggcttttgaacttcgatatgttgacaatcagaaataaagtaatagctcttcacatggttgaagagatacatagcttaggttttactgtatttctagaaaccctaatcaatcttcctcccacgttgtcattctttctaccaccctaattaataattctttgtcccaaggcagcttttaaaacactattattggttataatgattcttccattctgcccaaatcctaaacggcaccatctcctgctatttttaatgcatcagaatagaagatacaaagaggtaaaagtcaagctgccaatgtgcacagctgacacatctattagcaaagcattcagagtttaaaccccaaagctattaaaaaaaaaaaaagactcatgccatataataaaggtgactcttcacacagcagaaatgtgttagatgagaaagttcatccttctttgaaaccacaaagaatttatagttgaaagtttccggtcagattttcacttaagcagctcatcaaacatagctgcagtctatgacacagaaataataactgatatataaataggggatttttttaggatcctctaataaaagatgatacaagaccagagaagttatttcagtgtatggttccggtctctaccattcacttgccaattcaaaaaatttcagcattctctggaattctgaatgaatggcagggattgtatttttaactaccaggctctaatcctcgacttccctcacagacttgccaagaagtttccacttgtttaagttagcagcagtaggcacagcagccatgtgaaaggtctcctagtgcctctgccctggccagctgtggtgatccatctccctcacgtccttcccactgagcaccaccgacttttctgcagactcattctgtctgaacctactcagtcaggcagaagctgagtcaagcaaagctgctgtcagccccaaagagcagatgagccaaatcaggactgtaatacccgtggttcctgcagggattcatttaccagagttttgtccctggggtgggaaaaaaaagtggcactgtgaagtgccacttcccagagaaaaccactttggaaggctggtgactcatcaagacagccccaggtgtgactcaggagcctcacttcagaaggtgaacagttcagtcactgtgttagagacaccccgtcatatgctgcacgcaccccaacagcacccggccctggcaagcctcactttgcctctgcaaactgagcaaaattcttgcttaacctcatttttcctattttgtgaaaacataagaaggaaaaaaaaaaaaggactgggagtttctgttgcttgtttgatttgggccaagagccatattaaagaactttggctgcgttgcaaacaattttattattagtaccagcatttttttttctcctctcatgccaggatcaataatgctattaaaaaatgtatagtccagacacagtggctcacgcctgtaatcctagcactttgggaggctgaggcaggaggattgcttgagcataggagttcaaggccagcctgggcaacatagggagatcttatctctaaaaaaaaaaaaatcaaaatatgagtcgggcgtggtggtatatgcctgtggtcccagcttcttgggaggctgaagcggaagattacttcagcctgggaggtcgaggctgcagtgagccgtgatcataccactgcaccccagtgtgggcggcagagcaaaactctgtctcaaaaataataataaaataaaataaataaaagatgtataaatcaccttaagtttattgtgttggaactccacaacaatgtgagagtctatttcacgatattatttccagatgtcaagtataaaatatgtacttggtagagtctttatttcacttttctcctttctcacaaacaaaaacatgggatgagaatcagaagtagagaaaagatgagacgctttatgaatggtgaattattattactcttatttttttctgagatggagtttcactctttcaaccaggctggagtgaagtggcacaatcttggttcactgcaacctccgcccctcaggttcaagcgattctcctgcctcaacctcctgagtagctaggattataggcgtgtgccaccacacctgacgaatttttgtatttttagtagaggcagggtttcaccatgttggccaggctggtcctgaactcttgacctcatgttatccacccgcttcggcctcccaaagtgctaggatgacaggcatgagccaccacgcccagccacatgaatagtgaattctagaataattaataggaagtggaatgtattcatccattttttcattagacaagtatttacagtggggtacatcttccatagggattcagttccaaactcagttttcttttgtttgaaagagatgctgcccaggctggactccaacagttgggcttaagtgatcctcctgcctcagcctcccgaggctgggtctacacatgcgtgccaccttgctctgctccccaaaatcagttttggcaaatgtggagtgtggtaaaaattaccactgaaaaacttttgaatatacagtccactaggctttgtgtacattatattatctttcagtaagcccaatgcagccagtttcttccagggttagaatatggtgctatttctacacccaagatccagatgaagtgatgctgtacccaaatatgtatgtcgggatttgctaggcactcagtgatgaattcacgacacttcaacatgcatacggtgatgagtgcctgtaatacctaggccctcaaggagctggcagtcaaatgagcagggagaaggtggcagtgaaacaacgagcagtatggtggtaaacagcacagactctattgtttttgttattataaatggtccagagcctgacactctgtctcaacagctgtatgttagaaatgtttcccatatcaactgcatctaacatctaggaatcagcttcaatctcacaataagtcttaaaaagaagttagtattttagagtagccactaagctactctaaatgctaaaatactttgacaattgtttttccatgctctctgtgcctaacacgtttttaacatgttgttttttccagttgttcttaaatgggacactgacccagtgcttggctgctccgaagccactccaaatgtgaaatatgtcgaagctaaagctgcactgccctcctttctcttctttctaatggggccaagtgaattaaatgtcactcatcccaaaaaagaaggcaaatcctctttaaaaccaaaaattcttttgggttaggctagcttctcctctattcatgtgaagagatttaattcctttttgttggttttgtttttttcaattctgggaagaggatgagccaccctggctctggccatcagagccactttctttttgcacatgtttgaaaggcatgacacaacttgaactggaaaaagggctggcatgaaccccggcatctcaagagagactagaggtgcttttcagagtgaggttcccattttgcaagaaattatttggaggatcaaagacaaaaactgaggcatcgaaagggaccaacttaggcttcagaggaaggggagagtgctactggggaccttgaaaataattatcaggaaacacagcttatggttcacatttcaaacccagcctacaatgtttctttacgtgtatttcttggcatcttcagtcgaaaatatcacccaaatgaggcagagtggtacagtggatttgagatctgtttctgccattaactgactaagagactactgtaagtaacatctccaagccttggtctcctccaatgtaaaatgggcataagaacatccattacatgaggctgttttgagaatttcatcaaataacaaaagtaaagcacctagcacagtgccggatatgcatgacacactataaatattagttcccttcctttcccttgtgaaaatctatccaaactgtttaaagggatctgagtaattcaaatgcaaaaaaagaaaaaaaatcaataaacaccttatagtacaatgaacacaagaaaatggagagaaataatggtagacatcaatttactgcaaaaactacagatatacttgatttctttcgtgtgtgtgtgtgtgtgtgtgtgtgtgtgtgtgtttaagatggagtttcactcttgtcacccagactggagaacgatctctgctcactgcaaccttcacttcccaggttcaagtgattcttttgcctcagtctcctgagtagctggcactacaggcatgcgccactacgccaggctaatttttttgtatttttagtagagacggggtttcaccatgttggccaggctggtcttgaactcctgacctcaggtgatctgcctgcctcggcctcccaaagtgctgggattacaggcatgagccactgcacctggctgatatacttgatttcatatagtcgagtagttaagtaacaattgactcagagacaaaaatattcttaaaacacaggtctagctaaccacaagtctcacatagttcccccaccagcaccccacaatttttttttttttgcattctaataatagcaactctcagattcagtgtgagaggcagccaaagctgcgattcctttactgcccttgttggtaatgagtgccttggtggtaatgagcatctcatgtcagcacaagattttctctcccatttaaagtagaaaggggacttcagcttgcagtaaaaagcacagtaagattgaatgcaagcaaaagaatatgtaatggatttccatttttcctaataaagaaatgctcaagaagttttaatctaatttaatttttctaataatttacaaggagataatagttccaaaatgtgaggggacataccaggtacagaaatgcaggaagccttgaaggttctatgacttcaactaatggaaaaacagatttagcctaaaaaatgctgttgtttttaaacaagtatgtttatgcaaactccaaacagtaagtatctttgtacccacaagtggatgttaataaaaaatacatgattgatttaattttttacttaacaaagtacaaaaatatgtacctgtttcaattatgacttcaaaccccatccttcttcatgaaagtagcagataaaaatcatataaaatcaacatctatttgtgcgtatataactttttgttttgatatacctttaaacttataggaaagttgcaagaatatatacggcacggccatctactgattcaccaacttttttttttttatttaagttagtagcattagaataatcacttgtttctaaatgatccctcagtgatagtaatcctttggctggtcacttttctaactttgaagagaagtgagttttattctgtaacactcgcaagataaagaaagatgaaaaaaagctaatataaaccaatttgaataaccaaatcgggaaaccatgtgtgatattgtgatatattaagaaataaatctctgtcaccattgccgatctagagttcctataacccttgtagataggggtgctaggagaatctttggttttaatatttggtctttgacttcggctcctgacacagagcttctaatcccttggaattttctgggtgataggaacttctcttgttttaatgaggtgactgttggtgggctcctacatagccttaggaaggggctggttgccagggggaaccaaccacatggctggaggattcgaactttcagtcccacaccacatcccaaccttcagggaagggaagaggggctgaaggatgagctgatcaccagtgatgaaatcaattatgcctatgtaataaagcctccataaaaatccataaggatagggttcagagagcttctggatagctgaacatgtgaaggctcctggagggtggcacatccagagagggtgtggaagctccaagtaccttgtcctatgtatctcttccacctggctgttcatctgaatcccttgtaacattctttctaataaatgggtaaaagtaagtgaagtgtctccctgagttatgtgagtcattctagcaaatggatcaaatccaaggagggagttagtcagaagcacaggtcaccacctgtagcttgcaattggcatctaaaaaggtgggctggagggggtgcagtcttgtgggactaagcccttagcctgtgagatctgatactatctctgggtaggtagtgtcagaattgaatgaaattacaggacacccagttggtgtctgctagggaatcggaagtgctgtgttggatggtgtgtgagggtaaaaagaaaaaagtttgattttttttttcccttcagacctggtgacaccaagttttttgataaaatctaaagtaataacatttcagcagtaatgatgatgaccccaatgtccttccactgaaggagaaaacagaccccacccaaaaggtgggaagcgccggcagatgattcctttatttatggagctgctgatggtcacaccacggtgtaatacaaacatttctgtctaaacactaacttgggcagagccacttttacactgtgccttgtatttaattgacaggaagtttttcaaaacaggagagagctgccttactttgattaatgtattaattcaactggcaacctccaaataagttttcttaggagtagaggaaatacgtgcgaataacattaaaatgtccttccagtgcttggaatgaatattctacttgtacagacatagattttgaagacaaaattgtaaatagtaaaatctccacctcactctttatagaatgtatgatttaataaacaaaagaaaaaatgcagcttcagaaaaatagctttaaaaatgcccataaaatgcacacaaaagaacctgaaaacttacggcgggttattctcgcatattactagacttaacttggtaccatctttctgaagagcagtatatcaatatgcaacaaaaacctgggaaaagctttgatccagtaagtccatttgcacaaagcttttattcccagaaaacaattagatgggaatgacagagatggttgttgctttggaatatctgctctccctttttaggtgctaagtattgccaagagactaagttctagacaatgaacagaagtgctgtgtgggcttctgggaaaggtttttaaacggaagcaatagacatacgtttctgcttcccacccttccatcttttctccagcctggcatatgaacgtgatggctggagctgcagcagacagctggaattatgaggaatggaagccactcagtaagaacaactaagcagaaaggtgcagcggagccagcaaaccagctcttgagttccttaattcagatttccttaatgttagagaaataaatgatctcatttcgcatccctgtaaatcacaaacatgactccaaaccaatacaagtatgcagaatgtatgcttaaggatgtccacagcggttttgtttctatctttagtgtatgatgatagaatggttaaacaaattatggtacagtcagacagtggaagactgaacagacatgataaattacatggatctgtatttgctaaaatatattgtgggagtgaacataatcccgttttggtaaatagaacacatatgaacaagggggaagtaggctttattcatatctttacatttctttgttctttttgtacaataagcattatttttctaatcagaaaaaaaatgagaaagctatcctccccccaaaatgaacccatttcctgcttaaaaaatgatgctgcattccacatttgaacctatacctgctcattacagcctctgaaaataattccacagctatagtgcaggactgaaaatcttgtctctgccttaactgtgagttggaaaaggcgccaccataatactcccatgagtgcttagcctaaaggtgctctgaactagagagaggcacaaaagggggaaaaatgcaatagaaggaagggataaagaggatcaagggaagttctataattaagcaatattttacggctgcctctggcagctgtttgagtgagcgggagaatctaaacgaggtgtcaacagacacaggagctgccctctccttgggcagatccagcagggcctagcatgtcctgtacttcacaggacaatctggggcatcttatatccagcacctgtcagcctgggagactcccagctgcaatactgttattgctgtcatctgcctaatccagaagggagcggcatttattgtatctagaaagaaagattaggctaaaatatatttgactgttcttatgaaagagaatgcatgcctcacgtaactgtgtttgttttcttcttgtccctcctgactttttctgtttttatcaaaggaagaaacctactcttgcagctgtatttttcatttttaacccccacgttaatcatatattcacaacaaataatggtttaaatttagtctgacgaccagccacaaggctccttctcatcccactatgaggcacatcctgccttcagactctttacgcaatcctcattgacttggagaggaaccccgtgcaatgagttaaacaggatatagaccatcataattaccagaggaaatggtattttctttacaggatacatttagatttttcctttccatgagttttttttttttttaatggtgttaaaatgaaaggagactttaaagcagctttcaacttctcagtagccccaactatggactaaatgcagaaggccttacacacagcagacattaaaaaactactcatagaataagtgactgaattaaaggaatgaatgaatgaatgaatgaacatatttaatgggtttacttcgacaaatcattttgcttctaggtatcaaatataacagttgaatcttattcacatcatatatgtttttatctgtaagtactcataaaactaatctaggaagatttgttccttacttgccccagaaaggaacaaattctagagaatgctgtcacattctattaaacaaattaagtcattctcaattcattcctgttgattctgcaaactgctcggctgagcctctaccaggtactatacaccatgggtcctgaaagtccaccatatctagcatacaatagacactaaataataaatgtatgttgaatgaattgctacttatattcctaataatgacaatcatggtaataatgatagttacaataataattattcatattaattattagtcataatattcacaataaccatgctgttaatgtctgataataatagttgacatttatataccattttatggcttcaaaaatgatcttaacttgatcattacataacaggcttactaatctctgtttttaagaaataaaaatgggccgggtgcggtggcttacacctgtaatcccagcactttgggaggccgaggcaggcgggtcacctgaggtcaggagtttcagacaagcctggccaacgtggtgaaaccccatctctactaaaaatacaaaaattcaccaggcatggtggcgggtgtaatcccagctactcgagaggctgaggcaggagaatcgcttgaacccgggaggtggaggttgcagcgagccgagatcatgccattgcactccagcctgggtgacaagagggagactccgtctcaaaaaaaagatacagaaacagagttgggtgaagtaaacctacttaataagttcttagtttccatgtggcagagcagagtcaaatcttgttctcataataaggtctagggctttttccatgatacaatactgccttgtgaacccaaagaggctgacgtgcataacttgggccattaggaaggaaggaaaaggggaggtggaccgtcagcactgctgatagcctgactttgtcctggaacaatatctcctgcaggcttggtcctcctcttgcttcaataacacaccaccatccctccttgtccctcctgaaacccttgagtcacacagtatgtcaacttgcctgcaaaacttagctttttttttttttttaacaccctggttttaattaggcatatcctgtcaagaaaagggactcttgtgacaataaaacaaattaggtccatgtgatcctgtagttgttagggagaaaggaaagaaagaaatacaaatactacttaaaaaaacataaatacaaagcggaacgccaactctccactatgacctaaaaggaagaggtaaaaggactctgaagatagatttggagatgcaaggcaacagctgaatatgccatgagcaatgctggaaccctaagccagagctggggatgtgattcttaaggccctgccacttggaaagccaaaacctgttccttcagaagccagtctctgatagtaactttagcctaacttgccttccatttttattaatgcttttaatatcatattgcctttagtttttattaatgttttcattattttaataactagggaaaatattcaaatagggctgttgtataaaatgtgttcagtctataataagctatgtaaccagcctttataattgactatataactgtaattacttaactaaaattcaagatgtacattcacttttcctaaattttctctaaacaaaaaaaagtagtagagataaattccaatttttctaagaaattaccttttcatgataatatcttatgttttaaaacatttacacaaaaaacatttttgcaatgtattctgaaattaaaaatagttatattagaagaaacatttcattctgggttaggaattgtagtcattttaaatgacttgagaaaaaagttcatgtttaaatactcagacccgtaataaatatattaatacaaaagtgcgggaaaatgtacaaatgttatcatatgttgccaaatgtgagaaacattgcgggagggggtaggagaaagaattagtgaatacaaagtcattgtgaattcagcaaagggagagacacttctgattctgccaactgcatctggtatttccacctaaaatctacttctccggtaacaaatgctttcaggttcaaccagactgtgaggagacacagctatggggcaaggtaacctcaatgatgttctataaaacatcagtcctagaagataatccccctcacccctgcacccaaaagggttctgttatcaaataagtatggaaaacactgaatgttatattcctctcctaatatttatacaatacatatgcatataaaagattctagttttcaattagcttaatcccacatttctgtaattcattttatgtgtaacttttttcacttaattattactatcctatagaatacattttaagaagttgcaaaatatactatttatggtatttattacaagcatgacttcagattcaacagcattgtctgaacacacactgtgcttctgacactatggcaatattttatacccaactgaccagaactaaaaaaactacaggcgttcctatccaaaggcactgaataaatgtaagtacaatgctatgaagccctgatgccaaagcatcccaacgacaaagttcattcaaagcagagctaatatagattagagagattaatcggcatatatcagaatatatatatacaggcatatatgtatgtgtataaatatatatacatatgtaaaacacacatgtaaatttccatatagcttgaaattaacttgtgtttttaaaaagtgacctgaactgtttatacccagaaagcttttaatcgtccgctgtattttaaaatcaggagcctgtatctattcttagtgtgctttcgaaataaagcttcccttggttcggggtcacagctgctgcaaagcactctgggtggctcctctccatccctttgaaacagctggtgggaacctagtataaggccttgaacccagctgttcaatcttactttctaactttagcaagtcccttctccactaatgtcactggggcatgccacattgaaaaacacaccagagatggtagattcctatccctgctaaaaaaaactccaggcacaccgagccaagttacactcatgtaccaatcacagtatcacccagataccgactgcaggatccgcgtgatctgatttaggctgggcataccaatgatttaagaaggcttccctagacaccacaaataggcatgctgccatcactcctgccagttcagtgcattagaaagttaccgactaccagtggcagagccccacaacgtagaatcgagaagaccatgaaaaccaacctcagattcaaaagacttgcacatacaatgtgctgtctggtggcttttgtctccacaatgttaatgcaccgtacactactcatgaagccctcataatgtaattacttctatttaattgattgtacatgccctcgtcttagttttctttctttttttttttttaattgcatgctcattgtaattacttgccccaaagccaggagatttcagaaatatttgactgtttattaccctttgagaattactaattaaaataatttccttcagtgaaaagggttgctcttttcctgattccacttcgacactgctcaccactgaagagaactctaagaatgccttgctaagctcccctgtaattgactgcctcctttgttaacacatgcgtggacttaaaaaacattaaacgacttatacaaatggaaacaaaatgctctttgagttctattgataacttaacctttagtgttttggatgaaatcccaattctagggaagcagggggagccattgaatgaaaccattatgtaaaacattgttgtgggaattattttgtgtgaaaatatatacagtatatcatttaaaatgtctttgaaggtgggctttcaaaatacctaattaaaatatacatattttgtatggcttctctacttcgtgcttcctttttcagggaaagagaagaaatttgcataaggcaaatgaacccatgacgctggatgttagagtaggtacccttggggaatctggaaggggcgctttttggagctgggaaaaatcctgtttcttgggtcagagacctgcttacgtgggtgtgttcaatttgtgcaaattcatcaagccgtttatttatggtttgtatactgttctacaaaaattctacttcatttcttaaagtaatcaagagaaattacctccatttttttcaagtaatttgtataaaagacaaagggatgtagtttccatatagcagaagcctaagaattactctgaggcatttacaaggaatagaaattaagactgtggtcagggggcctctctgaacttattctggtttaggagttccccctccccctcaaaaagactgtaattgatttttctatgtcgattttttttaaatggtgtacaatatttggtttgagcaagccgatgtaaaaaaacacatctgagaccattaggaatatttgaatatgtactggatattaaataatattttaagaaattattgcttctatcctgataagatacaataagaaattcacaaaatcatttatgctgtatttttgtgaaaaattttaacctaatttaatcataaagaacccatcgtgtgtgatagtggtctaaagtttttttcaaaacaggttaagacgaaaaacaaacaaaatggtcaaggggagagacactttttgaatcaggagaaacataattattactaaatgcaatatgtgaatctgattggatcctgcactggggaaaacagacacacacacaaacacacacacaccacacacacacacacagagctacaaaagacatttttggaacaactgggggaatttgaataagggctaaatattaggtcatattattgtactaaggttaattttcttgggtataataatagaatttgttatggtataaaagaatgtcttattcttaggaaatgcattctaaagtacttagggaaaatctcatattgcctataacctcttttttacttttttttttttttttttttttttttttttgagacggagtgtcgctctgttgccaggctggagtgcagtggcgcgatcttggctcactgcaacctctgcctcccaggttcaagcgattctcctgcctcagcctccctagtagctgggactacaggcatgcaccaccacgcccagctaattttagtatttacagtagagacagggtttcaccatgctgcccaggacggtctcaatctcttaacctcgtgatccactcacctcggcctcccaaagtgctgggattacaggcatgagccaccgcgcccagccttgcctataacttcttttggaaaaaggttaacaattgctgaacctagataaagagcaaactctctttcaacattttttcaggtttgaaaatgttcaaaaacaaaagaaaaaaataggttattgttgattttgtcacacatgtaaatagtaattttgttatgtaagaaaatgttcttcttttttagaggcaactatttaagtatttaggagtaaaatatcatatattttatttgcttgaaaatactactattaaataacatattaaacaaatataccaaatgttaacaattcttaaatctaggcaaggggtatatggtgggtcattaccctattactctctccttgcatgtttgacattttattacataaaatgtgatcagatttttttaacaataaaatccttcctacttggttcaagtttccaaaatgaactgcagtagaattcctcccaaattaacattcatattatggttcaaatttctccataattgggcgaggcgcggtggcccatgcctgtaatccctgcactttgggaggccgaggcaggtgaacacctgaagtcaggagctcgagaccagcctgtctaacatggtgaaaccccatctctactaaaaatacaaaaattaccccaggcatggtggcacgcacctgtaatcccagctactcgggaggctgaggcaggagaatcgcttgaacccgggaggtggaggttgcagtgagcagagatcaccacatcactgcactccagcctgggcaacatggtgagattccatctctcaaaaaaaaacaaaaacaaaaacaaaaaaccaagttctccataaactggtattgtcttgggagacattattagctcaatggactcaaaattctttgtacataaaatcaaatagcatatttccttctatcctccagttataacaaaaattacagtaaaggacagtaagtgttctaagagaagtagtgaagtctgttctgaaactgaaagttgtttggatgttttccaaagacaagccatcatattcctgccctgctctctcagacctggcactgataacacaacagccttcaggaattcatttttcttctgaatcattctccactggggaattagccctggcatttctaattcccttgctgggcacaagcaagccctggcaccacagctttcccagagaaatccctctgtaacctgttcctctgtcagtgcactgattaagttagaaaaggtgagcccacttctctgtggctcgctgacctcaggacatgaggaactgtggatttgaatacacaaggcaacagccgtagtgcagtggatcttctagtggacccgccactggtacacattttcttgactctgaggacagaggctgaagagcactcagagcagtacctggtgccatcactcagactttgaagccatgttgcataacagataatgatgtgcgcaatggcgaatcttgtttgaaggtaagatctgccgcttactagctgtgtgactttggataagctactgtgcttctatttctcagtttctacatctatacagtggagatattgcacagtggttaagacgtctggaatcagattgtgttccaatagtagctcctacactttctacttaaattaacttgggcaaattacttaatctcttggtgcctccattttctaccaatatctatgacacacaaagaccttagaacaaaacctggcagatagaaaactatcaataaatattagctaccattatgattaggacacaatgatctactccataaagttaccctgaaattaaagttaataaagcatgcaaagctcttaacatggtgcctagaacacataattgtttaataaatgttagctattgtgatttggcttcacaataactgttaggtaaacagtgccaatattagtattttattgataaggaagccaaggatcaaaaagactcagtgactttccctctgtcgtatgctgacaacaatgactttactattccatgctcatactcttcctaaaattctctatgccttaaggatccactataaagaacagagagaaactaaaataggccaggagcctgtaatcccagcactttggaatgccaagatgggtgatagattgagcctagaggttcgagaccagcctgggcaacatggtgaaaccccagctctacaaaaaaaaaaaaaaagaagaagaagaagaagaaggaaaaaaaaaagaaaaaaagaaaaattatctatctaggcgtggcagcgcacacctgaagtcccagtgcctcgagaggctggggtggaaggatcacctgagctcaagggagggtgaggctgctgtgagctgtgtgagagtgagatcctgtctcaaaaaaaaataaaataaagtaaaaaagataaactaaaatagcatttgaagatagactcattaacatcagcataagcattctgaagctaagtttaaaatataaactagtaaatgatgagactgggaaagatgcttggaagaaaagcaaggagtccaaccttggacacaagtgcactttacttcgtgccactgaaagtgtaggccgaatcctttttttgtttggtttgcttgaatcacattttaaatgcacaagagaggtcaccctttgaaaattaattctgtgcaaatctttttggaatgattattttttaaaagaaataagctccacccttttataaatgggattgtagttaaagattttctgtatctgcttcactcaaaacaagcagcatctgtactcaagtgcatgcctgcaggtgagtgttgttggttaagctcaggtgaacagtgaaggtccctgaatatgtgacagggcctaacacaggtgttggtgtttgacctacaatgtaccagaaaagccgtaaaggcaaaccccccaatagatccttcacattacctgtctcctagcagcatgtcaaaaatcagtgcaaacgtaacagaagaatgccaaagtcaagaatacaactgagaacatcttgaagctacgaattagtacttgccaccatccagctgttggttgcctatagattatcaagaattttacttgtatcattatctcatttaatactcacaataatcctggaaaaattattatccccatcttataaatgaggaaactgaggctcaaaagtttaaaagacttgcctgaagctacatagctcataagtaaaagagtaggaatttggacccaagtctgactggcactcaagccaagcactcttgaaattttctttaatcttctttctagtgtctcctagtgtctcccaaattgcttggattacaggcgtgagccactgtgcctggctggtttctgtcttttttctaatgcatgttttttccatggctgtgaccatattgtggaaaatgctgtattccatttttttttcatttaacatcataacaatattcaaatgccgttaaaaactttcatcaacatcataatttaattaacaattccttactgttagatatttatatttttctttattcattacaaataatgcttcaacaaacatccataagcataagcttttctcaatgttttgagttatttctttaggctagagccccagaatcagtaccactgggtcaaagagcatgaatgttttatcatttgcttattttttttagagtgaaaaaagtacggccttattacttgtaagtcattatatatggatttttaaattattatttgtacataagaacaattttaatgatatttgcactatcaaattatctttaattggccaaccaatttttatgacacactgacatgtttggattatatcagtccataaggtaaagattccaaaatggcaatgaccaaggtctaccataggcaccttggttagaaagtatcactctgcatagtactgacttgtagatgaatagctggatattggaaggaagatttgattcatgaaggttaatgggctggggaaagcaatgggtccaattagcaaatggattgttcttggaccttctgctagtctcaaaaggataagcttatggttcccatggcccatggcagaaaacacagaacaaataaccaggttaaacactgaagttcaaaagttggccagtaatggttgtcaagggctgtgtccaggaaatcccgccagacaggcactgtttgcaaatggctgggaaatatggtctgttgccatcaaaaacagatgaaaagcaggatttggttaaaagagtaagtctttgcgcaagcaaaacctttccaaaataaagaaacagtgtatagctgttgccaactgaccttgactgaaaagaggggccagtcctgtaccaatgctcattataaccagtctcaaactacttaaatggtgttgagtggaaataagacttaatcaagtgaagaacctgccagctttgacagtggtaatatcccaaactaaaatcctcaagagtatcattaaatcaaaaattttttaaacttaaaagtaaaatacaccaaggcaataatatctactttagtattaagagaaactacaataatatgaaggaggatccattaagttacatgttcaaaaacatcaaaattccaagagtttgagacatctttaaatagcgacaaggtatataatgggcccttcatcttcacctgtttcacatcctgggattcaaccaacattggcctgaaaatattcaaaataaataatgatagtacaacaatttgtaaaaatgaatacaaataaaaaacaatacaatgatacagtataacaactatttacattgcatttacattttatcaggtattataagtaaatctagagatgatttaaagtataagagaggatgtgtataggctttatgcaaatatgatgacattgtctataaaggacttgagcgtcgtcaaatttttgtatcttccagggtcctggaaccaatcctttccggacaccaagggacaactgtatatcacacagtgtaatcaaatggggcaagggcctattaataataatctcttcaagtaatgccattattaagaatcagtagcagtagctttaattaagattctacctgtaacacagtccccgatgggaatataattgagttaatatatgtaaagtgcctggtacatagcaaacactatgaagtattagttaagctaataaagtcacagggccaaaagggaaaagaggagcctgacagcttcctcaccctgattcttctctgtccctccaagcacctcaagctgggacctcagtcctctgtccttgacactcactccactcacctgaaggggaagaataaaataaaattgataataagcattagttgtacctcatgggcctggcaccttcctttatacattagtggaaataaagcaccttcctcaaggcaatagccaccctggggtacccatttgatacattaaatgaaatccaaataaagtctttccatgagtcataaaatttcctatttaaaattcacattatcaactgcttgaccaatagaatatggtaaatatgatgtaccagtttccggcaccaactcatggctcctactttctgtttcatggaatgctcactcttggaacccagccaccatgccataaggaagctcatgcattttgtagagagacccacttggaaagaaaatgttgcctggctgacagtcaacaccaacttgctagtcatgtgggtgagcccccttgaaaattaatcccttgtcccccagtcaagccactccaaatgacactgcatgaaacagagagaagctgtccctgtcaagcaagctctgtttaaatttgtgaccaaaattaatgactattttaaccaccctcccaagtacattatcttagcaaaacatagacctatgctcaggctctaattattcaacatttccaaattcaaaaatgtatcaatttcaagaggtagatgcatattttataattttttatagtttttctttctttttgagacagagtctcactctgttgcccaggctggagtgcaatggagccatctcagctcactgcaacctctgcctcccaggttcaagcaatactagtgcttcagcctcctgagtatctgggaccacaggtgacacaggtgagcccccatacctggctaattattgtatttttagtaaagagggggcttcactgtgttggccaggctggtctggaactcctaacctcaagtgatccacctgcctcagcctcccaaaatgctgggattataggcatgaggcaccacacccagccaagtggatgcatatttcaaacaaagcacccaaaaatgcccaggcatgaccatttctccttttcttgaaactacaaggtcaatccccttgggaacttcctaatacttctctaaaaaccaacctaaaaaacccaaaactaatacatcctccaattcttcaacatgtaaagtccttgtaaacaaagctacaatgacccagaatatgaaaaaaattattttttttttttactttttaaaatattatataattctattctttggctaccttttaaggatcctccggtctacttgagaaataaaacgtgcaggtttaaaacacccaaccgacaatgctaaaggcagtacagcaagtaagcaagccatgtaatcatatggtacagagggagtggctgcctcagaacggaagaaattcaacttgagcaaaatgtgagagatgggtacattatgcttgaagttacatttacccacagagattttgccacactagtggttgtggaaagtcttatttctatcagattttaaactccttttgagcctggactacatctaattttcacatttaccattaacaaccacaaaccaggtcctactagaaaaactaccaatatgcatttgcagacactcaaataatgctgggggaaaatgaggaaacaataaattttcccccacaggagaaaaatgtatctacgtagggctaagaggaaatgttaagaaaaccaaaggcaaagttcaggtagaattttccgtctgcagagtcatgatataagaggatattttaatatcctttatattcttgaatgagcattcacatgtatttttgctagcaactattttggaatgagctgatgatttggattaaagaataagcaaagctatgtgaacaaaggcaacccaagatgggaaggcgttattggcagcagcgttcttttcactctggaccctgagcaaccctgaaattccagcagtcacagggtcctaaatacttggggacattccgactcagtctcacagactgaaaggtagagagcacagatctcaacaggaactgaaactctagtgttgatcattgccctgacacaactttaaagtggccaccaaacccctcaaatagctattttcatccttgtttacactggccacactgacactcaattggtgagaaaaggcttcccccccaacttttttttgagacggagtctcactctgttgcccagactggagtgcagtggcacgatctcggctcactgcaacctctgctgtccagtttcaagagattctcctgcctcagcctcccgagttgctgggattacagcatcaccacacccagctaatttttgtatttacagtagagacggggtttcaccatgttggccaggctggtctcgaactcctgacctcaagtgatccgcttgcctgggcctcccaaagtgctgagatgataggcatgagccactgtgcccggccagaaaagcctaattttaaagccaaagataaataaataaataaataaataaataaccaggcttctttctactctaggtttcaactgtagaaatctatttgcaaacttcaaaaactattaactttgggcaagaatttttaagatctgataagaggagactctaaagttaataatgtcttgctttgaggaacaagggtctccacccaccctgggctcataaactgcccccctcactaccactctctggcttcccaccaagtcctcaagaaatgatttactaagttcaatcaaggaaccagattctatgaaataataaaaggaaaatggagttcatgactgaaatcaagctgggcagagacataaagggtctttgttaataactgtacaagggaatgcaaatgaagacaggcttcacaaggaattttgacatcttaatgaagatttatgaagaatttgcagcatattaacctcaaatacaaggggaattacatagtcacataaaaacactgctttatgatttctttagcttaaaaacaattcaaaagacagtttcttcatgataatgctaataatttagttacaaaggttccccaccccccccttgtactccactctaattacattctccatcccccattacatttctttctttggttaactctgaagtgatacagctcattggcatgccctaaagctgtgaactgccccactgatgaaatcatgacagtgattaaatttctctattccacacagaaagttttgtgttacacagttttctttgttcatgtccttagtaacgcagaaaatcaactgacattttctcctaataatgaggggaatataagataatgtcaatgaaaaaaaaatcctctactggtgctacataagcggcataccaaaaaaaaaaaaaaaaaaaagcatgtgaagctgtacagatctcagtcaagaacacattggccacatctaaggtcagtgatagtattttgccacggtcatagattttatgttgtattcatgatacatacagataattagaaagactgagttcattaaatatattcaaaacacagaaactttttaaactccataaatagtagtaatactataagtagtagtacatgaaaaatagtttcatattacataatatgcaaagcatttttgcttttgattctcttaatatttatttcatgctccaaccctgtaagataagtattatcccaactttataggctaaggacctgagacctagaagttaaataactggcttaaaatcacactgccaacactgccagacaatggctgaggcctcattccctgtgacagggccaccccctcacagctcactgcatgcacaccccaccacatcccgggaaggagcttgcacaggactttaagggcacatgacttggcttccatctctactcatcatccagagatgctccttagctaaaagagaagttaatctcaggaaatcaatgctagcagggccaggttttactcttagggttctatctcaaattttagctacaatttagaaaatgcaggaagtgaaggaaggaggtcaaagaaagagccctgggacttccaggagggccaggtgctccttgtgtcacagttgctgctacaagggctgccttaatccctagtcccctagcccagccccattcctcccagcccacatgctgaccagctgctcagtgtttctctgtagggtatgtgaggggcagatgcaggccagcccaaggctgctggccttccgtgtgctgcccttcctgctgaagcggtactggcccttcttcacaccctcccagtctgctcagatcagacacactggcaggccagaaggcaggtgggaggacaggtgccaggaaaaaccaggcatagagaaaggcccacacagaagctgaagccatacgttctgcattcttacccatggagcaaaggagggaaatgtcaatggaaggcttgaggtgctgaggttcatggtcaccttatcccttggatttcagggtagtgagattcatggataggcttccaagcctgtgcactgaaggagggaagggtcactaattgagaaaacaagtaatttagacagaaggagcagcactaaaggtccagaggccggagacagcacaatacacaggagaaactgtaagatcatcaatatggttggagagtggagacctggtcacagggcctctcataagctaaggcatttgaactttatcctaaatgccaaacgaggagcttcaaagcacatgcataattaagacatctgtctttttagaaaatcactttggccacagcatgagagtggatcagaggagagtaagaccagctaccaggtaggagaccagttagaagactattgcaggagcacaagcaaaggatgacctttctagtgtagtgacctacactagaaaacatagacaagggagcaggttatggaggaaatgtatgaggcgggactgagagaacttggaggactggatgtgataggtgaggaagaaataatgggtgaggcagtaatttgagcaatgtggttactgagttccataacaacggagaaggagcaagttcgagagtgagataatgaatttgctttggacatgttgcctttgaggtgactgtggcgcatgcaagtagacgtgtttaatgggcaaaagaatagggtatccagcactcaaaagaaagatttgtgctagagatttagactagggacttatcaccatacagttgctgaaacattttctctagttactaaaatgtggtcccgagttacagactccctcaagccccagccaccccatgaagctgctttcttaccactagttaacattctgaagtcctctcctgaatctaatatcctgtccaataccactgagatactggagaaacaagagaacacagctataaagacaaacaggtactgtcacaggtggcatactgctatggtgtgaatgtctgtgtccccaccaaattcatatgttgaaatataacctcccaacatggggcctttggaaggtagttagatcatgggggcagagcccacatggaatgggattaaggccctcatgaaagaggccagagagagcttgtttatcccttctaccatatgatgactcgggtagaaggcatgatctatgaggaataggccctcataagacaccacatctgctggtgtcttgatcttgtacttcctagctaccagaactgtgagaaataaatgtttgttgtttcctgagccacctagtttatggtatttttgttatagtagcctggacagactgagaaacatactaattatttcatgcatatgtattttcctgtcccattccgctttaagcgtttcaggtcaaaaatgtgtctgctatatgccctgggtttctctaaggcagtcttggtttcaaacattctggccctatgcattcttttatcattaaaatttctaagaaatcccagcatttcctcaaatagtaactgaccaaatctagtcagtaaacattataatatataggtcatgaaacactgaggtctacaaaagatacacaaaactatggggtgaggaaacatcagtatttctcactaaattacacgaataatagcttatattgatatagcttcttttgtgaggggtgggtaaaataccacttataggctcattcaaaccaagtgctgagaatagagtgatgggcaatacacactccgccttcatccagcttcttgtcagataatgacataaacaattacagttgctcagaagaagtaaggatgctaacaggggaaacttcagtccacataaaactcagggaaagcttccataaagagaagacctttcaagttgagacttaccaggaattaactagatgataaaggcagagaaggaagagattccaaagggcggcaaatgtgtgtgtgaaagacctgaagtcagatttaactttattcaaaaagaactgcgaggcatccactctgactagaagcagagcaaagccggggtggcctggaggggagtgatacacagtgaatgctttcgctattgttggactattggttacggttataatactactattacaatggtatttttttatttgtaaagcccaaaaatgccaccctcataaaagcagacaaaactcatgatatcaaggcaaagccatgacgcagttttaacagatattactattttcagttgcttttactttttgaaatattcatcttttttagtattcattgaataaatgcatgtgaaatctttttttatgaggagaaatgtgtaacataaatataaatccactaatgctgcttagaagactgataacacgggttaacttcagtgacctttgagaatttgacatagttcttttctttttttgagacagagtttcactctgttgcccaggttggagtgcagtagcgtgatattggctcactgcaacctccacctcctggattcacgccattctcctgcctcagcctcctgagtagctgggactacaggcacacgccgcaatgcccgggtaaatttttgtatttttagtagagacagggtttcaccatgttagccaggatggtctcgatctcctcacctcgtgatccgcccgcctcggcctcccaaagtgctgggattacaggtgtgagccactgcacccagccttgacgtagtgattttctaaagaacttactgaattgatcttccctaaagttttaaattgattgaagtactttccaaattaactaatataactaaaacgatagaattcattctttgtcagtgaggaatcagagttctcttcaatgattaacaactttaggcgactgcaaaagtcaacaaagacctgtgtgactgtaaaatttcctctggtaattcaaaaacattactcagagatttcccaagagataactgaaacaaaaaaagaaaaataagtaatgaataagtacacctcctctgaaaagtacgaataaaaccatctacctagcatcttcaacaggagattccattagaatgcaagtttcgtgagggcaaatagtttagtcttcaaggcctaagccagtgccttgaagtacatggtaggtactcaagaactatttgttacatgaatgaataaataaatgaataactaaagtaactgcaaaaatcaatatctgatattgttgaattctgagtataattattcatatacatttattatttttaataaaaatagtgtaaatgcctaattgcccattatattgtttttataacttcaagaaagactgcacaaaatagaaaaaaaatttatttagaatactaatatgtacatttttgtattgtaactaccctaccatctgtttcacacacatgcacacacacaaatgtgcacacacacacaaccaccatcaccagagcctgcacagttagcacatattagtttctcaacaaatatctaaatttttttttttttttgagatggagtcttgctctgtcacccaggatggagtgcagtggcatgatcttggctcactgcaacctccatctcctgggttcaagccattttcctgcctcagcctcccaagtagctaggactacaggcatgtgccaccacgcctggctaatttttttgtatttttagtagagatgggggtttcaccatactggccaggctggtttcgaactcctgacctcaagtggtccgcctgccttggcctcccaaagtgctaggattacaggtgtgagtcaccacgccaggcctaaataattttttaaaaggtaaattgcaataattatcagaagaagaaccaaaacacaagtgataaagggtctaaaacgttaagatcagtcaagtggctcacgcgctataatctcagcactttgggaggccaaagcaggaggactgcttgagcccaggagtttgagaccagcctgggcaacatggcaaaaccctgtctttacaaaagaaaaaaaatagaaataatacaaaaattagtgagctgtggtggcatgtgcctgtagtcccagccactcaggaggctgaggtgggaagattgctggagccttggaggtagaggtagcagtgagccctgatcacaccattgccctcctgcctgggtagcaaagtgagaccttgtctcaaaaaaaacctaattaattaattaaaataaaatgttaagctctacacgaagccctagaagtcatctagtccaacttcatcatgtaccagatgggcagccaaggtccaaagtgccattcagctttacactaacagggcagggacaagaacactggactcctcaaagccatccaactccaccaggaaattttcttcacaagtttgggttagctaatcataatcggattacctactaaaaggtacagaatgtgtaatgtgttatccactacacctccccacctaagaaattattgcgctagttcaccaggatagggtcagcaaactatgccctgcacccaaatcctacccactacctgtttttgtacaacagggaatctaagaatggtttttacatttttaaataattgtaacaaattaaaataatactattttgtgacatatgaaaattcaaatttttgtgtccataaatacagttgtattggaacacagctactctcatttgtttctaaaactgtctatggctgctctcataccacaacagcagagctgaaaatttacaacagggactttatggcccatgaagtctaaactatttacctctagccctttacagaaaatgtttctcgacctttgcactaggagatagctaatgtggctttagtaagtttcaccttcaaaagagccagggttgtccccaccaacttgcagtcactcacatgctatttcctcttctttgattactgaaactccacagcaaactattgtttttaccagtcacccagaaaacgaagataaacgtttccacagaggaaataataaccttccttttccaaggtcctcctctgcctcacgtccagtgaaattaaaagcaattcttcattcacaggggttctgtgtcattttccccaacagaattcagaggacaacattaattcacttttacaatgaagggctcaggcagaagaaaagtagctagtagtgagtttatcctaagaaaaaaaggaatgtttaacattttctggaacggaaagcatttttgttttcccttgagatgctattctttctaacatcaaatgcaaactgccattatatactatacatcttctaaaaattgaaaatcataatatccatacttaaattttcaactttccagttttccaattacaagcaaagtaccaaattcatacctgctcagtgttgcaaaatgattttaaaatgtaatgatgtttttgtttgattttgtttcatagtattttcctctaccaatgtacaaaacactcccttgtaacaaataaactaagaaaatcgcattcccagggccttgggaaataactttaagggtgtctctgttcacttacatcatgaacccagctcttatgctcctaaagttacaaatggccactcttcgttttaatagcagatttaaagaaacctaatgttagttcaacacgggtaaacagtctctcacacagtataaataaagaattctttgagttgtaaatagtagttgctcaaagaagtggaagggtggctgaggaagacagagaaaagatgccttctctcctctctttctagcagggcaggccagggaaaggaggcaggacgccagaaggctggaagagctcagccatccagaaggacagcagggttgccaacttctgaaagcagccaccattcattcactgttcactcatttgtcaaacatcaactgaacactctcctatttatacaacatccgggggactcaaaagaagaaaacagcctggacactgctgttcataagaagccttactgtccaggcacagtggctcacacctgtaatcccaacactttgggaggccaaggtgggaggatcgcttgaagtcaggagtttgagaccagcttgggcagtgaaccaagaccccatctgtacaaaaaaaaaaaattttttttaaattagctgggcatggtggttcatatgcctgtgatcccagctactcaggaggctgaggtgggaagatagattgaccccaggaattcaaggctgcagtaagctatgattgcaccactgctccagcctgggtgacagcaagacctcatctttaaaaataagaataatagtaaaagtttttaaaaactttttttttaaaaagaaggccactaacatgcaggttaaggcaaaatgtacgcagaaccaagaaagctgcgtagcaagacaatgacccatgccaggggtcagctaactacagcctgcaggccaagtctagctggcagcttgtttctgtgaataaagttttattggaatatggccacactcacttatctatgtattgtctacagatgctttcacattacaatggcacagttgagtggaagcaacagagaccatgtgtctggcaaagccaaaaaacaatctggactctttcagaaagtttgcctatccctgacataggccagagagggatcaatccaactggagtaatcagagaagactatatgaaagaactgacatttgatctaagttttgattactcaacgtttcaaaaggcagaaatgggaaaatcatattgtgaggggcagaatggccaaggcgagatgagtctgagcaatgaaaggactgaatttgaatggggtacaggatatgaggtggggagttgtggcaaagtggctaatgatacctacccagactacatggtttaacagttaataacatagctccagagtgtttgctagcttactggaaatgtcattccccttttctctagcttccttcacatttatggctaattccatagctcacaaatatgtttgttcactgattgattactgtgatcaatcaaaagtttgcatgtcagtttaatttcaaaaacacttctatttacattattgcctagacttacatttaatcctcaatcacatcagacattactattcctacttgacaaatgataaaaactgggcaactcacctcatgtcccatatggcgtcaggggcaagagactggcttagaaccctggattctccaacccatctcatgacccaccttaggaagacactcatattggaaaggttaccacctggactgtattctagaccagaaattctgataatcaaacaccaaataatcaaacaggaatgcttttttggggcatatccttgctatacctgaactgtggcctgatagtagctcaaaatccacatcaaagaccaagttcgaggtacattcattttatacttaatgaaatctggtcaattcacataattttgttacaatgggcattgggtaaacgttctcacagattaacttaatccattataggaggggaaaagaaaaaaaaaaaaactccacctaccagtatatactttggcagttggatcatcattattttgcactggaaacctagaacccttaagagaaaggtatcatttgtaattaattttcctgtcctttgtacttgtaagtaaacaggtggtgttcggatgagtcccttaaaagcccctgttgcctgccaattaagtaataatattttcttttcagggaagtgccataaaagagactctaacatcttgggtcactgagtacttcctatgcaggaggatatgaggctgcaacactgaatttttccaccagcaggatattcaatgtgatgagtaaattagcaattagcatggaaaataggagttattctcagcatttgtcatatgagagatcagaattcctgcactcgtcacgtctgtataaatggtttctttaaccatgaacatcgtctcctcttaactccctccccatgtcactccactcacaatccacctacactgatacctcaaaacatctcttcctacacaatttttaatgttttattcctttacctgcttgctttacacaagcctgtctagagtcctctacaactaaattatttccatcatcgttaactttagaacacggttccaatgccagtctgaaaaccattctgaaatatccaacagctcttcttccaaagtgcaggtgggtaggctggcagcagagcagagatggctttttatactttcaggatcataaggggagagactacactctgctagtgttttgtcttccagcatccaccatctcctagcctttcccaacacccacctcttaaaacctgggcagtctcagaaggcaagaccaggaaatgtaaaggcacaggaccagacagaatcatatatgaaagcctaacacagcttaggggactggcctaggaactatggccaattatcctctctcttggcctaatgagattatgtcatgaagatgagtaccactccctaccatcagtaatgagaatgcagaggcaagacccagggaccaaggaaagggttaaagacaagcagcaagatgaagggtaaaagcttgctggttcagaaacattatctatctgcccctgacatactcatctcaatacagccaatctccactcccggcatctcttctttgatttactaacttatattcttttgttacttttttatttttatttttggcagggtctcactctgttgcccagggtggagtgcactggcacaatcttggctcactgcagcctcgaccctccctgagttcaagtgatcctcccacctcagcctcccaaatagttgaaactacaggcacataccaccatacccagctaattttttaattttttgtagaaatgaggtctcactgttgcccaggctggtctcgaaatcttggactcaagcgacctgcctgcctccacctttcaaagtgctggtattagtggtgtgagccactacacccagctgggcttttgttatttttcaacaatcaaataatccatgttcatggtgaaagaaaatccacactcacggtgaaaaaaaaaattgtaaaatgcagataaacaaaaatgagagagagagaaagatgaatggaaaaaagaaagaagagaaaatacataacttccctatccattactaacacttcagtactggcttccaaatgtgttcttgcttaaatgtcttttgaggggtcttgcttgaactgctttcaaacatcagattttacttatatttcatctgggaaaatcagttcctctgagagctattactgacacacagtcatgtgcagcatgacttttgggtcaacaacagatggtacattcaacagtgggcccataagatcatgatggagctaaataactcctactgcctggcaacatcgtagctgtggaaatgtcgtggcacaacacattacctttctctatgtttagatacacaaatacttaccattgtatttgtaccactgtaccattgaatacctacagtattcagtacagtaacatactgtacagtttttgtagcttaggagcaataggctatgcatatagcctatatgtgtagtagactatactttctatgatgttcacaaaatgatgaaaacatctaatgatgcccttctcagaacatacccacatcaagcagtactgactgtacttttcaaaggcaatagcactgatgaataagaatttcttttcatgtagtgtaatataaatgtttgattctacatcttcctccaaaatcattaaggctcttttgacctaagaagtctcttacaaacaatatgaacatctttcaaaaggagacatcagaacgatagcttagggtgagcatggtggctcacgcctgtaatcccagtactttgggaagccgaggtgagtggatcacttgaggtcaggagttcgagaccagcctggccaacatggtgaaaccctgtctctactaataatacaaaaattagccgggtatggtggcatgcacctgtagtcccagctactcgggaggctgaggcaggagaatcacttgaaccagggaggtggagtttacagtgagctgagatggcgccattgtactccagcctgggagacaagagcaaaactctgtctcaaaaaaaaaaagatagcttaggtgatggttacaggggggtacattatactagtctactagtattgaggtatgttttaaatcttccattagaaaaaagtgttttgcatatgcacctaagtgctaatctatgtgcagaccagcatgtggcatgctccttaaatgaaataaacaatactgaactttcaaaatgccactcttaaagatttgcagacatgtcctaatttggttgcagaaatacctataattcagctctgaaaattgcattcaaaacactggtttcaaccatttttttataaggatttcttctttggtcactgatttatcagactcttaaaaactctctatacacaaaattatatgctctccagaatttgctttaaaataatttaggtagcagttaaccattacaaatttaaaacatttctaaaagaggaaggggatcaatgaataagaatggcagaatgtggacgattgctgaagtggagggatggtaggtacgtgggaaattatcatactgttctcttatggatatttgaatatttccataatacaaagttttaaaaaaatcattgtgaatatatattgctccaattacgaatcagtatttcgtacccagtgcacaaataattaagctctattggaatggctacttactacgtgcccagcactatttctagcacttgatactcatcaattccttgagacatgcctgttcagttggtattattggtctcatttgatatctgaggaaacagatcgaaagaaacaacccacttggccaaggactcaaggcaagtgagatggaggaggggtagcggccacaccacagaggtgtctgctacatatattgtttggtccctttataaatattattgtacgtgagcatgtctgtttcattgtcacttgcagtattttagtgcatcctgtttttctagaaaaatgaatcagcctctctctgtttatccaagataacaaaacaaaaaaatggcctgagaacaatattggtctgatggaggccatcctgactgaaagaggaaacgtccctgagtcaatatcctcagtgagagacatcccttcataaaacaaaccaggaatattccaacaaggttcaaataagcataaacatccacagagttcagtggaagctacactgcactcagccaccggcattttttactgcctgtgggcttttcctgtctcatcgcagactcaattctcaaattctgttccctcaaatgtctcaggctttaaagcttccataagatctcatttttccccttaattgagaatgtccgcttcccaccctttctttctgcctatgaaaatttgaccctatctttaaaaattcagttcagggaacacccttctctgtaatcccatgtaatgaaatcccctggctagaactacgtatttcttcctctgtactttcctaataaaatggctgtcctctctctctctctctttttttttttttccgaggtggagtttcactcttgttgcccaggctggagtgcaatggcatgatctcggctcaccgcaacctctgcctcccaggttcaagcaattctcctgcctcagcctcctgagtagctgggattacagggacgtgccaccacacctggctaattttgtatttttagtagagacaaggtttctccatgttggtcaggctggtctccaactcccaacctcaggtgatctgcccgcctcagcctcccaaagtgctgggattacaggcatgagccattgcacctggcctgctgtcctctcttttaataaatttctttcattctgccaggtattatgagaagtcattttcagatttctttctaaaactgaacctaagttatttaggacaaaggccatgtacttattcattactacatcccgcagtcccagcacaaactagaagcttaaagtggaagaaaaagtaagaaggagggagggagggagtaaatgttgctttatgtgcataggccagagagtctaataagggggttagtttctaaagtcaccaagaaaatgcgaaactaatgtagaaaaaaaatgtccctgaaaatctcctaactgcatattaagtttatgtgccatttttagacatgctatctcttaattaaaaccagcacacccagttttacctcccgctttggaacagatagctgagaagatagctggtttccatttaggagccaccttgtgccatgacaaggtggtcacaatttgagggtctcctggggaccatgatgagcagaaggaaaaacgaactttcatctcatctcactctcactccagggcaattggattggagcagtgtgcaatccgtcttctctttccttctgtccccatctctctccaggcttatgtagtagcatgtggataagtcaatgcacacacagtgtgtgtgctttgctgtgcttcttcaagttcaaaaccactagaggcttatggctttccacggattagccacttttcattatttctaactggcctcattctaacaaaggatttggaaccttttaaaattccataaatcaggccaggcgcagtggctcatgcctataatcccagcactttgggatgccaaggcagggggattacctgaggtcacaagttcgagaccagtctggccaacatggtgaaatcctgtcttcactaaaaatatgaaaattagctgggcatggtggtacatgcctgtagtcccagctacttgggaggctgaggcaggagaatcacttgaacccgggaggtggaggttaacagtgagcagggattgcatcactgcaccccagcctgggaaacagagcaaaactctgtctcaaaataaagtaaaataaaataaagttccataaatcataccaatattcagagtccaatattattcatggactctgaaaaatccctcctatggatacaaaaataaaatgcagaatattccaccattggctaaaagaaaacaacgttattatagtacatgcacatagaaaaatctggaaggatgtataccaaagcaaacagtagatatacaaatgatagactatgggagatttttcccccttaattaacaaagaactataattacttttgaaataacttttaagggttactttttaaaggctactgtcaatttcttagggatggactgaaacaagagattccaaagataaagcctgtgctctttgcaggcatgtcctctcagaagagcgtctgagaataagacattcgaaggactgaagaacagtacgaaggactccttgagccaacaagctgcctgcccaggctggctacaagcctgggtctacaatgtcttgcagccaacagatacatccgggcatgctggtggggtcagcagacactgaggcgctggtaccaagcttgaggtaaggagaacaacatctctcgagcatccatctgtgctggtcttggtgccagcgatacaacatgtatttatctctaatcctgacaacaccacccaaggcaggcaagaggctagagagcttacccaatgtcacacagccagcgtttgaagctcagtaagccaagctccagaaactgtttaacaatctaatagctatgaaaaagatgtggtccccacatatctaaagcttacagacaaatgcagaaaaagagagagagaaagatgtaatgtcagatgtgaaaaaatatcatcgaagaataagtacaggggttttgaggagtatataggagaaaaaccttaaaataggcagagtcgagacttgaacacagctctatttagacataaagtctctgtgccttgcattatactaggctgcctctccacgctgtaggagcctggaaaggtaaaggaagctccaactgagagggcagtgacacgacaagtacaatcctgtcccctcttctcctcccccctccccaccacctcctgggcttctgaaagaatcagtgcaagagccaacatctccttcaacccattgacgtctgtgagatacccagagacgttcaacccagagatatccaggctgcttgccaaacaaggaaatccaagataaacgtgccattctgtcatgaccttatcctgctgagagacagacagaaacaatggcagagaggaatagccttgcatgttttcatggcacctttcagaaagagatgaaattcaccatcagtcacacctcttggaggttgtaccatttagctgataagaaacagccagagaggcagggagtatggacactcctgaaggcaatcctatgaggagccccctgaaacttcttgaagaagaaaaatagcactgttcccctccccttccaactcttcacgctgacaggagtttctacgaggcagtgtttgtcagtagtattattaaaaaaggaaccaggccagattagtgactcacacctgtaatcacaacactttgagacgccaaggtgagaggattgcttgaggccaggagttcaagaccagcctgggcaacatagtgaaatcctatctctaccaaaagaatttaaaaattagccaggcatagtggcatgctcctgcagtcccagctactcaggaggctgaggcgggagtatcacttgagcctaggagttccaggttacagtaagctatgatcacaccactgtattccagcctgggtgacagagtaagatcctgtcaccaaaaacaaacaaacaaacaggtatatagcactggttgatgatttcttcaatctccacactctgtttatttttattagagcacaacaaaggtaattttgttcaagcctactactttaggtttaggcttgaactgactgccaagggacacagtttacctttcttgcccaaaaatgtggtggccccagtaatattgccttcttgggttgctggttaatcctcgcacaggctgaaactggagatcatattatatcaatggtctcgttctctcaggatctcacagatcgatttctaaattttgttttccaaattggtggtccattagaagcacccaggattccatcattacaccttcctttagtcacccaatttgggacttagctccatttaacatctacacgctttgatgtattttggtcctgggctccatcttatagcactcttatagaaaaacgctttcttaaatcctagaaacagctttgttgggtaggtgttttcgtatcatctcagtttagagatgttgcaaaacccaaacattctgactacagaatccatattcttaaccactacaccagattgcctcctccaaagagggtttcagacaactcagtttctttattttttagataaagaacccataaagggaagcgtggcacacagagcataaacagaggtcatggacaccccaacctccatgatatgagacctgaggatctaactggatctttttggaacctctttggtcagccattaaattgaggcaaccacagaattcatcttctaagatgacagtaggtgtgaccacagagcttagctggattgacaagtcttgatgaaggagagaatttgtgggcagtgccttcaaacttagttccaagtgccttaaggaagatcctctggggagctggatctcatatgttcttctgcacccctcctccaccgctcccccccacacacacacactcatcttctttgtaaaagacttctttaaaacaacatagagtatcttatctactccacatgacagaggatgtttttatagcagccaacacaaatgcctagatcatttttatctaggtcctatttatctatctaggtcctcaagttccagctcacatcccatctgtctggaaactaacagcatttccattgcaaaaagttacaattgcatctgccccacatgggggaataaaccacacctctaggatgcagagctaggagaccacacacatcagcctttacacaagaatctcaagcttttcaactgtagtgtcctatgactattctcttttctcagaatgacacaagtggagagaatgcaaacaaactaccagaaatctggagcatcataaaagaatccatgtcacccttgataggaacaattctgtattggaattaattttgctgaatgaaccacaggttcctgaaaacaaatgtgctgccgttcttactttagggtcctgaaaatgtcacagaataacatgctttttctacctcagcttttgctttgcttaaactgttttgaagtatactaaatatggcatttaaaagggcaaaaaatatgaacccaacagtttttaggcctcccttataaagaaacagtccttgtttttaaacttttcaagtttcttaaatttgcttctttgctgtctgcttttaaaaattccagacagtaattctaatcacagaagtctttgtgaaactacatttctgtaattttttttttaactcaagtaatgttattggaaggaagcagaaaaccacagtgcccaaacagaagtgactaatgctagcagcaagtgctgtaataaataaggccccgagagcaagagaccgctgcaccacagtagcttgttgtatattcccatggtcaggactatttggagaccagcaaccagattttccagagctcttgatgtgttaatcaaggtaaccaggtgcaactcctttcactagcaatcttttgctaaagatgatagaaagaaaaaatacaggaagagcaaaaatctaaagagaggaagaagtccaaataaaacattcactcagaagacagaaatcatactaatatggtctatgcccagttatattacagatcagtttttaaataactacatatgttttaatgtctgatgtaatgcattacaggtgttctcaaagttgtacatggacgatggaccagtgacctaacattaaactttgaatttctctactactgtttcaacatgttgttggcacaatttccgaattagttacgtggtttttctttgccaccataaggatgtctgctctgggacccaaagagtcaaaatgccttaatcaatcattgaactttccttatctttatttcaactctcactcactcacctttatctaaaaaatattttggtagagattatgaatccatatcccacaccctcctcctgcacaacctatctgcttctgctcactgcatgccccccagtcttatgacatgattggtaataactatttttttattatgataaatttgatcacctcaaaatcagcaagaggcttgttttaacccagacttatgagttgtttctctgacaatgacatttcaggtataaccttaaagcaaatttgggatgttgttattattctcccaggtgcaatgatcttttctatcaagttgttgttatttgaaagatacactttgttttcaaaaaccatgaaaatatgaatgaccaattgtcaaagtaatttattagagacattaaatttataccaataatataatacaaataacatataacaatgataattatctttttgtacttacaaccaaaccatattttcccagaaagaaagaaaggaaggaaggaaggaaggaaggaaggaaggaaggaaggaaggaaggaaggaagaaagaaagaaagaaagaaagaaagaaagaaagaaagaaaaagaaagcaagcaagtgagcgtgcgtccaggcgcagtggctcacgcctgtaatcccaacattttgagaggctgagctgggcagatctcttgagctcaggagttcaagaccagcctggacaacatggcgaaaaccaaaaccaaaccaaaccaaaaccaaaaccaaaccaaaactatctccaccaaaaatacagaaaatcagccaggcacagtggtgcatgcctgtagtcccagctactcgggaggctgagggagaaggatcacttgagcccgagaggcagaggctgcagtaagctcacatcacaccactgcgctccagtctgggtgacagagtgagaccttgtctcaaaataataataataatgtgctcgattcagtaacccactaaagtgggtctgagtttatcattattctttccttactatccccatcgaaatttatggcaataatagccttggattcagtaattccattgctaagaacaaattctaatgaagcactcaggatgcatcttaaaaatctttgagaatgtttatcagctgggcacggtggcttatgcctgtaatcccagcactttgggaggccgaggtgggtggatcacttgaggtcaagagtttgagaccagcctgaccaacatggtgaaaccctgtctctaccaaaaaaatacaaaattatttgagtgttgtggtgcacgcctgtaatcccagctactcaggaggctgaggcaggagaatcacttgaacctgggaagtggaggttgcagtgagccgagattgtgccactgcactccagcctgggcaacaagagcaaaactacatctcaaaaaaaagaatgtttatcatatggccatttaaagtgtgaaaatgggaaagaacctaaatgctcagtaagaggggctagatgaacaaagtagggtacagctataaaatggaattctgggcagtcccaaaggccatgctatgatgccattagctgtgaaaggcatcccacatcatttaagtttgcaatatatgttgtctttctttctgatgaattaatccattttttgtccattgaatgacatcacttctacgaacttgcattctgacatccttatttgaataggagagaaatactttctatgggtaaatgtaaatctgtataagtggaaattatgtaattgctttcagggctaatcatccactatgtgaccgtgtagagaagatacaatcctgataagcaaactagagggctactatttatggcaaatgggaatttatatacaatgccagaacctcacagtcctttctgaagggccatgcttcatggctgcacttaattctgcatctcctcgttaccttcatgtagttttggcaatgttgtgctctcttgcatatatgcttagctctccagccaggctacagggttaaggctagggtccctatctcccatgtggcttgcatcactctctgtggagaaagtatgtggttatcgtctgcccagaatcacttcccttcgtccggccacatccctccccaccactaccatgaccacttccattgaggaactaaatctttctccattctaactctgtgattcctgaatgatgaacaatccagtacccttctctgctgagctcacaggaggtcaaatgaacagatactggcatacattgaagtgggcgggtgagggcgggtagagggaagccctcttgtccctttagaggctgctcgtttgggatgtggatgcccaaccttcctgaggccatattcctgccaatggagaaggcaatatggccaagaggcagagagatgagaagtctaaatgatactaatgaagtccctggatctggagccaaccttggcctcacttggttcatgcaccagctagtgtgagctagacctctgtcatcttcagctggaacagtcctgactagtccaccctccatcacacaagccagagacaggaatctatattctgtgctgcattcatggccaaacagcccagtctctgttcttcaagctgtccaggctggctaccaccttggagatgggagccacacttgggactatataagatcaagtttgctgcatccttctaaaataacattgcttctgctaaggggaatgaactgatacgtactgtttcttaataaacttagaaaaagaaatcataatcatttttaacctttttttttagatggagtttgactctgtcacccaggctggagtgcagtggcgtgacctcggctcaccacaatctccacctcccaggttcaagcaattctcctgcctcagcctcccaagtagctggcattacaggcatgtgccaccatgcccagctaattcattttatttattttattttatttatttatttttttatttttagtagaggtggggtttcaccatgttggccaggctggtctcaaactcctgacctcaagtgatccacacacctcagcctcccaaagcgctgggattatatgtgtgagccaccatgcccgtaccattcttaatctttacagaaagtcctttttcaggaaaagttggttgttagtgaaatagacaactctacccttttttttttttttttttttggtttttttggttttttttgtgacggagtctcgctctgttgcccaggctggagtgcagtggtgcgatctcagctcactgcaagctctgcctcccgggttcatgccattctcctgcctcagcctcccaagtagctgggactataggcgcccaccacgcccggctaattttttgtatttttagtagagcttgggtttcatcatgttagccaggatggtctcgatctcctgacctcgtgatccacccgcctaagcctcccaaaatgctgggattacaggcttgagccactgcgcccggccaactctaccctttttcatccctgccttctgtgacagaattatagtgactcaaattttgtttttgttttaataaagcaaaaattaggggctgagcatggtatggtggctcatgcctgtaatcccagcactttggaaggccaaggtgggtgaatcatccaaggtcaggagttcaagaacagcctggctaacatggtgaaaccccatctctactaaaaatacaaaaactagctgggcatggtggcacatgcctgtaatcccagctacttggaaggctgaggcaggagaatcacttgaacccacgaggcagaggttgcagtgaactgagactgcaccactgtactccagcctgggcgacacagcgagattccaaataaaaaaaaaaaaagcggaaattagcatcacatgcaaacaattatattctcaaaaggaaacaagttgttctatgcatagcactaaaagccctgactcaaaccaaatgccacctccttaatcacctccatgcagcaccctgagtttaccatttaagtacctaccaagtccctcccttcctagacgtctgacacccagttgagctcatggattaaggtgacactcataaaccattcttagcaatgagtgtgctacaaccacatagcaatgactgcaaggtaattgtaactcatgacaaatgagttttcctgcaggcgccaggaaacaaaaacatcacagatggctttctgaatcaaatcaaggtacaagggaccaagtcttaaattgggaaaaccgtgcatttgatttcagtaggaaacaattgcaaataagttaatcccactctgtcagtcctctatattcattactggagcctaccaactaataacagagccttgagaaagagtaccaaaaacccagcatacagtaatgcaacatgcagcagcagaccacgtcctataaccatcctcggtgcctcaggatcatatttcctatgggttttcctcccttaaaatccatccagttgaaatcagtcaatatataaaaccaagctaataatatcttgtttgagctagaatttaaagagaatgtttgcattcaagtatatacatattctatagtatgtaaaaaaaaaaaaaatggccagaactgatgtgatgttcagtatagaaaaataatttttactttactaaagtaattagcattgaaaatcccaaagcaggctgagcgtttttggttagaggtaaaattctactcctttttttccatactccaagggaagataccagaggtatcttcccacgaggactacaaaagagcatcaattggaaaaccacccatattgaatgtgtaggcacatggggtgatgaaatacacacagcataaaggtgcatctaagaatagtatcaaaaacaaggtgttgcccaaccttggcacacagcgcacaggttgttgaacacctactccgtcctgaggccaccaagcagctgcttggccaatactttatttatgccctgccctctcttaattcacacaagtgtaatatcctgcccaccgtgccactccccagcacctctccaaagcaaagaaatcttaggccaggtaagctaacaaaaaacataaaatgagacatgagaagtttcttagggacctagggtcatcagatttagcaaataaaaatgcaagatgcccagctaaatatgaattccagataaataataaataatttgtttagtacaaatacgtcccatgcaatatctgggatatacttaaaactaaaaatttacctattgtttatttgaaattcaaatttaactgaatacctgtattttatccaacaacccttcttagggtaaacatattgttaaggtaaacccatgatctattccccttctctcctgaccacaatcctaatttcctttgggaaacatccaccccattttcagccatgtagggtgtcatgtggggtaatcaaccctgaatttatgctgaacaatgaaatgcaatgagcagaggaacacgaaattttgatgggaagaaactatggtatacagtcctaggagtgaggaagcctgagagaaaggaaggtatgccagctgccttaaaccagccctttcctgcaccccctggaaatgccagagaagccaggaagaaaggaataggtggtgataactgaagagtgtgtgctatggctacaggaggcccccaaatcaagctggtcaaagtttgtattaaaccaaacagagatatccatgttgtccatgaaatcacagcggggttcacctccaaaactctccagggtgggtctccttcccttctccttatatttgtagcctgagagggtcctattatttttaaagaaagttgacgctttctaaaaaattctgaagacattaaaaacttattggccgggcgcggtggctcacgcctgtaatcccagcactttgggaggccgagaaggggcagatcaccagaggtcgggagctcgcgactagcctgatcaacatggagaaaccccgtctctactaaaaaagcaaaattagccagccatggtagcacatgtctgtaatcccagctactcgggaggctgaggcagaaaaatcgcttgaacctgggaggtgggggttgcggtgagccgagatggcgccattgcgctgtagcctgggcaacaagagcgaaactccgtctcgaaaaaaaaaaaaaaagccaggcgaggtggctcacgcctgtaatcccaacactttgggaggtcgaggtgggcataccactaggtcaggcaatcgagaccatcttggctaacacggtgaaaccccgtccctattaaaaatacaaaaaattagctgggcgtggtggcgggcgcctgtagtcccagctactcgggaggctgaggcaggagaatggtgtggacccgggaggcagagcttgcggtggccgagatcacgccactgcactccagcctgggcaacagagcgagactccgtctcaaaacaaataaacaaacaaacaaaacttattaagccagtttggggcactttgtgagctgcatgctttgcaacaaggaaactcaaacaaatactgctctaggaaacagctgccactgaagtcaaattttggctcttggtattgtttattgctttgtatgacaggctaattcttgccccagcagtatctttttcggtatcgtggagcacatatatccttgtccgcaggatagactaggtgagcttttgaaggttagggaaaatggatggttaacctagctcaagtccagctctttcagactttagtaccaagaaagattctaatccaatggtacaagtctctcaagtctcacaaatgattctttttattttttttattttattttattttattttattttattttattttatttttgagacagagttgctctagcctctgttgcccaggctagatagagtacagtggcatgataacagctcactacagcctcgacctcccaggctcatgtgatcttcccacctcagcctcctgagtagctgggaccacagacacataccaccctgcctggctttaaaaaaaaaaattgtagagatgggtctccctatgctgcccaggctagtctcgaactcctgggctcaagcaatcttaccatcgtgtcctcccaaagtgatgggattaccaggcatcagccactgtgcccatctcattcttctggcagtaatctctgccaagtatttgaaggaaaggttcagagaaaaaacatttttctttaattgtgcagcatgagtttaagaggaaaaaaagttatttcccaactcctactggaaagacctcagactccctattaaaataaatactgttgtttatttaaaaagtttcactcctttctcagtcaaactaaaatatttgtctttgatcttacagaagagtccctcaggctcacaaaagtacttatattgtattttccacctattcatttaggatacttatatacccttacagagaaactcctcagagattatctaagaactaggtcagtatttcctacgctggggaatctgctaagcgaagctaaccccaaccaggacttgagtgtggcctgtaaaagactttcccgctagaccctgtggtttctccaacctcactcctatgctttgccatttcgaaatctgaggaaaatagtctctcctgttctccaaataccagtaacttgttacccaagtgaagaccaaaacaaaaccatgaagatattcttctctgtcacaacaatctttgataaaaatattgtttcaaagacaactggcactaaatgagtattaaaaatccctgtaagttttaaactgttgatgacacatattaaaggaataaaacaaaacaaaaaatcctttcatatcagccaacccatctactatggagtatctgatcatgaaagtgtataacaatatgaaaaccatatatgcaaacatatagggaaaaacttgaagggtattattactgagacagggtcatgctctgtcacccaggctggagtgcagtggagcaatcatggctcactgcaacctcgacttccatgactcaagcgatcctcccacctcagcctccccggtagctgggactacagacacacaccctgtgcctagctaactttttcattttttgtacagatgagttctcactatgttgcccagagtggtctcaaactcctgggctcaagcaatcctcgtgccccagcttcccaaagtgctgggattacaggtgtgagccaccacaccgggctaacttcaaggatattagaataataaaatcttcggtgcgtttttttcttctgtaaaaaaattccaattccctataaattgcttttgcaataagtaatattataatatttaagtgaaccataattataagagtgttagtcccaaaataactcatataaaattacagtctgtcattttgctttggcctccagctctagcaatgaataggtagggatgaagaaaaggttttctaccaaggataaaagaagaacagcaacttctctcggaccagtagccaaagacaaagatctaaactgtttccactctcctagctggccacctcatagacaggatatggctctatttgggacagataatcagaatttcttcttgcctttcctgcagaccagctcagtcccgctcagctcccgtaccttctaggcagaaatagtcttgtcacttcatgtgaggccccagtcacctgcttaagcccttttgcacttattgggcaggtaaacaagagtttgcatataaatcggggcaccttagctctaggatcaataggaagcagagtcacaatgcctaaggtaatgagaacggttaataactcagatgattaaatcctccttttccaggatcatggtgtagaccaagagtacctgcagtcacgccaggaatgacgtccattcttacctcacccatctgtttttgcacaatttgcatttagatgtagcaaactaaatttcctttactcattccttccttgtttttaagctctacttaattctgacaaggttcacaatctaatgatggaaaggacaggcttaatggacaaaaggggatgtcagcctcccagaaacaaatattcttttgttgagatctcccacacaaaatgtggtcagtatgtcagcctggaaatgttgaccttttcacagttgccattaatgggtcaagccagtgggagaaatgccaggcaagagctgtccccactcacctggggtcagaatagaggaagaggaataaagattcacataattctcacagtcaaatttctcgacctcctaccaatatcatgggggcagaagctaagtttagatgaggaaaatgacttactttccattctctcaaaagatccactattataagagtttatgtttctaaaacctccttactttaaaataatttttttaagttgttactctgggtgtagagagaggccttgcctaaaatccaaaattgtcgggttccttgattcttaatgacattagcaaaatcagttctgaaacaccactctccaagcaaagtttggatcaaattaacatttcatctctccttcagccagttactaaaaaaggcattttcagtcttcacgtacaaaccccaaatataagtgccaatggatattcaataaccataagcaagctcagaatcaccacctaccctctggcataactactttcaggtaaagcttaccaaaaaacagcaatgcatcctccttgcctatcccacaaagaatgaaattacactcccgctgtatcttctcagagagggaaaaacatttcactccctatagccattcttgtcaaatgacctgatggggtagtgactggagcacaaatccagatccaagatcaagagaggccattaacacacacgaagggagacatgaattatcccaacaaaattaagtaggtccactctgggtactgcaactagggtggtgatcctgggctccatgcttggtagggaagagctgtgaggcatgataccttaataaaattgagaactttaagcactttatttatttattcatttagagacaggatctcactctgtcacccaagctggagtacagcggctcactgcagcctcaacttcccaggctcaagtgatcctcccaccttagctcccctgagtagctgggactacaggcgcccaccactatccacagctaattttttgcatgttttgtagagacagagtctcactatgttgcccaggttggtctcaaactcctgggttcaagcgatctgcctggattcagcctcgcaaagtactgggattacgggcgtgagagtactttttaaaaaataatttttactttttaaaatttatttacttatttatttttatagccttgaggtccctctgcattggttgagttgccccaaggccacgtagtttctagcatagctctgactctaaggaaacaggcaaggtagttcccactttaccaacgaggaaacgtgcttcctgaagttatgtaagctcattatgtggcagatccatgattcaaaccagtacgtctgattacaaagctcatgagtactctctatgactgctctctgacattgatgaccaagcatccaacctgtccatccacacaacgcaaacaaagccattaagcccagatccctacctttaaagcagtagagggaaactgctgttggcaactgtagaagccactaaaggaagatcattttccactcaaaaatggatgtaattttcaaaaaggtggagacaacccaaaagtccaccaacaaatgaatggataaacaaaatgtggtatatccatacaatgcaatactattaagccataaaaaggatgaagttctgatgtatgctacaacatagaggagccttgaaaacattatgccaagtgcaataagccactcataaaagactacatatcatatgattcaatttacatacaatttccagaataaacaaagctacagagacataaagtggattagtaatttcttaagactggtgaagatgagaatgtggaggagaggggcatggctaatagctatctagttagttggggcttctctttttggtgatgaaaatgttctaaacctgactgtgatgatggttgtacatacctgaatctattaaaaactattgaattacacacttaaaatgagtgaattatgtgctgtgtaaattatatatcaatgaagctgttaaaaaataagtatggccaggcacagtggctcacgtctgtaatcccagcactttgggaggctgaggtgggaccatggcttgaggccaagagttcaaggacagcctgggcaacataggaagaccccatcgctacaaaaataaaataagccagccaggcatggtgacgcacacctgtagtcctagctacttaggaggctgaggtgggaggatctcttgagcccacgagtttgaggttatagtgagctatgattgtgccaatgcattacactctgggtgacaagtgagaacttgtctctaaaaaataaaatatatatgcaagtgtaattggttaagcaaattaaaaggaaacttggccattatctcctttaagttcttcatttaagggtgaggaaaccaagtaaaaagtccaatattaggcaagcgtcctacctactaatcccagtactcaacaatgtcctttgggacccagctcagtgctaggtataatggtagacccccaaagagtttaaacctaatcaggctttttgaagccaggaacaatgaaatccaacagcctgtagactgggttcaggggtggagcggacactaagagctgtgtagtcaggcaggaggtgagacctagaaggaaatccatggcagaatgaactgatggagggtcagggaagaggtgagtgagggtgctccagggaaggggtacaagcactgccaggagctgtgggtggcagcaaatgggttgcaagggaagtgaggctcgatgagcagggtcacactgtcagattctagaggtttaggaaccaggcaggagatcagccctgacaggacaggacaccaagaagagttctgtagcaggaaaagggtgatgagagccatcatgaaggaagattagcctggctgtggtgtgcaaaggactgaagtcagaggctagtgtgctgcagtctacaaataaatgatcacatcacacagtagggtggaggcaacaggaatggagaaagaggaaggaaagatgagaggtccagaaagggaaaaataatgaagacccaaccatgtcaagaccggtgagagggaaaaggagagccagggtggctctgggcccagactgcccaagtttaagtccttactagtgtgcggctttggtcaagttccttaaatgccctgtacatcagttttctgagcaaagtggggataaaaatagtgtttctgtcagagttcttggcataattaaatgtgaacagtgtgagaacaatgcctggcacaaagtaagtgctaggtacacgtttgttaaataaatacacgtaaatgcatattaagatgtctgtgacccagcttctaaagataagagcagtaaggaaaagcctcattatctcccaccaaagtttcctttttcactcattttttcccgtttatttatcctaaggttctgggaagaataaaacatgttccctgcccttgagaatgggctttcaaggagaaataaatcagaaaacagagcaatgcctattccctaccaaggtccatgcacaataaatggttgaatgacatgcttggtgaggatcccaaagaagcaagtgaaagaccctggatctgtcaggctgctgttgtgcaagtccacctctcctgtggagctcctgtttgcaaggcagccagtgacccaaggccatgctcagctggcattcgccctttcacacggatgtgctttccagacactacctcagcaccagcaaccactgagcctcttccctgccctgattctcagtagctcaccctccagacccggccacggtatatcctcaccatgtctgtcccctcacaacttaaatcaaagactctgaggccaaaccttgaattgacaatgctagccaaaaagctctgagcagggatggaagactaaagaggagaggaggaatccctgcctttcttgcatgggagggagaaacacattctgtgatcttgaccaaagagccctgtataatcagaaatcagcagaagggggccctgctctaccctcttcttcatgtggttgtgacaatgttcctcttctcctggctagctcacaggagtgctggggatacagtgctctgggtctccatatttaaaagaagtttaaattatcatacaaatgcattgtatttttagtaattggacttgtttgatctcatatcttttgataattactaaaaatctcccttcaaagtgatgaaagattcaaatgaagctagaatttaatttatattaggtctttgagatgaggtttaagtaacattacagtcccattactaggaaaacgggtaaataaactgtgtatagccatgaaatggagtaacgtattaagatctctagctgctgtcatagaacaaaatactttaaagtggtgggtaaaaacgaagttaaggtacaatatatagaaggagaagaagaagaagaaggaggagaaggagaaggagaaggagaaagagaaggagaagaagaagaggaaggaggacgaagaggaagagtaggaggagaagaggaagcggaagagggaggaggaggaaggagaaaggaggaagaaggaagaaggagaagaagaaaaacttgaatcattggtttctacatgcataagtctgaaggacagtccctgaactgagaaatgggctctccttctggggagatgagcaggattggggatagagggtcaagaaagtctattgctttagctgaatttcttaaagcaagaatgcatttatttatgacttgggcagttttttaaaataaaaaaaaggcaatgttgaatatatgaccatctatgagtaaagtaaacctggtttataattttaaattcttcttccctttattctggtcaaaagggaattcattttcccacttttctgagatctgaaaagatgataaccttatcaaatcttgggtctgtgtgatcttaaaggacaagtaaagaataaaaaagttcaagtcaaaattttaaatgaagatattaacaatgaataagtaatttagaatgtgatgttcccaggagaatgaattttcctggattaatctggctaaactttctttgaagtttgtggatgatggcaacaccactgaaaatgaacttgaggctgtgtttaaatacttgctacaactagcttttctgacatctctgtactcactactgacacagtcaatccacttaattagttttgttgatatctccaattcccctatttactttgtgtcctgaaaagtcctttgaaacccaaacagcctactctacctcttcagctccattgggaaaggttacgatcttaggatcatttgaaaggcaaggagggggtagtaaatttccaccatcaagtggaatgtggaaataatctgggaatagatgaatatattgaattaataccaggaaattttcctttcttggatcttcattgtttttgcttgaaaaactgattttttagaatttatagtcgggctaagaattaaatacaaagaatagaatatattctaaagtaaaatatacattatatgtatcctttatgctaagcacagtaccagtatgtggcacacagtatgtgctccataaatatgtattggcttattgcataggaaagagtcaccagaaaatctaaataatgtagaaatttaaaagaaaaaaatcatttatatttctttcagcaaaagttaaatgaatccctactatgcatgccatgctttgggccaggcattagagaagtattatgcacaaaaaattagctgggtgtggtggcaggtgcctgtaaccccagctactcgggaggctgaggcagaatcacttgaacccagggggcagaggttgcagtgagctgggatcatgccactgcactccagcctgggcgacagagcaagactgtctcaagtgaaaaaaaaaaaaaaaaaaaaaaaagagagaagtattatgcaaggcaggtaagatttggttcttgtcactatgagttcatagcatatagaataaaaataaaggacaagtactctctatcacagcaaataatcaaaggttgtctattatttctaaactcaatttcacatcaaacttgctatattattacatctaatctaaaagcatcaatttctgcctgtgaccacccagtcacattttgattattttaacagcatattgagtatgtttttttttttttgagacagagtctcgctctgttggccaggctggagtgcagtggcatgatctcgactcactgcaacctctacctcccaggctgaagcaattctcctgcctcagcctccccagtagctgggattacaggggtgtgccaccatgcccagctaattttttttttgtatttttagtagagacggggtttcaccatgttggccaggctggtcttgaactcctaacctcaggtaatccacccacctcggcctcccaaagtgctgggattatcagcatgagccaccgtgcccggcccatattcagtattaacattaatctcaataaatattccctagtaccaatatgtgctaggcatgaaggacaatacaacaccagttccatattctaagaattggcaagttggagaaatgaaataaacccattcatttacaaacaaaccttacacgacactctgatggacagtagaaaagattaagtggcaaattaccccaatagatcaaattactatggggatctggagtaggaggagatcccttctagttggttggtgtaataaggcattagacaggagatggggctggctaagtcttaatagaccaagcatagggatgtaggacattctaggcaagtgagaaatgacacactactcctaatcaaaagtgcaaagatgagctactctgtatgacatatgcagtggcaaccaggcacggtggctcacgcctgtaatcccagcactttgggaggctgaggtggtggatcacctgaggtcaggagttcaagaccagcctgaccaatatggtgaaaccccgtctctactaaatacaaaaaaattagccaggcgtggtgctgtatgcctgtaatcacagctacttgggaggctgaggcaggagaatgacttgaacccaggaggcagaggttgcaggaagccaagattgcaccattgcactccagcctgggcaacaagagcgaaactttgtcaaaaaaagaaagaaaagaaaagaaaagaggcatgcagtggccgtgagcataaaaggagagaaaactagggaaagaagcactttaatcgtttacggagcttccttcaggcctgtttattaacatattccaaaaaaaatcactgctgtatgtacatatatgccttaagataaagaggagcaactggaaagagatacaagccccaagtacagtatacttccctgacatttgtgtttttaaagagttcatttaaagggcaatggcataatactagtataattcacataatgctagctctgggctttggacttttaaccaaatgttaaaaatgactccttttctcttgtctctgcgtgtgcttctctgactcgcttggcctgtttccattctctttcttttttctctctccatccttcttagtgtaagttaaaaaaaaaaaatcaatgccgcaagttatgtttaaattcagcccacatgacatttccttcgcatttaattgcttccatacaatttatatccgctagtcacgctagaccccagagtattaaacatgctcttttacaaagaagctcttgtcctgtaataacccccataatcaaagttcaggaattatgggtaaggctcagccggccgatggggaaacaaacaggtttttaaattcatccaaagcaggcttcaggcaggaagcaaatcaaagccgtcactctaccaccaggtttgagagcaaaaacaccgcagaggctagctcaaacgagagatactggcatctctgcacatccagcaaatctgatgccagatactttctctttgggctgccgtgaagaaccactaaacaatgccacttaaagacacatggttacattctctctgctttcaaggcagcccattccaaaaagatctagcaatggtctacaaagactgctcttaaaatgcctctaaatgaataaatcattcttctttgttattcagagtagactaagactaaaattatcttggaaaaaaatatatatatacagggtctctttctgttgcccaggccagagtacggtggtgcaatcatagttcactgcaaccctgaattcataggctgaagtgatcccccttgcctcagcctcccaagtagctgggactatagcagtgtgcaccaccacattctgttaatttttaaaacttttttatagagatggggtcttgctctgttgctcaggccggtctcaaactcctggcctcaagccattctcctgcctcagcctcccaaagttctgggattataagtgtgagccacgacaacctaaagttacctcttctattttcctatagacagcttggacaacatgtctggtcttctttcatactaatggacagctacattagtatgtagctctcaaggtctcttataaactcatatttctgggcacttttacaacttatcccattatcttccccacttctcaagaaatcacctccccaaaagttcacctttgaaaaagtacagaagttggctgggtgcagtggctcacgcctgtaatcccagcactttgggaggccgaggtgggtggatcacgaggtcaggagatcgagaccatcctggctaacacggtgaaatcccatctctactaaaaaatacaaaaaaatacccaggcgtggtggtgggcacttgtagtcccagctacttgggaggctgaggcaagagaacgttgtgaacctgggaggtggagcttgcagtgagccgagattgtgccactgcactccagcctgggctacacagcgagactccgtctcaaaaaaaaaaaaaaaaaaaagaaagaaagaaagaaagaaagaaagaaaaagtacagaagtcatacaactacacaggggcactaacatgatttcttggattgcccttattcacgtagcccacttttcacaagaattgtgcctacttttcttacaaaatctctttaagcaacatctctggtcttccccactgtattcagataaatgcctctctaccagtgtcaacaattttaagaaacctttaatttcacccaatctcctctgctcaaaacccatccagatcaagagcaaaacaattgaaactatttatcagatccagacagttgcatcttaaagaactttttgaaagtttctatggcttgcatctctgatggttttcataaaccaatgcttttgtctatagataaaggttagaaccaatatagattggttttgtttttgtttttttgaaacagagtttcgctctgcccccaaagctgaaatgcagtgccccaatcttggctcactgcaacctctgcctccctggttctagtgaatctcctgcctcagcctcctgagtagctgggataacaagcatgtgccaccacacccagctaatttttgtatttttagtagagacagggtttcaccatgttggccaggctggtctcaaactcctggcctcaagtaatccacccacctcggcctcccaaagtgctggtattacaggcatgagccaccgagcccgaccagaatcaatacagtttggatcagagatatcatgctactcttagaaactggcagataataaatatattatttatagccaataaactacttttggtctatcataataaaaaaaacaattcctaagctatcactaaaacatgatgtcatttgtggttgctttattttgtatttactatacagatgtattctttattgtgatggcctagatctggacatattcagagccaaaattattttacgtatcaagtcactggcaaatcaaagaaaaaccaaattatttaaacattcatttaggagctcatatttatattttggaaatgaaacctcatattttaaggcattcgatattatttattatgcagggtccttttatcttgttccacaatataactttttgttttactcttggcagactttactgtcactgtacaaaacagacattgttttaaaaacccatttgtaataagtgtcagtaaatatgatctttcgcttcagctgaagcaactctatggcatcagtttacacctccacacttacttggaagtttataatgcttgttttcagcagctttcacacctagactccatacgatatgtaccagccaccaagatgtttaccagtcctcagaagggcctttcgagaactcttaaaacttaatttgttactgacgctttgcttaaaggacaatgcactttaattagccacaccactggccctttattcacacacatgaggtaagctggacattccaatgcatgtgcaactgggaaatttgagtcctttaatggttttcaacaattaactagggccggccaattgttaggttaaacaaaaagcactgtggcaaaacttgactcacttcactacggctaataattacaaaaggttgtgctggtccatccctcactctacttacctgccaaagtttcaggcaaagtctcaacaattgggatctaacctttaaaatcatttctttaatgttgacactccaaattgtccataatgaccctacattctgctcctactgttaataatcaccaactacttaatagtttattaaaaagttagcaacagacaaatacaaagaacaatgtttccactgtgtaccatacggattacagctcttggacctttgcttgagaacacagctttccaaggcccaaagcacagcccctgtcatcttcatacttcaaatgcagacatgcaagatcaataactcaaggttaacttttcttagatgatagataagatagctaaacttttttaaaagcctaggtaaaaaagagatgttttaaacatacccttggctacagctcaacttttaggtagctgatcctttctccattcctgccttctttccttcaagcttttctacaatatagccttatggttggattttatgttaaaatgtacgaatgtggccgggcgtggtggctcacacctgtaatcccagcactttgggaggccgaggcaggcagatcacctgaggttgggagttcaagaccagcctgatcaacagggagaaaccccgtctctactaaaaatacaaaattagccaggcgtggtggcccatgcctgtaatcccagctaactgggaggctgaggcaggagaattgcttgaacccaggaggcagaggttgcggtgaactgagatcgcatcaatgcactccagcctaggcgacaagcaaaactctgtcacacacacacacacacacacacgaaagtacgaatacccaaatataagttggatgatataattttgtaagagaaatccggccgggcacggtggctcacgcctgtaatcccagcactttgggaggccgaggcgggtggatcacgaggtcaggagatcgagaccatcctggctaacatggtgaaaccccgtctctactaaaaatacaaaaaattagccaggcgtggttgcaagcgcctgtagtaccagctattcgggaggctgaggcaggagaatggccggaacccgggaggcggagcttgcagtgagccgagatcgggccactgcactccagcctgggcgacagagtgagactccgtctcaaaaaaaaaaaaaaaagaaatccttatttgccaaaagttgcatatgcatagggttatatttcacataatacctaaaacaaagacccaaaaagtggggacggttgcactagagaatgcatctgcagaaaacctaagtaattttatgagcagcactcaagtttactgcttcttttatgattcttaatcccgcctactaaattcacatgtctttacaaatcccaaatctgtaacaaggccaccaaatgctcccaaattagcaaaatacagaatagccttttaactacaatacaagctttaactacaaaatgcagccaaactcaaaccagtttgatataattaaacatgttttatttaccttatattgtgaaagggcaaactggcctggcgaacttacttgcattaatctgagtcccctttgccaggtatcaaaatcagttccagtgaatggagaaacaaagataggaaagataaacatttatctgaaactacagttacataatatttggaaccataaattttttactgatactctccaaacataatctgctatttttatggctgtaatttagttatgacgtgtgccagcaataacagtcctgtgcactacaaattgtgacgaagattttaccaagctaggattgcagactgtaattttcctcacagcaagtaatgatcatatcaattagagtcatgtttttacccgagtcttataacttagctcagttagttataaaacactgatttcggaccccattttaataggatgcttaaacaagcaaacgtgtggtatacggcaataaagtgagagacactataggttatatggaaacttgtgggactatgtgggagtgtattcacaccttatctaattgagatctttattttccttatttttctgtctctcaaaactaaattatctgaattatcataagaattagtacctcaggccctgttatgacctatcctgggaaagaaagtgtcctcgtggaaaagtcattcactggacatttttcagtccttatcttccttgacctctgagaaacacaccacagagctaaccattctttcttcttgaaagactttcttccctggcttccacgcaccactctctggatttcctcctacctctctttctcttctctctccatctctttacagggtccatcagtacttcttgtttcttctcattctatctgtaacctctctaagaaatctcaaccacaccaggatttgaataattatacacattccactacaccccattttcctcccttgggcatcttaaagtcacttcaaactcaatatgttaaataatttctccacttcttccaaggctcccagtacggcttgctacaattagaggcgccaccagccctgacattatacagccagcaatctgcaaatcttcctttcctcctgctttactcgctgcctttatccaatccatcaccaaatcctgtcaaatttacctgctaatatcccttcagtgattaaaatgatctcacttcttctcttttccagcaccactaaagcaacttttcagcaattaaatcactcttatgaataccttcattccagagtggcagaatattccagtcactacctgtgcttctggaactgtaatgaaaatttctatccctgtttctccccagtatggctcacatcagacagtcctcgaaaacctgaccagttttgggccagcagagacgtcactttcttgaaccaaaaagtcaaatcccagtctctagatcatggttaccccgataaggcttttcaccctgagacatcccatcaggcattgcatccagttctccagaatttaatccatgtctgtactctacccggtcctgaggttatgtgaggctcaaccagtaacagagacttcccacaatgcaaaaacaaactaatgctgtttttatcagtcaagtcatatatacatatatgcataataaatccttggaagataacacaagtaactgggaacagtagttacttctgaggagtaaacctagtgtgtgtcttggggttgcagggtggtggtggcagggaggtgggcagtacttttactgttcacttctttttttacttatttttttgagacagagtcttgctctgtggcccagcctggaatgcagtggcctgatctcagctcactccaacttccacctcccaggttcaagcaattctcgtgtctcagcctcccaggtaactgggattacaggtacacgccaccatgcccaactaatttttgtatttttagtagatacggggtttcaccatgttggccaggctgctcttttattttatttatttttttttttttgagacggagtctcgatctgtcgcccaggctggagtgcagtggcgcgatctcagctcactacaagctctgcctcccaggttcgcgccattctcctgcctcggcctcccgagtcactgggactacaggtgcccgccaccacgcctggctaattttttgtatttttagtagagatggggtttcaccgtgttagccaggatggtcttgatctcctgacctcgtgatctgcccgcctcggcctcccaaagtgctgggattacaggtgtgagccaccacgcctggccccaggctgctcttaaactcctgacctcaagtgatccacctgccttggcctcctaaaatgctgggattacaggtatgagccactgctcagcccctacttttcactttataactttcagttctgtttggactttttggtaagagtatgtattatttttataacaaaagccagctttttaaaaacaaaccccaaaataaatgaagtcagtaaaagttacgtttgttcattatagtcacatttaccatttgcttgggttttctcctttctgatgggttatcacacacagttgcagcctcaactatgataggtgcccaggtgcccctttgaaaacctaggctaagaagtgctttgcaagtgcaaactaggagaaagatattcagtattttaatatctgcagaaaagccatcacaaatgaatattttttttttaaataaacaacctagcatgtgtatttttctccagtcaccatgttttgactcctgagtctgtcactggcaatgcttaccagcagactagtcacaaaaaagaacagaaattggatttttgtacagtgttcagaattgagatgtgccacagcaaaattttaaaacaatgagttactgtagaagccacaaagacataaaatatattatgtactagaaaacagattatatacaacctttgtgccatagatttccattttaagactgaacctcttagaatgattattaagttaatgaaaggtatgattaattggttgatgcaaaaattatagctagaaggatggatggaaaaataaaacgataggtaagtaaatagatgaattgattaagagatggatgacagacacattagataggtcgttaagagagataaacagattactgcttctcaaactatctgtggtgaaggaccggggttttatttccaatctgtcaagaccagtatgtagtcctatggtggatggcttatacatagctcacaccacatgtgactcaccacacaagagtgacacacccaaactaccctgttccacaagataattgcattggtcacctacttggatgtcatagcaatgccattttgccataaagtttctaaatactctcaacttctctatctagctcttcataggccagttataattcaactgtacactggcatcagtccatggaccatactttgagtagcactaagctatataatcagttacttcccagcagtatgccatcagttcttattggttgggcatccactctaactggttattgaatttggtagaccatgcatcagccttgtataagaaggataagcagactgattgacagatagaacagtggatgacagataaattagataaccgactagctagctaacaaattagatgggaaccggagagctgttctttgggcaaagaatatttctgaataaagtgttaacaatggtactttctaaatgggggattcagagaagatcagaagaatttcttttccactttcctccctccaacagtgtttgagcatataaaattttaattaaaaagagaaagaaacaattaaatgtccatcagtaggggacatgatgtacatttaaattcctaagcaatggaatactatgtggtccttaaaaaaaacagaggtttatgtacagaagagaaatgaactccaagatatattatactaagtgaaaaaaaaagaaggtgcagaagagtgtgtacagtacactaccattgtgttgtgttgacatggtctaggtggatatctacattgatacatgcatgcttgtactcacaaagagtttctctgaaaaaacaaaaaaactagtgctctggggagggggacaagaggactggaggagagtgaaagaaagactcttcccagtaaatgcctttgtacttattttaggttcttggtatttaaatgtatttattacctctttaaaaacttttttttttaatttaaagaagtcacctgaaaacatgaactttcgagtttagaaaatgcgttcctgagagggaggccactggctgcccaggcagggcatcctcagggaactgggcctaggtgggccctggtgggatgactatggttccagaatctcagttttgtctgtgtctagttgatcagcctcagaggaactgagaaagtaccgaaaaccacaagagagtattctgggaacaagcagactcaaaagctattcatttacaagcagaaatgatagatccagcaggggcggtcccaagtcaagggtagcctggtatcccacttacttgggaagtaaagaccacccacaattttggaactgtacttgctaaattgaatataggatggagctatgaatggaaagataaaaagaccataatttccagactcttttaagtcagcataaaatgcttagttctctaaacaaccaggaagatctcaacataggtgacaatggtggggtcttacgctacagtcacaaaaagctaggactcgtgtatctcaaaactaaggagtgagaaagttgacatttactagcaaaaggtcaatgagcccaccctagctgaggctccagaacctcaatgggatgcataatcatctaccaaccaacacctatcttttaatacaagtcagtacaagctcctcttagtctcaaaaacacaccctcagcatttctgcctctatacctctcttcccatcctgtttttcctggaaggcttgtctgcacacctacctatatctttgccactttttgaaggttccatttatgtctaagcacctttatgagacttctctgaacacccagccttcattcatctccctctccactgcatttagtatctggagctctgacattaatcttgcagtcaaaggggcacagatacaatggaatgccatttccaagcatggaagactcctacgaattccagggtgcaagtttacaatgaaaatggctaaaaataaataatacaggattcctttcgaacacctactatgtgccaggcactgtgctcaagttaagcaatgccaagcaagacaaacatcgttcttcccctgatggaggttacagtgcagtaaaaaaaggaaaaccaaaactaaacaaaacaaaaaaaaaacagtaatatgagagtggagcaatgactgaggaaacagaagggcctatgggaggaggagcagcagcatctaatccagagtgggagctgcaagttggggaaaagttcctgcaggatgtggcatctaagctgatatctgaaggtaatggaggagttaagcaggcaaaaagcagggaaataatgttccaggcaaaggaaacagcttgtgccaagttcctgaggccagaaggagtacagccaatgggagaaactgacagacattctgtacagctgcaaatttcagacctttagtcatattataaatgactgacttaggacacaccttacaaaggcttccggcaaaccaaggtggaaggcagctgatccaggctctaggaccacaggtcgaaaccagctctttggcctggtttgtctgtgttccccttctctctccagattctgtcagctgcctgcggtgataaagccagccacacatttcttcttttaggacatactcacgatgctaacacaaacaggagttcaatgcttttttttaattttttttattttttatttttttgaggcagagttttgctcttgttgcccagtctggagtgcaatggcatgatctcggctcactgcaacctctgcctcccggattcaagcgattctcctgcctcggcctcctgagtagctggaattacaggcaagcgccaccatgcccggctaattttgtatttttaatagagacagggtttctccatgttggtcaggctggtttcgaactcctgacctcaggtgatctgcctgcctcagcctcccaaagtgctgggattacaggcgtgagccaccgcgcccagccaagttcaaatgatttctagttgtaaattagctgaactggctaaagatcttttagatggcacaaaggcaaggccctggaagatcatcgcccctttcaccgtctaaatcccgaacaataacaggaatgaacttgcaaaggtggtgtttgtgccaggcactgcgctcagcactttataaatgtttcttcatttcacttcttctcctaatagcactgagcaagtgaacatcatcttttcctttcttatttattttctgctatgcctagacggaacattaaataaaagctagaagtccaggaaagagagcatgcaagtaaagaataagctgaaagaaatccatatgaccgccgggtgcagtggctcacgcctgtaatcccaacactttgggatgccatggtgggcagatcacctgaggtcaggagtttgagaccagcctggccaacatggtgaaactctgtctctattaaaaatacaaaaattagccaggcgaggtggcagatgcctataatcccagctagtcgggaggctgaggcaggagaatcagctgaacctgggagcaggaggctgccgtgagctgagatggcgccattgcactccagcctaggcgacaagagtgaaacgctatctcaaaaaaaaaaaaaaaaaaaaattctgtagagacagaatctcgctatgttgcccaggcttgtctcaaactcttggcctcaagcaatcctcccacctcggccccccaaagtgataagattagtggtgtgagtcaccttggtggaaatcttgatgagaataaaatataaatagacaatggaggtgtactacccatttctggtatatttgggttttcttccatcatctctatctcaccatcaatgacagttccaaatagcataacccagactcagttcagaagcaaactctaaaaatccatccaccactccaccaccacagttatgcgatcatcaaggatacataattacaagacctaattatgggccacacaattggcatgagacagcatggcataaggacaggaacacaggttttggaatcacagagttctaatcccatctctgccactcacctgttatatgaccccaggacatttatttaacctcactgagcctcagtttacttaacagtaaaatgaggtaataatatatacctgttcatgggatcactgtgagggttaaaagaaataatatacgtaaaagcatctagggttatgaaaaagttccatatgcatataattctgttgctatctctctgggatgtgctgactctcactctctgccttgtctggcatacagcaggtaatcaacaaatgtcaattacctttcctgctcatctcccccttctccatttcctcttcctcccctatcccacacacaaaaacagctcaatttgtagtgacaatctagattccaaacaataaaaactagacacttctcagatggagttgggtatcctctgcccaaaatgctgaagcaaaagggcacttacagtgagcattcctatttaggtttctcttaaccaggaaagttgactctaactccttattttaaacttaaaactgactttcaactccagatccaggttgtccctcaaagctacagctgtaatccagagtcaaaaatcacctgacccctattgccaaggtttctgcttctgattttggctgggtaaataggctatgtgtgttgggagagagagaagagaaagcaagaactaacttgtactgaacatctcctgtgcgccagatgctttaaatatgctcatctttcaaaccacaatgcaacaggtatcactctcttcacattacagacaactgagttagcagacagtattttttgaatgacaaagggcccttatgaaaacagctacattatactgtcattcaaagataaacagaaaaaacaagccagagtcagaacaatttttaagtaaatacgttcagataaaaaaggacttgaaaaacttacctcctacaaaccacttcttaagaagttactcaagcatgtactgcagcaaaatgagggataaaccaaaaaaataggaagacacgggaaaaggaaacagcacttccagccatggaaagaagttccaggatgacagctctgtagtgggcttagtgaataaccagttcagaacggcacagaacgagaaaggaatctcggcatacagcttagacaaagaagactcgataggttagacaagattgagagcctagaaaacttttgagatcataataatggcaaataatgcatgaacacattaaaaggcaatcagaaatactagggaaaaaatttaagaaagtcatggtccaaatatgaaaaaactaaaaggtaacacaaatttaaacaactgatgaagagtgagaaaacaaaaaatcccatttgactttggggctagatatctcatcctttgattggcccaggaatcctaaaaccagacccacagtgcaagtctaaaatccaatcctgacacacaaggcaatgaatcatttcacagaattgtagtcatgtaaatgttgcctatggattttcttttttttttttttttttgagatggagtctggctctgttgcccaggctggagtgcagtggcgcgatctcggctcactgcaagctccgcctccggggttcacaccattctcctgcctcagcctcctgagtaggactacaggcgcccgctgccacgcccggctaatttttttttttttttttttttttgtattttttagtagagacggggtttcacggtgttagccaggatgatctccatctcctgacctcgtgatccgcccgcctcggcctcccaaagtgctgggattacaggcatgagccactgcgcccggccttatggattttcaactttaagaatcatatacgaataagatggtcaactttggggcaaagcacaaatacaggttatgggttcagggctttggcaatgtggaaagcaacattgtcaaaaagtgaacagtagaactggtagcaatccaaacattactgacatacagcataaggaatcaagaaatactatccaaagttgaaaaagccaggtgtggtggctcacacctgtaatcctagtgctttaggaagccggtgggaggattgcttgaggccaggagtttgagaccagcctgggcagcataggaaaccctgtctctacaaaaaagttaaataaattagccaaatatggtggtgcaaacctatagtcgtagttactcaggaagctgaggtgggaggatcacttgagcccaggaatttgaggcttcagtgagctatgattcccactgcactctagcctgggtgacagagacagaccccatctcaaaaaaaaaaaaaaaaaaaaaaaaaaaaaaaaaaaaaaaaaaaaaaagatgattatttaaaaaaggtgacctaacagacaaatttaaaatattataaacatcaaacctgggagagaaaaaagaaaactagcttaaagagctacattctcactttcatatcaggtgctaaaagttgataaatcaaaacatggtggtaaaagcacattacttaagcttaagaaggtaacaatctaagaattaaatatgggtacagttgaaaaaaattaaaagttgccctctgtgagccttgaggaggtgaaggaaaccattgtttttcaacaaatgtcctcctgtatattggatttgttaccaagtgcatggatcacttggacaaaaataattttctgtcacacatttgagaaaaggcaaaacactaaaattgtcactaaaaatgagacgtggcagccaaatgttatagtctgaattgtatttaagaggaggataaaatcttttttcttataaaatcacgttactcaaatgaaagatttttacaagaatgtttgcgaaagagtaaagatgggaaattctactgaagctagataactttcttctttataattccccattttctggtttatgtatagaaagcatgtattctatttataatcagagaccttttaaaaatttaatgtgatcagtattcagtcagtgtgccaggttgcccaacaccccagcctgattcatgagattgagaggacagcaggaataatgaatgaacacagtggttttcagaggctaggtgttttaacattcaatctgcttcactgttactctaatttttaaaaactttttatttagagatggggtgggggtggtagtggctgcaggtgggcaccaccatgccctagtcattgttactctaaaggaatatctgaataccacaggacacctgaacaccacaggaaagctgtgaatgctcaggaaaggtgccttcaggaggttgcagaaagtgattacatcatatacctaggaataatcttacctgagaaaatgacaaaaggcttttttaaagcttcttagatgtccaggctctgtttcccattaagttcattgtttagctaaggaagtgacatgggggaaaggtgtcggtggggaaaaaggaaaactgttgcctaagtagacagcaacagattagaggtccagtccagggtccaccattaaataaccacatgactttcccaaattcctatcatcacccttccgtggcctcaattttctagtcaaaaactaaactaaacaaaattgacccttgtcattctaaaatcctttgatttccaacttataaagctctcaactcccaacagagtcaagaaaaagattcttcttctggctgggcatggtagctcatgcctgtaatccaagcactttgggaggccaaggcaggagaatcacttgagtacaggagtttgagactagcctaggcaacatagtgaaaccccatctctaccccagccaaaaataaaaaaattaaaaaaaaaaatgtatctgctagcctcagccctatttcatagatggcaagtaaagtaataaacagacataatgaaaagtaactccaagtgagtcaccatcatttttcaagcttctacttaatccactgaaatacactgccttttgaggctgtgtaacaaagtgtatgacatttacctaattccaactttaaacaaaactctacaagaaattcagagaactcttggcagattgcttatccttaaagacaatagtcactgacaaattcttaacctctcttagtcacttggccaaaatacttccagggatagcatcagagcaggccagcctactacttacacatttttttcagctgtcattttcattgactacccaaagtgaaatgaagatgcactctgctttggattggagagtggttgtggttggggggatgggcagagagatcacagcaactttctctaaatccaaggctaacttccacttttgcccttgttcacaggcagttctgagctactccaatcattcaaaacacaatgtataaaggaatttttttgttttgcttttgtttcagggtctttttcgtctagttttcctcagatattaggcaagcctagctcctatttcatatttttaataatcacagttatactgatcatataccatacgtatgtgtgtatatattcataaacacagtttagaaatcatgtagggctggggccaggcgtggtggctcacacctgtaattccagcactttgggaggccgaggcgggcagatcacgaggtcaggagatagagaccatcctggctaacatgttgaaaccccgtctctactaaaaaaaatacaaaaaagtagccgggcttggtggcgggtgcctgtagtcccagctactcgggaggctgaggcaggagaatggcgtgaacccggtaggcggagcttgcagtgagcctagatcgcgccactgcactccagcctgggcgacagagcgagactccatctaaaaaagaaagaaagaaagaaagaaagaaatcatgtagggctgggcatggtggctcaagcctgtaatcccagcactttaggaggccgaggcaggcagatcacttgaggtcaggagttcaagaccagcctggccaacatggtgaaacctcgtctctactaaaaatacaaaaattagccaggcgtggtggtgggtgcctgtaatcccagctactcaggaggctgaggcagaagaattgcttgaacccagggggcggaggttgcagtgagccgagattgtgccactgcactccagcgtgggcgacagagtgagactttgtctcaaaaacaaaaacaaacaacaaacaacaacaacaaaagtcatgttattacatcatattcttgactccaccagctacttagaagtcaaaggactgagcacatgtccaaactatcactcaataacccagagaagaccagctgtggcataaatgaccatcaagtctgtttcagaatctcagcattacaccaatctcagaaacaacaaaagaactccttggacaagatatcaacagccttgagatggggaagtaataagaattggtcactggtatgaatcaatgggctcactatagtaaacttcatccatcactgtgtattcattcttagggctctctcatagcaatcagagcatcaaatattagtgccaaagaaaggcttgattaaacttttaaaattgtacatagtgtcttcacttttgcactaaggctactctactaaagaaatatgggctttaaaatgaagtctaagtcaagttcttaggagaggagtttccctcactggcagtgcaggcaatcctgaaacaagtggttaggctggcacaacctccatctttgatagcctgaccctatgacctcaatggaacatttcaagttccagcctggtttctcctgaggaatgtagttatcttagggtaccacaattgaaacaacctcctctagtgtttgagaatatattttcctgtggggtgtaatttgaaaatttcaactaatgtaaaattcatgacatcaaaaagctggaacaatgtgaaaggaagaagagtgacaaagcaggcttgtgatttgatggtattttaggttaacaagtttaatgtaataaaactcctaacaatttccacacgattgatttgtccagcccacaactactccaccacacagttgctaataacatcactgtgctgtgtggtcattatgtcacccagctgggagcactatggcctaccaaccactgttcacttttccagcttgcttttcccaagaagatagaaactgcagaccacctacttcaccaaaagtccctctgttccccaagcttcacagcttttctctgatttatctcggtgtcacatcccaaagggcctggctctggactatctgacttagagtggccaaggaagggactaagggtctgtgcccaagagttggcttcagtcctgcagattcaaggcaaagtcacctgtgtgttttatggtggatgaacttcaccactgcttctgatccctgcttctgatcccttacaattccaacactcagagactcactccctgcttccagctctccatatctgtgaaataaccgtggaaggacacgcaccatctctctctttctctctctctctctctctctctctctcacacacacacacacacacacacgaacacacgcgcgcgttgggcactgtgacttggtgccttcttcggctccaggctgacttacttgaggaagtacctctggccagtggccgtgaaggtcatctcccagcccgggggcagtggcagctcgtcggtcacgtcgtaggactgctggcggaggtgcgcgtgctgctgcgcggggctacccgcagcacccgcgccggtgcccagctgcagggacgcgggcgacgagtgcgagcggacatgctgggcacccccagccagtcgaggccccgggtggccgcccgacgagtcggtgctggactggcgcgagtgcgagcccgaatcaggctccttaaagaaagactccggcaggatcttcttccgccacgagctaggcttcggattcatgacagagttgaagagggcttcgaggtctgtgtctaggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaaggaaaggtcgcacgattccaggacaggcagccccccgaaagaagttcagcccgagccaactccaccacgtctcgactccggaagcccgaggagcctggagccctggagtggtgccggatgagcgcgcgagctccagcgggcactacctgggcgggcagcgaagctgagcctgagcgcgcggcggccgccgtcccgcccgaacttgccgtcgggcctgggtcgctcgggtgagtcccgagattgcggagctggagccgaggcttggctgacaaatcccgacccgactctgtgcctggcagtctaagggcttcggctctcacatcccccgagctggcctaaggcgctagtgctgggcgaaaaggaggcgcaggagaagcagacagcgcggccgcagcagctcccggactgtcccataaacaaagtttggagcaaactcccacccccaggaaagaggcgggcccgaaagttgagctgttgaattat

SEQ ID NO: 138 - DNA, 107599 bp, Homo sapiens
atcatgataaggtggatgtttatttaaaacaaaaataagaagagacatggcctatcatcatgaagattcataggaagagttttcctttgttaacgtggagatcttgcaggctcacagtgtgaacatatggcacctttggacctctactcttctagattgagggcttcctgaaggcagaaaaaatgtttatttcacctttgtatcctgagcacatcatcaacacggaaacacacctgttcaactgtagggttttaaaatatttttcctgaaaatgttttgaaccaagagtctatattcttgaaaataaaatcagtctttctcattgtctcaaacaagctgataagtcgatgatgggggacattggtagttaggtaaagaagatgtgttaatgtactcaggaactagaatttagagttattatgagcaaagaaagtcagttatccaatctttttgacaataagatgttaaaagtattttgaaactatagaaaaacacactgactcctcttataatctatttccaatgttatttcagatgtttaagtcaaagactcgttgcagaaaactgttagcttctgttccagaatccttgagtggttaacagtacaggctctgaatagagattatgtgaattaaggcacagactctagcttttacaaactgtgtgaacttagtcaagtcagcttatcaatcaagcctcagatttcttatcggaaaaataggttgctgtgaggatcaaatacatgtttagtgcttagcacagtacctgggatgtagacagccctaaacatctgctgcattgccacacctatttcgattctttgcctcatatcatttttcagctcaacttagggcaaataaatgaaacagttgaaatgtgtgcacttatttattcttcactaatattaaaccaggtaatttatatctgtctttggcaaataacatacacaaatctatatatatatatataaatgtttgtataaaattgaatattcatgattttaaatttgacaaacactgtcaggtaaaaatcaaactattttactaagttaacatctcattcaattagttgtaagttgtaatagcggcatattttacatgagactattagaaaaggataatattaagtcattaacattataaatctgaccacttttattaggttgaggtgaaatagagaaatctctactatcctggagagaaacaagcaataaaaccatgtattacaagtttaaagaaatgaatttatcctaaaatcatcagtatcagcaccccaacaaagcaactttgccatttctacttaaagtacactgtagcttgatcagacacttatctcagcagtacttgtttaagcaggtctctttgtacaaaagcaaaacagaaagcaaaacaaaatccatagccattatttaccttgcacccagtaaaagccaagagatttaaggtaaggacattttctaatcccatacccatgctaacatcatcaacattgctgatacaaaactcaggtcaggaaaagaagctcaaacagggaaggtgagtggcaacattttatgtatgctaaattggatggcaatattagattacatcttctgcaactgtggtgtcaaaaatctgatagcaaatttgattatctgttccatttgtgacattgtatgacttgatgaagcattccaaccacggatatgcatctacaaaaacaaaaacaaaaaaagcgatttaaccattaaaacaaaataaataactctgaaataggtacctaagcttaccactgagctagaaaaattaacatttattttggcttgaaaagtaagtaaacgtcccttccaaatttaacattattctctcttcaaaatacatactagattcatgttattgttttggagcaattgtgactaatttgaattttttgccacaagcaggtaacagtgagtacatcttgggtttcaaaatggttggtatatattttaaaaatctaaaatagtggttacaatgggtctaccaggcccatgcttttggatataaagacttacttctagaaatctatccaaaagaatccaaacagttaacacaaattaaaactgacaacaaataaaggtattcaagttaaacttggttagagatcaacacaaattcctatcattatgtaactattataagatgcaaagattgaccagggagagtaaagcctgattaaaaatagtatataaaaattaaaccagctgctaaatctgcagctggtaaaatttcctacgataaaaaattgttagaaaaatcaaaattgtcttaatatgacttagatctgcaagtttcaacataagtacaaatatagtcacagaaggaaaattcagtggcagcaggtataagcagtacaatttgaaatgaggaagatctggtttattaatcaaatgtttatgcagaaaacaaagctcacaaaaaattggtaaaacaaaagcttgtaaaatctgaaactagttaacaataaataaaaaaattaatccatgaattaaattggataattggagtttgttacagaaaatgtttactgccaacaattcatcacttttggtctaatttcaactaaaatgcttgtagcatgacaatgtcaaatgtgcttgtgatcaaaactatctccctttcctatatttaaaaatattttaaaaatcttttgactgcaggaattatgattcataactattttatccctgccactctcttcatcaaaggttgatcatagagtaatcactcactacttagtaaatcatttggaagcaaagctttcagacttctaaaagtccacagagtacatatatgttagtgctatctcaagtaaaagaagtgtgggattgttaaaatattcttgcctaccaatttttattcctggaggacaaaacatatccatgatcatatccacacttttctgaaggtcatcatccatcagaacttctgatgctggaatctggaagaatttgtccttaaaaatgtttcatgagagaaaaaaaaaggaaataatattaatcctttttaatgttattattaacacatatttcaatattgtccaattaaaagataatctagacagtttccctctatcaagattgtagaattcataaactagaatgctggtctcaactccaaaatcttatttactctttaatcttaaaatagctttgagatacacgtaatcaagtaaattgctctgatttaataatgatgatggtaataatgatttaaaaacaatgaggctgactattctctttgtgcatagaaaaaaaaatcttgtgctaagcttaaatgaatataacatacagtatatgtattatatagttatttaatttttctcttccctactatgttataagtttcaagaaggaaggaattttgtttactttgttcaccgctgtgtctccatcacataggatagtacctagtacatagcaggtgctcattaaatatttaatgaaaggttaaatgaattgtgtaggtgggagaaaaattctcctctcaactataactcagatcttttccaatccatgtagtaaacattttaactttaccctaagagaggtctgggctttgaccttagcttgtggaacgtaatctctaagccctttctatgtcacacttgatagaagtatttttgcctggaagccctgggtcactatgaatagtttaacaatatgatgtagggtggaaagtttggagcatgtggtatcagcttgatctcaagaggggctgaagactatgatcagccatatgggcagtcaaccatacctacgtgatagagtcccactaaaatcttttagcagagcttccctatctggcaatatattatgtatactgctacacactgttgcagggaaagtaacagtccacaactctatggggagaggacaactataagttccatgtctggaactttcctggactctgtcctatacatctctttcattatctgattttaatgtacatcctttagctgtaataatctgtaactgtcagtataacagttttcagtgagttctaggagtcttgtgaattatcaaatctaagagtggccttgaggacttccaattgcaattagtgtcagaaatgaggaaggttttgtagactgcctcaaaactttatacaataatatctatcttccctgttaaagtaacttcattcctctaatatgaaatgtggaggtttaaaaagtatgatcaaggctgggcacggtggctcacgcctgtaatctcagcactttgggaggccaagggtgggtggatcatgaggtcaggagttcaagaccagcctggccaagatggtgaaaccctgtctctacaaaaatacaaaaattagctgggcgtggtggtgcatacctgcaatcccagctacttgggaggctgaggcagagaactgcttgaacccgggaggcggaggttgcagtgagctgagatcgtgccactgcactccagcctgggcaacagagcaagactccatctcaaaaaacaaacaaacaaacaaacaaacaaacaaaagtacgataaaatgttgactacaaataatgcttccatagtgtggccgtatctctgcattttggccatggtatagggaatgactctttaaatccctgttccttaatttttcactattcaaatgttaagatttagtgtcaaataaaaaaagagatacatacacagatgattcaagatttatgtgctcatattttacttatatttttaaggtgccttaagtccttttaggaacaaagcaggtatgaataaatgtattcaattttttaaatattattttttaattaaaaatatctttattacctctgatacttacagaatccatgagataggcttctagtactcctgttccatcatcaagtgtaaaggtcataacaaacacatattggaggggtacaatacccagtgctagtgaaggaaaaaaagatcaaaccatatgagtctgctattccttattatcaaggtaaagttaaaattgttttatgatagtatagacctgtaaattttatttactaaaataactcaagatacaaagaaaaacttggcattatctccaggtagatagtgtcagaattgaactggaggacacccagctggcgtctgctgagggattgcctgcttggtgtgtgggtgaaaacccctatgcatttggtcacataagtcttctgcgctgattgctgtggtggcagagcagaggacagtttgtgtttttaactccacagatactcaacctataattaagctcatttagcagattcattttggaatatttcactatacctacatagggagaatatcttatgataagcaatttaatctttttgattaaatattaacgtatttaaaataagttgacaccctcacacctgtattctcagcactttgggaggctgaggtgggcagatcacctgggcggatcttgaggagttcaagaccagcctggccaacatgatgaaaccctgtctctactaaaaataccaaaaaaaatagctaggcttggtaacatacacctgtaattccagctcctctggaggctgaggcatgagaattgcttgaacctgggaggcagaggttgcagtgagtcgagattgcaccactgcactccagcctgggcgacagagtaaggctctgtctcaaaataaataaaaataaataaataaaaaaaacagttgatagcctccatagaaaccacaaaaagtgattcatgaaatgtaactcattgcatgttagttttatgaaagataaaattaaaatacagaatattctaaaaaatagcatgcagttaaataccgttttagcatgcctctctcctttctattataagctaggggaataatttataactttaaaaaagaaaaaagggatatcatctggttgaatggacaagaatgtcagaatctgagatttaataatttggtaagataaggaagaaataagaaattagacatactgggtaaaatgaaaattcacaggttaagataaatatcttcttgtttggaaatggaagatactcaatttatagaatgttttattagcttttatctgtggaacccatatttaaacagtataactaattaacagggaaagtaagaataaattaggacatacagacatgaactagggcatacaacagacattaatacaggggaactgaattttaggcttcaaaaggtctcaataggttaaaactgtgaactaaaactaagaaagatgaacttagcacctactcccaggaaccataaaaacaaagatattacattaagaatagaacgaagagaccaagttcaagaagttcatgtgacagaaaaaaaaattacattaagaatagaatgagaagaccaagttcaagaagttcatgtgacaggaccctaggatttcactggaccacaaataaaacatgagatggctgtatcaaaaaggaaagaaaacaaaaccaagtgtacaaataaatagctatacaatgacatttcaggctagtagaagctgagtgtccagtttcaggtaaataataatttcactctattctgaattggccaaacaacatctgcagcacaatgtccagctctgaatgccaaattctgagaaaagcactggtaaagtggaatgcttactgaggaggaaaaacaaaatagtaaggcataggggaaagtatgtgacggtgcctgcttgaagaaatacagactaaaggaaggcttggcagatatctttaaatttacaaagtctgtttatcttacagaggaaggaataagtatacaaagaaggaacaggtatactttcaggtatactgaaatataagtaggtgaaataaccttgtaaacaaacagttaaaattgcagggcatggaaatttagctaaccttctgccacagaagaaggaatccacgatgttttatcaaccagggaatttagattttgtatggatctcaaactagaacactgtttacatctgaaatttataaaagaaagaaccataaatatttaaaaataatttagcttgtttgttataactttttactgctcaaacatgtgtagttttaaaatataaattattaaacagaagaatactgcatcccctatattgtaatgtgcttgtttgtttcacaagagaattatgaaagagtaagcttattacataagggcaataaaaaagacagtataagattcagaataaacaactctaaattgagaacagggtgctcggttccaggtccaaatcattaattaattttgctctcaatttccttatttgttaaaatgaaaagttgaagaaaatgatcatctctaagaattctctgattctatgatctatatctatatctatatctatatctatatatatatattttttaagacaaggtctcactctgtcacccaggcactgtcacctctgcctcctgggctcaagtgagcctcccacctcagccttccaagtagctagaaccacagttgcacaccaccatgcctgggtgatttttgtaattttatagagacagggtcttgccacaatgcccaggctggtctcaactcctgagctcaagccatctgcctgccttggcctcccaaagtactgggattacaggtgtgagccaccatacctggcctctgtaagtaatatcttaataaattcaaagtgttaataaatatggccaatagagaaaaattactaaacagtcacaacatgcaagattctagataattaatatttttagtaagcacatatccagaggtttgtagtttatgatgcctaattccatagttaacttttgaaatgtatataaatctaagactacacaatacactaaagttgtgcattgtgtagtacagttattttgctttacttgaataccaacatattttaactatgagtaatttattttttattatgcatcatcataatgtttatgagatgttgataagaaaatatacttgaaaagatatacttgaataaaaataaaagttcgaaaggtccatgcaatttgttttcatttgcactttgaggaaaacaagagggtaaccacattacatcttatacccttctatttattaaatatataggtgtttcttttctaataaaagatgtcaatttaacaaaagaatattattgcctaagaaaaagactacgatattgattagcattagacattattaaagttagtataaaaattaaaaattaaggatattaagtcaaaattaaatacagaactacttacttccaaagcagtgaaaggggaaacagaaaaaattagaaacataaactaaatatatcaataacttaagaacatatttaaactccactattaaaactaaaatttagccataagcttttatttatgagtgacatacaaattagaatgccagaaacttgaaagcaaagggatgagagtaacctataaagcaattaccaaacaaaaattttaaaaaaacctataaaacacaagaaaccataaagttaaaaaggcatggaatacactagaagtatggatgaaactgacaaagattagtatctctaacacggaaagaaaccttacaatcaattacatgtatgtgcgctcacacatgaaccaacaaagaaatcagtaaccacatagaaaaacaggcaaaagatgtgaacatggaattcatagagtaggaaacctatgtagctgataaacacgggggctgcttaaacacactagacatctaggaaatacaaataaaaacattatggataccatctgatgctcgctggcctgacaaaattacaaaattaatgccaagtatcagacagaaatagactaataccaagtgttggagtgaacttggtagaaactaaaattttatacattactgatgggaccatatattgttaaaaccatgggaagaacaatttggtatttcttcccataaagcaaaacttatatacaccttataatccagtaattctaatttcaggtaaacaccttaggagtaactttcaaacatttttgttaaggactcacagtaagaaattcatttaatatcatatcttagtaatacatacatacacatacaattgaaatgaaagtttaggaaacaacactgacccttactgtgtaaaatgttctctattatccattccctctcattccattttttactacaaccacatcatataatttaaaaaaaaactgtttatgacccactgaactcattttatgacaagggaaatagacaagaaaacatataacgtgacttcattatggtctgtaaatgaaacaaaaaataacacatatccattaataggaaaataggctaataaattctgatatttcataacatactccaaagatgttaaataatctaaatctacatgcgtcaatagtggtaaatcttgaaaattttaatgaatcaaaaaaagcaagctgcaaaaggcttggcatagtacgaaacagtttatataaatttaaaaaatgaaaaatatgccatactgcttaagagttcacacatataatgaaggcataaaaacattgatgagaaggatttaatccaagtttggaaaagtagctacctctgagaaaaaagagttagagaagggattgatatggcattatactacttctctgtaacatttaatttcttaaaaataaaaaaaaaaaaaaaaaaaaaaagtttggaggccaaggtaggcagattgcttgaactccagagttcaagaacagcctgggcaacatggcaaaaccccatccctacaaaaattagccaggtgtggtggtgtgcacctgtagtcccagctagttgggaggctgagatagtaggattgcttgagcccaggatgtcaaggctacaatgagctgaaatcatgccacttcagcctgggtatcagaatgacactgtctccaaaaaaaaaaaaaaaaaaaaaagtctgaaataatgtcaaaacgttacgatttgttaaatctaaatggtggatacgtaattgttgtgatgttacttttttaatttttctataagttaaaattatttcataacccaaaaataaaaagaagaatcaattaaaagatatactggcttttgatgatgaaactcaagtaataaaaaatgtaaaaatgtcttaaaatctggagtgtgaacagcatttgccttagttttgaagcaaccagtaaaaagtcaacagccttggttgggcacagtggctcacacctgtaatcccagcactttgggaggccgaggtgggcagatcacctaaggtcaggaggtcaaaaccagcctggccaacatggtgaaacctcgtttctaataacaatacgaaacaatcagccgggtgttagtggtgcatgcctgtagtcccagctactcggcgggggggttgagacaggagaatcgcttgaaccggggaggcagaggttgcagtgagctgagatcatgccactgcactcctatctgggcaatagagcaagacttcatctcaaaaaaaaaaaaaaaaatggggtccttaaggtaatttttttgagacttctagtaaaagaagtagtagtatttcagagtttaaaatgaatatgaatatttcctttcctggtttagacgcgtcacggtgcccagtactggcaaggcaaaatagagagaaaggggaaagaacaaaagcaagtgagcgaggatgagcatgcaaaaagagaaagctcagtgacttattatacaagaaaaactgaattttatgagttttaattttttaattaattggcttaattaaaaatcattttattttcaaaaaagatggactctcagatcatgagtctaatgagagggagaattagacactgagtatatcagtaaaaacagctataacacagagatttaagtcagtggcatacactttcgctttatggctaaaattttatgatatgttggaaggacagagggcaatgcctaacagtgactttaccacacaattagggaggtatcatgcttaccgtataatatttttcaaccagtatataatttttcaatcaggatttacacattatgacaatgactactaattgctacaaatgtagaagtcggaaagaaagaggaataggatgataaaacatatgttataatccaaggtttctcaaatcagaatgtgtccagggtgattgtttcatcaagcagtagaggagattttatccctaccccctccttctaaatgtagaaatctgtttatagctcctaatgaattcttttatattccaattttcagtggcagcaaatttgtaatttagtggctcagaaattctgaaattgaatcacttaatttttactaggtttgcagctctgaatttttctctgtaactggaatctaaatcctcactgttaaagaaaacaagtgagtaccagcctctggctgaggaatcaaaagacagcagccttatgcctcacacattgcgtgtactctcactatatatgcttatcaaaagaacagatatatgccagaaaaacctagtacatataagttgatacactgtaagttcatgctgaacatatagtaaccaatgaaataaactaataaaaattactcttcaacagtttttaattccaaaagttttctcagttgaaaacaccaccacacatctgcaaccatctgatctttgacaaacctgacaaaaacaagcaatggggaaaggattccctatttaataaatgttgggaaaactggctagccatatgcagaaaactgaaactggatccccttacaccttatacaaaaatcaactcaagatggattaaagacttaaatgtaagacctaaaaccataaaaatcctagaaggaaacctgggcaataccattcaggacataggcatgggcaaagacttcatgtctaaaacaccaaaagcaaaggcaataaaagccaaaattgacaaatgggacctaattaaactaaagagcttctgcacggcaaaagaaactatcatcagagtaaacaggcaacctacagaatgggaggaaatttttgcaatccatctgacaaagggctaatatctagactctacaaagaacttaaatttaaaagaaaaaaacaaccccatcaaaaagtgggtgaaggatatgaacagacagttcttaaaaggagacatttacacagccaacaaacatatgaaagaaagctcaatgtcactgatcattagagaaatgcaaatcaaaaccacaatgagataccatctcacgccacttagaatggcgatcattaaaaagtcaggaaacaacagatgcttgagacaatgtggagaaacaggaatgcttttacactgttggtgggagtgtaaattagttcaatctttgtggaacacggtatggcaactcctcaaggatctagaactagaaataccatttgatccagcaatcccattactgggtatatacccaaaggattataaatcattctgctataaagacacatgcacatgtacgtttattgcagcactattcacaatagcaaagacctggaactataccaaatgtccatcagtgatagactggattaagaaaatgtggcacatacgcaccatggaatactatgcagccaaaaaaaggatgagttcatgtccttgccaggcatatggataaagccggaaaccatcattctcagcaaactaacaccagaacagaaaaccaaacactgcatgttctcactcataagtgggagttgaacaatgagaacacatggagacagggaggggaacatcacacaccagggcctgtcagggggtgggaggctaggggaaggacagcattaggagaaatgcctaatgcaggtgacgggttgatgggtgcagcaaaccacaatagcacgtgtatacctacgtaacaaacctccatgttcagcacatgaccccagaacttaaaagtataataaacaaaacaaaacaaaacaaaacaaaacaaaatacccatagtgatgtattgttccttgtataagaaatggtgctgaaaggtccaaaagttccaggtcttcgtggccagatctcacaggaattacactattaaacttgttcgagagtttgcaaatttcactgagtgtacctcctgttaagagaataaataaatccttcaagtagtgcaaataaaatgtagacaagtacagtcctattaaataacgtgtgaggtataataaaagactaaaggaattgacagaaaaagacaatgaatgtatgtaaaaaatattaatttgtaaatgtacaatcctatacattgattaaaaaaatcaatgcacaaaaatgctgagactttggtaaaatataaagcttgtgaaattttaaccaacttcttaaatttaaacaaattgctctttatttcaggaacactttggttcaaataaccaaaagagggaatataaattaaaagctaagttatgatcagattctcactaatttgctatatactaattaatatctgggcaaatttagagtttaaatctcaattttcaggtcaatatttcatttaaatatagatatgagtagttcatgtaatatgaattcacatataaaatttgttcatttttcctgggaaaattatcacagttaattctatgacagagtaagcattcaaatgaccaggctggctgagaagtattgtccaatggcatccattattagaaggcagtgtcctttttacttagctaataatgcttcctctctccaggcaaaatgaaaaggatttaaaaaatacctctgtgtatttcctaaaatttgggtagaatttgtaatgtcaacattcaattataaaggagaagcacttctggtatagcagagtgaggacatccaaagacacacttgactataacagcagtaagaatattggcaaaaactgtaaaaccttttttagaattctggaaattaccagaggccttcaacaatccaaggagtgtttgctccagaaaaagggctgaattttggcaagaacggtgagctctgtggcattttaacttgccctgttcccatcctccttcccccaagctctttgttactggaagccagagttctgctatatcatattgcagctagatagaaactctcattatgcatgcttaaaaactcaaaacaatattccctaagcatgctacttaaaagtttcacagcccaaaagttagtctatcttttggagactgatacctagccctgctgaagagactcctgcctactgttcaaaactgcaataggtgaccattcactaactcttttctctatgagttcctccccaaaaacactatttcaaagaatctggtgagagctcatctagtcattcacactggccagtcacacgagtttggctctggcacataagctggacaaccttggtcaagttacttaaactctggtataacagtttccccatttgcaaaactgagaataatgttactctgtaagatcattataaagattaaatgagttaatatttgtaaagcacttagagccatgagtgactattactatcaatattttagtgatttcctcttaatgtaaagtccatgaaaggaagaactttgttgtgtttgctacattgccactaatgcctaaatcagtgtctggcacatagtaggcattcaataaacatgtgctaaacaaatgaataagaacaaagaaagacatttacatgtatatatgtgcatactacatttctcaaggtttgtatctggagacatcctaactgagagcaatttatttgcaatcagtagaaatatttaacatggactatggagacagaaaggcctaagtttgaatttttttctgacatttattaagtctttaaccttgagtacttcaccattttctcttggtctcagtttcctcttctgtttacaaaggggatatatccagcttacagaagaactgttatgagagttaaagataaaatactaaactagtacagtgcctgacacatagtctattcagtaaattataggtattaataataaatattatgataaaatgattcagtgacattagagttccatacaaattggattcaattcaattggaaacaatacaaaatgtttcagaggaagttaaatgttatgcagtttaaaatatagtgttaataataaataaatattataaacaattcgaacccacaagtttgacaccttagataaaatggttccatttcttgaaaggcataatctatcaaaactcacacaaggagaaacagataatctgaataggtctatgtctatagagaaattaaatcaataataataatcttgaaaaaagtcaccaggctcagattgtttcaatagctaagtctacccaaacactgaaatgacactaattctctactatgtattccagaaaatggaagtagagggaatgtttcctaactcttatgaggccagcaatattctaatacataaccaaatacattacaagaatgaagacctattgatcaacttctcttaagaaaacacataaaaaaatactcagaaagtatttaaaaattgaatcaaaaaagaaaataattattcaccatgaccaaatgagatttattttaggtaggcaaggctggttaaacacctcaaaatcaattaatgtaatttatcacattaataggctaaagaagaaaaattgtatgatcatattaatagatgcaatagaaaaagcatttgataaaatccaacatcattaataataaaaattctcagcaaactaggaatattggggaacttcttcaacttgataaagaacatcgataaaatagccacagctaaaattacatttaatggtgacactttccacctaagactgggataaaagcaagaacattccctctcattgctcctattcaatattgtactggaagccctatctaatgcagtaagaaaaggaaacaaaaggtatacatattaggaaggaagaaataagctgtctttgtttacaggaaatcacaacaaaaaaattcctgaaataacaagcaattatagcaacggtagaggatacaaggttaattaaaaaaaaaatcaattgcttccctatacataagcaataaataatcaaagtttgaatttaacattaaataattagcaccaaaaaagaaaatacttagatataaagctaacaaaatgtgatctatattttgttggatttataaggtttatctgagtaaaactataaaaccctagttaaagggatctaagaagatctacatagaaagatagtccatgttcatcgtcaataacatcaagttgttagttctctgtctccaccgtgacttatagattatggcaatcttttttttttttgagatgaagtttcgctcttgttacccaggctggagtgcaatggcgcgatctcggctcaccgcaacctccgcctcccgggttcaagccattctactgcctcagcctcccgagtagttgggattacaggtatgcaccatgatgcctggctaattttgtatttttagtagagacagggtttcttcatgttggtcaggctggtctcgaactcccgacctcaggtgatctgcctgcctcggcctcccaaagtgctaagattaccagagtgagccactgcgcccagctggcaatcttaataaaaatcccagcaagttatttttggatattgacaaactgattataaagtttacatggaaatgcaaaagatttacaatagccaacacaatactcaagaaaaagaagaaagttgcaggacaaacactacacaatttcaagaattactatatagctttagaaataaggatggtgtgatattaggaaaataacagacagattaaaacagaatagagaacacagaagcaaattcacacaaactggtttgacaaagaagcaaaggcaattcaatggagaaggaacagtctttttaagaaatggtactggaaaactggacatctgcatgcaaaaaaaaatctggacacagatcttagagcttttacagaaattaagtgatactgttttatatgagactctaatggtgggtacatggtattctgcatttgtcaaaacataaagaactgtaaagcagaatgagtgaaccctaatgtaaactatggtcacaataaaatagtgtcaactgcattaacttggcatgaatatcagtgaatactgctgcaggtccttaaagtctaagaatgactttgtatttatatcgttttctttggttcatctctaagtccaggtcagtttttgattttgttacttcctaaccagagcagtgccatactgcagtaagatcctagcccttggtccaggttataatacttagaaacataaaataaaaatagctcacatttcttatattccttttacatttcaaagtgcttttacatacattctcattatttttttaaataagccttttttaaaaagcagttttaggttcactgcaaaattaagcaaaaggtacaaagtttccctatgtcccctagcctcttccccattatcaacatcttgcaccagagtggtaaatttagtcaatcaagaaacctattttaaaaaaccattatcactcaaagtccacagtttacattagtaacaaaccattatcactcaaagtccacactttacattactaacaaaccattatcactcaaagtccagtctatattagggtttactctcagtgttgtacattctatgttttctttttaagacttcattttttttttttttaaggagcagttttaggttcacagcaaaattaagaggaaggtacagagattttccgtatccccttctaccatacatgctagcctcctccagtatcaacatcctctaccagcgtggtacatttgttaaaaatgaacctatactgacacataatcacccaaagtctataatttacatagaattccctcatttattaaaaataaagttaaatattactctaaggcaaattaaagaaggtatttttcttctattacaaaaggtttcaagggaagaaaagccttcagaaaaacaatgaaaaggtttcaagggaaggaaagccttaagaaaaacaatgaaaaggtttcaagggaaggaaagccttaagaaaaacaatgaaaaggttacaagggaagagaagccttaagaaaaactctaaatttgccatgaaaaaaaattcacagtacatattttagataaatgagataaaaattagatgaaaatgaaaagaaaatgaaaaaccaaacatgataaatttcatttaaaacttgtcaagttatctttacttgtttcaatggtctcttctttgattttgatacaatagatgactttcaccctatttctatgaaacaacagtgacatccagaggccaagaaaacagcaatggtacataagcaatcagcctcttttattattacttaactagacaatcagcttagcattgacaaaataaaatgcaatccaacaatatagttaaatgttaacacttgagtctgaagtacaatttcaaatgtaattaagataaatttatgaacgtgtgcttatatatatttgaacctagttaacatatatattcaattttgttaaatttaaatactatttttactttatatgtactaggttgtctgtaaaatgtattaaacaataattaattaggaaaaatatgcaaaaggagtattctaacaaaacagtgacttaaatatcttaccttctatcaaaagtagacattcatttgaaagcgggagaataccattatttttcacaaaatgaactgctacttttcgtcctttttgatttttagtggtccagatttttgaatcatataatgatgtattttgtagcttgacatctggggttttagttgcaccatcctgaaaaattatatccaaatcgccctcatgtggaacttcttgcctaaaattattggcaatgaaatgatagaaatcgattttggtgtaagcgtgaagatttccatttaacaagttatcaaattaaaaagtatcattcttacatgtagatgagtcagttactttttcttaaattatgtaaattatggagataattcactttgcagaacaaataactttttttcaatagataattatttgatattttgtgggtaagtatatccaaatcatatttacattaactaccagtgatttctatgcctggttttgtgatacaaagttactcataattatttctagcatcaatttttttctcctctgtaaagaatgctaaatttcccagtaggagaaaaaaatgcagtggccccgtcttcactccagttaaatatccacttaccacacttagggagaagggcacttctaaactaataatatttccaattctgtttaataattaataattttaagaagtcatatggttaggtaccatgtagcagaaatggcatcatttggaatcaaaaggtgtatggctttcttctggttctgttgccagttaactgtgtaactttagacagtttccgttaatttctgagataatatccttatttgtttaaaaaatgatcgcggagagtggttttattttacaaagctgtatgattttacaaaattcaataaaccaaagtttgataatatttgaagaattatctaaaatccttatatatacattttaatcccaaccaccatttcaagctcaaatgggtaaaaacagttccctcacattttatttaaagagattttaaaataaaaaatttcttcaaacaaacccaaattttggattggaaaatatatgtatattaatgaacacagatactcacaatttataagcacacaaatacatggcgatgtacatagatatttacacattgtagcacattttagtgaagactcaatttagggcatccaaatgcatataaccatcaattatctacattttccaaaacatcattttagatattcagaggaaaagtaggcaaattgcaaaaagatgaggagcttttaaaaatgattttcagaatatgtcttgagccgattatgtagtaaaaggattacaaaacagttatatacatttattacatatttatataatcactgatgttcagagtaaaggcactgagaaattctcaattactaaagaaaatttaaattatatttattatattctagttattaagcaggacagaagtttaccaacaaggctctctttatcacttaattagatatttcaagtaattacaactcctttcaaaaatttcagttaataaaggtttatatttcagaagatacttctgtgacaaatgagtctgcccaaatatattcatcatttattatttctcatttgcctttatcagagtgactaagctgaattttagatctgaaaatagcacccacttttattactatcagaataatttattctctaagaatttagcactttacctaaaaaatttaccattcttgcaaaatataatatatatattaacaatttacttattcctaagacacaaaattatacatatgtgtacatatacacacaaataatatgaaaacgtttgttttattatggaaaatactcacagcaaatgacatttagggcaatgaagtttaacagactgaaatagtcttctgggcttatatgacctcaattttgctcggatgcggtattgttgaggagctttttgtttcaaaatggcacatagtggtgtcctctccaaatactgatgatctgtaagtactgtaaagaatttttatattcaatcagaataacaagaatcatatttatgacatgcatcctcctgaaccaaatatatactataaaatctaattaatttaagctctattaagtgtcactccatgaaaggaagggttatgtctttattccctgatgtatacccaaggcccactagcatagtgccaggcacagtaggtactcaacaaatgtgtactaaataaacgctggataatttgggggaagaaataagtaacttaactgcctagtaagcattcaaaaaagcaaggtttatttagctaagaaaatattacgctaggcaaccgtttaagttctaactggtgtctgccacaaaagaatgtaacaaaacacacttgtaaaatattatttgcaaatattatttgcaggctcttggatgtttcaaatcagttactttttacagaaccatcattataaaatcagattaagaataggaagggacattaagggtgatctaactgtcacaggagtggtgtagtagtggagaagaggaagtttggggagttggaaggagggagtggaggaggagggagaggaaaaataagaggaagttgagtcaaactggaaaaaaaactcagacaaaagcattaggagcaattgcctgggaaataggtacaataggtctcctcagctacttgtggaaagatggcctgggattgtagtgatcagtttttactgggaaaaagtataaaattgctggtgacccttagcttaaggcaacagcttgctatacattctagcttaacactttcatgtgttttagaaaagggaaatgatgtacaaatcttattaacctcaatggcgaagacaattcctttcagtactgagctttaatccaatgaaattcttgttgaattagttttccttcaaggagcaaatggccaagaaggacagaagtttaccaacaaggctctctgtatcacttaattagatatttcaagtaattacacctcttttcaaatatttcagttaataaagtttatatttaagatacttctgtgacaaatgagtctgcccaaatatattcatcatttattatttctcacttgcctttatcagagtggaacatttattacatcagagtggaacatttattacagtggaacattttgttgtggtggcgattgtggtttttttttttttttttcggagacggagtttccctcttgttgcccaggctggagtgcaatggtgcgatctctgctcaccacaacctctacctcccaggttcaagcgattctcctgcctcagcctcctaagtagctgggattacaggcatgcaccaccacgcccagctaatttttgtacttctagtagaaacggggtttctccatgttggtcaggctggcttcgaactcccgtcctcaggtgatctgcccgcctcggcctcccaaagtgctgggattacgggcgtgagccactgcacccagctggtgatgcttttaaaaaggccattggcaccgggcgcggtggctcacgcctgtaatcccagcactttgggaggccgaggcgggtagatcacgaggtcaagagagcgagaccatcctggctaacacggtgaaaccccgtctctactaaaaatacaaaaaattagccggtgtggtggcgggcacctgtagtcccagctactcgggaggctgaggcaggagaatggcgtgaacccggaaggcagagcttgcagtgagccaagatagtgccactgcactccagcctgggcgacagcgagactccgcctcaaaaaaaaaaaaaaaaaaaaaaaggccattggcagacctgatcaatttagtgtacattgctacacagtgataagagcaattgcttcaaactcatattttaacctaaagtttttaacttttcattttaaaatgctttcaaacttaaggaaaattgcaaaaacaatacaaagaccttctgtataatattcaccaagattcaccaattgttaacatttttgcacatttatcattgtcactgtgcctgtctttatctgtctctcaccacataaatattattgaatcatttgagaataactaccagacattatgcctcctttcctctaaatcctccagtatgtatttcaaaagaagacattttattgacataattacaggcaattttcaacattagaacatttaactgatttattactataatcgaattaattaacaaacattactcaaatttctacaattgtcctcaaaatgttcttcttagcattcattttattttcaagtctaagatccaattctggaccatgtatcacatttaattctcatgtctctttagacttctttaatgtaaaataagtcctcggcttttctttatctttcacaacactgatatatttgaagagtacagccatttattctgtagaataaacaccaatttgggtgttgtctggttattcctcaggctcagatttagcttatgcatttttggcaggaataatgcgtaagtgatactgtatgcttctcagtgcatcacatcaaggggcatacaaagtgagtgtttctattactgtagacctaaactttattcagctggtaaaggtagtgtccaatcacttctctactaaaaacttactgtttcccccttgtatttaacaagaatatactagagaaaatgtaaatatcttatttttcatcaaatatcctgatagtttagaatccacagattcacaactaactcaacaatgactatcatggttacaaaatggtagcttttttttttctaatttcattatcccttttatatttgttattttactttaagaaagatatttccacttaaccccatatattttatttttcctttatcatcatcaacatgggctcatgcattcctgctttactcaattagtattatttgttttgatgctcaaatgttcctagacatgttctatcctaagccatttgacgagtttcatcattaactgagaacccccttactttctagtacaaggttactccatactaatcttgtaattcccttgttctagttcagaaatctgctgtttcaccaaggagctctgattcctttagagagaaatattatttataaaccaagatctgagcaccaggtgtgcttatggcaactggagtgctgctgcctctatgctttttcatggagagagagatagggtacatatgaacacacattcatactgacacacacacacacacacacacccctataatataaacaaatgtgtacacgtgtgaatatatgcgtatcatacatacacacagctacatcgacttctgtatttacctagaaaacatgagtacataatggtacctccaattacaacacaacattaaaagatttcatcaatccttcttccattcacatttgttatcttccttctccaatttgagaaattaaaatttttacaatagcacatttaataaatttgtggttaaaaatatttttctgaaaatttttttttaatcttagctgatgtagcagaaggagggtacttgatagacacactatcattactaacattaaattaaaattttgaggcatattgcaaggagctcctttatggtacactgttaaatgcatcatgtgacaggataactcttcatgtaatagtttaaagatatgtgtctttacattgcacattttaagtcatgtaactctaacagagatacatgacttcaaatacatcatgtatttaatgtttaaaacatatctgttttaaacattaagtctgttagagatagatgacttaaaatatgcaatgtaaagacacgttatctttatgggttccattttatgccaacaagacacggtagaagaagaaagttaaatatggacatattttagctttaaaggatatgtgttctactattagaaagaaatggattagctggtaagtgtagaggcagactttattatgctcattactgtgcccatctcaaaaatgatacatagtcttacttgtagcagatagctgttgacatctttctacctcgtataatgatactgatccagagcctataaaaaggaaaaggcaaaaaaattaagtccattacaacttcattgtagaactgaaaacaatggagcgttgctgagagaaactgaagaaaatataaataaatggtgagatatgccacattcatgatttagaaggctcaatattgttaagatatcaattctctccaaattaatctgtaaattcagcataatccttcgaaaatagcagaggctggggtgggcacagtggctcacgcctataatcccaacacttcggaggactgaggtgggcagatcacttgagatcaggagttagagaccagcctggccaaaatggtgaaaccccatctctactacaaatacaaaaattagccaagtgtggtgcagatgcctgtaatcccagctactcagcaggctgaggcatgagaatcacttgaacccaggaggtggaggctgcagtgagctgagattgtgccattgcactccagcctgggcaacagaatgagactctgcctcaaaacaacaacaaacaaacaaatagcagaggctttattgtagagattgcaaagcagatgctatcacttatgtggaagtgcagaaaatctagaatattaaataacattttaaaaaataacaaagttggagaaccatgtacatgacttcaagacttactataaacttacagtaatttaagacaacacggtactggcatcaggattgaaaaatagatcaactgaattaaattaaatagagagcctggaaataaacccacatttacattgtattttgattttttactaaagcagcaaagcaatgcaaggagaatgcaaatggtgctgcaataactgaaaatttagtgtgaggaaaatgcatacttcacactatactagtaagcattgaatgggaagcctagacataagcccacatttatactcgcttgatttttgacaaagacattgaagccatctaataggaaaaaggaaacaaatgatgtcataacaactagaaattcctatctaaagaaaaaatgtctaccgcatatcatgtgactaggcattaaaaaggaaacaaactaatgatatatgcaacaatgtgattaactctcaaaaacatatagtatatacaaaaagagtacatatgattcaattttttcaaagttctagaacagcaaatctagagggatttgggttacacgtttatgtattagtcaaaactcatggagtggttcataaaatggaaagttgtccatttcactgctaattttacctcaaaaataaaaaactctaaataactactaaactctagctaattatgttcataccacagtgtttagaaaatgtacttatgtctgcaacttactttgaaatgtataaaaaatataaattaatgaatgaagaggcacataggccaggcacggtggcttgcacctgtaatcccagcactttaggaggccgaggcgggcagattatctaaggtcaggagttcgagaccagcctggccaacatggtgaaactgtgtctctactaaaaatacaaaaattagctgggcgtggtggtgggcacctgtaatcccagctacttgggaggctgaggcaggagaagcttgaactcaggaggtggaggctgcaatgagccgagaccgtgccactgaactccagcctggaggacgaagcgagactccatctcaaaagaaaaaaaaaaaaaaaaaagagatatgtagaaataaatacacgtgacagagcacacaaagtaaaatagttattggagagtctagctggtagttatttgagtattcattgtacaactgttttaattctaccatgtatgaaagtttttatcatgttgaaaaaatacagtgtagaggaaataaaagcggagatggataaaatagtaaacttatgaaatttaatagaatgaccaaatgaacatcaaaaataggattttactctaacaagaaagcaaaagtagtagtcatagcattaaggttacaaaatgctttctaaaaagaagaacttaagactttaaaaatgtgtattttgtaatcactttagcttacattctattatacataacagtacattatgtttttataatttattttataaagcatcatacacaaacatatcctcaatattgctaataagtggtataaaaatccaagtcaagaggacttgaatggacatctcaagctggcatggtataatttcaataaatctaatttagtaattaatattggccattacaacatgagatggaaataatggcagaaaccataaaagtagtcaaataagaaaatgtgtaaaacatacatggttgcccacaaactgacaaaaatataattcaacagaaaatcagataaagagtaagagcagaaaatctgaggaagagggaattaaaaacgtttgtaaatatatagtaagattttcaagtttccaagtagccaggaaaattaagtaagaaaacacctttcacctgcttaactgtcaaaaattacatatagtgttaacttccaatactgtgaaggtgtgagtaaagtatattctcctacactgctatttggatataaatttctatgacctttggtaaataatctggcagcatctattaaaaaatgtgcataaccttagatacatcgacctcacttttagtttattgtggagaagtaaaaacatggaagtacatatattcaaggatgtttattaaagtattatttgtaagagcaaaaaactggtaacgatctcaacatctattaaatgaaaaatgaaaaaagcataacattattattatgcaactataatgaatttgagtcatatgaattagcccagaaaaaaagatctataatatattgttgaagaaagcaactatttattatagtgtgatttcattttggtaaaaatttaagagaaagagaagagtcatattgtttatatataggtatatatgtttgtataaagatgaagtgattgaaggaatcacactaaactgttaaatcttacctcagggagtagggaataaaggtatagtgaaagctattcaactggatattatgacacatattacagtgtactttaaaaataatgaatcattttaaaaggaaaaagagatttaaaaagtataaagtataattacaaattatactgtctccaagtgatttgtcatctgaactaaattggtttcctaatagtagttcaagtaatcatacaccaggccaaaacgttatcacgaagttgttagcattttaaaataaggagagttttaaaacagagagaatgaagaaaataaatgtaaagtatgtacaaaaactcaaaaagcctgcacttgaatctgtcttgctttgtcatcagttaacagctaagtaactatggacaaattatatgatatccatccatcaaagcctcagtttcccattgtttaaaggagacagaataattcatctcacaggagtgttgttagaattaaataataatgcggacgggcgcaatggcctgtgcctgtaatcccagcactttgggagcccgaggcgggcggatcatgaggtcaggagatcgagaccatactggctaacacagtgaaaccccgtctctactaaaaatatatataaaaaaattagccgggtgtggtggcgggtgcctgtagtcccagctattgggaggctgaggcaggagaatgccctgaacccgggaggcggagcttgcagtgagcagagatcgcgctagccacactccagcctgggagacagagcaagactctgtctcaaaaaaaaacaaaacaaacaaacaaacaaacaaaagaattaaataataatgcctgcaggcacttacatgcctaccaagaaatgtgtgttaattttcatgcttattattgagatggaaagagaatacatctcataaaatgattctttggatcatagcagggtaggagttaggtagaaaaaaaaaaaaacaacaacaacagagaaacatgacctagattctaggtcccaaaatgcagaagtagaaattaagacaggccaggtgtggtggctcaagcctgtaatcccagaattttgggaggctaaggcaggaggattgcttgagaccgggagaccaggaggtcgagaccagtctgggcaacatatagtgagatcctgtttctaccaaaaaataaaaaattaaaaaattaagagtaaaaaaagccaggcatgttggcatgtgcaggactacaagtccttgctactcaggaggctgaggagggaggatatcacttgagcccaggagtttgaagccgcagtgagctatggtcctatcactgcattccagcctggtcgccagagcaagacactgtctcttaaacaaacaaaaacccagaaattaagacaaagtggtaaaggaaaaaacaatgcacactgaaagctttcaagttcagatttgactagtcacttattcaagcagacaatattagaaggacatatccctctgtttgttaatattttgtatttagatacctgattaattcaataaagactagtaactatgtatacatctaacataactatgagcaaaaagtatttgggttatgcgaaataagtggcaaaaacaatctttgttccctttaaaaactgacaagcaaaatagtctatgaaatcaatacagattttcttgtgaatacacacatatgatatgtatatatcataatcaagtaatcactaccacccaatttgaaaacgtaattatataatttaggaagaaaccatgtttactttttggcataggccacagataaagattttagtatgttcctctactacatgaaattattaataagagagacaaagagaagacattacaaagaattatgttgataaaactattttatttagcaagaactaaactgtcaatgttaaagattatccttacttggaaagctgtcgtcaggttctgattgacagataacatctgaatgctgattggctgtcaaatttgcagattctaaatccctataattgaaagaatacaatttcaaattgcataaaacaaagtcaatatagtaaatttagctctacccacaaaatccagaaattcattgaaattgtatataaaattttgtatgtatatgcattcttcagtaaaggatctattgctttcatcagattttccgggggttcaaattaaaaatctgagtttagaaagatacaagtgaaacagcagaatgatgaaataatacaaacaaaaataaactgggaatttaatggatagcattctgagtcagaacaatctaactctagattcaagaagctaaatatgatattaaaaatcagtgaaattgatataaaagtaataaaacagaagctaatttaatgtcacactaattccaatgaattaaaatgtagacaaaagttatttaaatttaatgaacagtatgttttctctttgaagatatgaagattttttaaatttctagaatattgaccaaaatgcttctgcacacaatactcactaggaataccttgggaaaagcagatctaaatatatagcaggtctaagatactatttactttctggcacatgtaaaaattttaaaaagtttaaaagagagtgatacaccaaaacatgtgttatctatttaatcagtggcacttcagaaatacatttttttcatgagagaattaaatatttttggaatcttagatatgtatcaaattttccaaactttagctaaggtctagtttcccctgtttgttgctgtacttggagagtgtggtaaatgatagaagagaagcatgagtgtaaaagccagattcaaactgttggaaaacttcaactataaccctggctctgctactacttagctctatgagcctataatcatttgatttgtttcatttggctcatctatttaaaaacatggcaaatggcacaaaaggctagggaactatcagaagccccaggaacaatattatcttagaaatcggcttaatcgataccttatttacattttctaaatactaaaagcttactttttcagttgatccacatcagagttactttctggcaagaccctgattccccgaccgtaactggtacctccatgaagatgaaactctaaacttaacattgtctgattctctgaattcattgattgaagtttggtatgaaggctatagattctaagaaagcttccaacctaaaaaatagatcatttgttatttagaaagtggggaaaaattaaaatacttctgatatttaaaactttaataaccaatatggggccaatgagggcactgaccagtcaggaaatatactaaagtatctgcaaagtatgctatacgagtgtggttgaatatcagctgcatggacactacatcaaaactaaatatatggacatgtgcatgcatatgcgtgtgtgcacacacatacatatacacacacattcaactgtaagagatatttccatttcagatctattaaaatgtgaaaaaatattgtgtcttagcatcaataaaatataatggttaagaaacccattacctaaacggaattcaagccctctatttgactaaggtttctgaaaatgccttgctttaactagtttaaggattaattaaatatgatcctgaagatactgtcattacaagaatgctaagaagaaattttaaatatggtactaccgaaaaataataaacatcttccatcttacaagttctatggaaagaaaacttctgcatttgtgcctgtaccaccacagtgtgaaacactccttgagttcaaacgtaagagttaactaattagagttttgaattaaatgttctatagttaatctcagatgttttgctaaacttagtctacaaatgtctttaattatagaccactgagatttttcttttaatggagatttcaaatgagagagatgcagaatgctattcaaagatattgacacctacctaaaagaagctatataacctaaatcacatttatatttatgaagaaagatttagaagcaaaaggagttacaaacaaggaaatttaattcatttgtataaatatagcactcctgactactggatgactatagggataccactttttttcccctacaagttcaggattgaataacagacatcttacataacaaaaaaactatataggttaaatattctttatctgaaatacttgaaaacagaagtgtttcagatttcagatatttacagattttggaatatctgcatatatataatgagctatcttagagatgagacccaagtctaaaaacgaaattcatttatgtttcacatatatgttatacacatcacctgaaagtaattttctataatattttcaataattttgtgcatgacacaaaatttttgtacactgaataattggaaagcaaagggttcactcgcatactggcactcaaaaagatctgcatttaggagaattctggacttttagattatggaggctcaatcctataaaaggaaacgtttaaaaaaaaaagatgagtagcaaatcaactttccaattctgcttattgtagcttctcttaattatatttcccctcattactctttatttctgatggaggatataagcaaaggaggtaaggagaaaacccacactcccaggtgctactccttcattcccaaggatcttttttcccaaccaatcaagggttttataaggagcagacaaaatacaagcctttcctttgacctctttcacttacatctatatcataaccagggagtagtataaagaaagttaaagaagaaaagaacaaaaagaaaaaagaaaaaaataattttcctcatagtcttcaaagtgagacattggaaaaaacataaaattttctagttttatctcattctttttgactggattattttgtgattcttttaaaatatgtgtgtgtatatgtatatataaatatattagtatagcacatgtatgtatgatctacaaaagatttgaaagaaggcctaaacacatggagaaagatattcacatacaaaaggctttgatattacaaaaatgataatttcctccaaattaaactttaaattttatgcaattcaatcaaaattcccagaagctttcatggaatctgaaaagctaatccaaaaacttatacgaaagagaacagtcaaatcaattttaaagaatatgagaggggggctttaccctatcaaaaaatacataaagaaaaaggataataaacataggtatacgtacaaacctacatatggagacacagagaggagagcaaaaaaaaaaaaaaaaaaaaaaaaaccagagcaggcaggagctcaaagaaggttcgatgtgtagagttttatttcctaaaatttaaaagtgtctgaaataaatgtggcaaaacatttaaaaaataaggtgaacacacgggtgtttattatactatcttgtctactacagtattttttaacataacaaaatttcgaggccaagatataagttattcacataaagataagttgttattatcaaaaattccttatggaggcagcattgtattttttcaaaagcttgactaaaaatactatgaaatgtgccagatgctctattataaaaaaacaagtattggttaatcttgtcagtattaagattccaaaaatacaaatgaaacatcaaccaaaaaattataaaaatacagtttaaaaaacaactatagaagtctatttaaatactaaaaaaaaactagaaacactaaaaaaaaaagcaaagtaaatatggctagtaagaaatgactatccctttagaaataatcaaacgatttgtcataaacggtcaagaatttccctttaggtttattatttttaattccctgaatatgtctcaaaatagccaaccaaatcacagctgttgaactattgaaggccaaaacataattatgaccacgtatattttataattaacaattgtgtctggataagagtagggatttagaaagtaaagctttagtttccagacaaaagatttgaaatctcagtttatgtgactgggtctgtgtaaaatgtttaagggaatgatataacaaaaagtgagattcagaaaatagttaagggcaattcgggctctaaaatacattgcttgtagatgttgattatattatattctataattgcattatactgtcctctttactaaaataaaaacacattttttcctgtttctatacaacaaaagtctttcgtactggttccaggtattttgacacaaaaacgtaattttaaacagttgtcttgaaagtaccaagaagaattcatttatatcaatgtcacgtgagtgaagagttcctaaattaagaagaaatgttacagaggttgtcagaaaacaaataaatgtgatgtcaatgtgtattaaataaaaatctaaagttatattacttacacagagaaaaatcattttcatattgcattgcagacaaataatataatgctattgatatcttcacagaaaacacagtgccatacattttcttaattatgtgtgctcatatcaccctctagtgggcaaaataaagcagaacataaaaaaggagaaaagaatctggaaaaaaaatccacagcattcactgattcattcattcagcagcagctattacttacttcatcctcactacagggaaagcactgcgataggtgctgttcaggactaagacaagaaaagcaggaaaagcggaaacagaaagacctacattggaagacctgtttggaagcagtatagggaaagagaagggaataaaatggcgaaggaaggtatgcagagtgtggaactgaggtgaatctaaaatgtaaattcattttatttatgaaagaactctatgaaaaaacctccagaactgaacttatcatatatttaattttgaaataaactaatcaatgtagataatatctttcagggaaataatgtcaaaaatatatcttcaacagtcagtgttttctgatatgtcacagatgtatgtgcatacatatatacacacagaggacaaaaaagtacagtcactatcttcctggaccctggatttaatctaatttattgatttgagttgagtaaacttacttggtttgttgttgttttgttttctaattactattttttctgtaacccagaacagtattgatggtgaacttatttgtgatacaatgtagaatggatatatttgctactccatggccactgatttataaagggaaattgggcattgaaattcagatcttcactcttactgttttcttttaatttcctataagtaggctagaagatatttgtgatggagatcacttccatttaatgctttaaaagattagctctgcaaagagacattgtggattcaaacactggcttcatccagatagggacaggaggcagggaaattctacgcagaagagggcaggtccccagcaaggaccctgctctcaagctgaaaagcctgataccacggcccaaagtgagaacttacatccctgttttcctgctcaaatgttgccttttctaaaaccatccatggcccaccccacctgacatcctgtgcccataaaaaccccaggctcagccggcagagggaagagaggcagctggccatcagacactatggctggatgtcagagagaagcagcttgacttcagagggacagcttgatggtgtaacctgggagaagaatctggccagagagggccagacttcaaggtaagactaccttcctgctccatcctcttttcacttccccttcccactgagccactttcatcagtaatgaaatcccctgaatttaccatcttcattttattcttgagacctcattcctcctggatgctacacaagagctcgggtgccacaagtgtggtgtgagtcagtcacagctaccctgcactaagctgttaacacttaagctgtccatggatgacagagctaaaacagtactgtaacacttcctctggggcttcaggggtcaccagcaccctctcagatgctgctgtggggccagtacagagtttgcttctgcccgtgcccaaaagcctttgccctggctcctgcacctgctcacctgcatgctcccactcctgtggtctgagtgagtggagctctcccctgccagcactgaagcggctgcctagttccagcacctgtgcactccagttcctgcccgtgaaggggtcagggaaataccctgcttcaatccaactagctgtggaatcttgaaccactgatttaacctgagtgcctcatttcacatttgtagaacgagatgactaccatcacctgtcttataggagagtaccaaatgcatataaagtgcctagcaaaagttactcttattatttactgcattattatttatcataccattctttactacaaaaagtactttcaaataaaagatataatagagaaaagaaattccctacaatttttgttaatagttaagtactgccatatctaaactgtgcaccttaatgtatttcagaagacagtatgcaaattctataaattacacagtatacacacacccaatttataatattataaacttataatataaacttgtaatataaatattacaattataacaaattgtaatttaacaatttgttaaactaatgaacaaaaagttatcagctacattctatcaaaccagtttaccaagcttagcatttaagttagcaatattttatatagcctttttcattctaaagcagtattatctcacacaacaaaatttttctatactattttcacagtaaaattatgtatacctttaagacatttaagaaagattattttaaaaattgctctaacccattaagtttatcttttaataatttattgtaacatacattttacaacttaaaaatcaaagaaataaatataatttctagactgtatcacctatacatgtaaccatatataaaaaatttacatgagcaaaaatcactataatttataaaaacataaaataacattttttcctactatacatcaccttcagagatcttgccacatgaacatggttatcgtagactaaaatgtctattgtcagattttgtagccgatggatgtgacttaaatcaccttcaagaacaaggtcttgtattaagactctccaagatggaaatggtgtcctggtgccatcccatacctgccataagagagtagagtagttttatgatccttttgaaaaaatgcttgtgctaaaaagttttttcctggaaacagtatttaaaagtaattaaacttatgcctctgaatattggcactattttaaatatgacattattttctgattgttaaagaactacatatgaaatatgggtaatgtggaaaatgtagaagaatgtaaaggagaaaaagagtcacactgccataagctcagactaaatattcctgagtcaagtgctttatacaataaaaacaaaccaaaatgatcttgaaaaacactcatatgtattaaaatatttttgcacataaatacaactagtaaaattatgaatgctctaaaaattataatagtaatacatttgacattaatcaaattatttttatgagattcagtctcattcttaaattagttgtaaagcattattctgatgtttccatacaaagaagtaaatgttgtaaatttgaataatttcctttatatgatgattttctggttcacattatgctttttcttctccaaaccgtattacaggtgagacatacaaattacccaccagctctggctataaatgacgcctggttatttatataaaaaaaaaaaaccataaaacaaaacacacaaaagataaggccgcaccaatactgtagatattaaaacaaatagaatatatacatttagagaaaactcaatttgagagtattgctcagaaaaaaaaaacatataatattaacagaatagagaaaaatatggaatgatgtcagatcaacaaatttattaaattatatttaatgcaaacgattggtataccacggctactgaaaaattaaaataaatgcactgtggttagtaaaaaaggtaccaatattaatattgtgcccaggttgagatggaaaatgattatactattttgtatgtaaccagacattatatcgagtaatgtctagctcctctgttattaaaaaatataatttaaaaattatttctgatacataagaaaatcactgtccggaaaaaaaaaatcactcatatttcccagagttgaaaacagtaaaatgttgctttataggcctcccaatatatttttgctatgtacatatacatttttagtgtgtaaatgaaactacagtaatcactaaatagaccatcatgaaattctatctcaacaagtgtatgtctataatgtcattttatggttacaaagtattttatggtgacatttacaatgttattttatggtcatcctacataaatagtgtacacaattctctattgttagtatttgtttttttctaatttttctactgtattctcattttttatactgtaagaaagataaatatattcttttaaatgcacctttgtaaatattttaaattatttccttaagataatgaaaataaaattgctgagttgaagggtacaaaaagacttttgaggcttattcttaaattgttgtaagaaaggcttttactaattcttttctttaaattttgcttgaagttttgggatacatgtgcagaatgtgcaggtttgttacataggtatacacgtgccatagtggtttgctgtacccatcaacccgtcatctacgttaggtatttctcctaacgctatctctcccccagccccctaccccacaacaggccccattgtgtgatgttcccctccctgtctccatgtgttctcattgttcaactcccacttatgagtgagaacatgcggtgtttggttttccgttcttgtgttagttggctgagaatgatggtttctagcttcgtccatgtccttgcaaaggatatgaacttatcctttctttggctgcatagtattccagggtgtatatgtgccacattttcttaatccagtctaccattcgtgggcatttgggttggttcccagtctttgctaatgtgaatagtgccacaataaacatacgtgtgcatgtgtctttataggagaatgatttataatcctttgggtatatacccagtaatgggattgcagtgttaaacagtatttctggttttagatccttcaggaatcgccacactgtcttccacaatggctgaactaatttacactcccaccaacagtgtaaaagcgctcctttttctccacatcctctccagcatgttgtttcctgactttttaacgattgccattctaactggcgtgagatggtatctcattgtggttttgatttacatttctgtaatgaccagtgattatgaacttcttttcatatgtctgttagccacataaatgtcttcttttgagaagtgtctgttcatatcctttgcccacattttaatggggttgttttttcttgtaaattagtttaagtttcttgtagattctggatattagccctttgtcagatggacagattgcaaaaattttctcccattctgtaggttggcctgttcactctgatgatagtttctcttgctgtgcagaagctctttaactttgtcaattttggcttttgtcaattttggcttttgttgccattgcttttattgttttagtcataaagtctttgcccatgcctatgtcctgaatggtattgcctaggttttcttctagggtttttatggttttagggcttatgtttaagtctttaatctatcttgaattaatttttgtataaggtgtaaggaaggggtctactttcagtttactgcatatggctagccagtcttcccaacaccacttattaaatagggaatcctttccccattgcttgtttttgtcaggtttgtcaaagatcagatgattgtagatgtgtggcgttatttctgaggcctctgttccgttccactggtccatatatctgctttggtagcagtacaatgcttttttggttactgtagccttgtagtacaggttgaagtcaggtagcatgatgcctctagctttgttctttttgcttaggattgtcttggctatatgggctcttttttgacttttcaatattgtattttaaactaacagttacgtgacagtggttttcacttgtccaaaaaagttatctgttacaatgggatgcaggtatgtgctgtgtttctgcagagagaaaatgtagactcaactatttcagctaaaagttggcacattttatcttagaatttaagaattttctaaaaacacagtcaaaagatagaatatgcctcagtgcatagtagtagagtccttgtcataggaagtgttcagttgttagcaaatgctcatttgttaagaatgtcacttttgccagagtatgactggttgacctagattcgctctaagtttgtttgattttatattgctttagcttcagctttatcatatttgacttatttaactttctgcagggcatgtatttacgactttctcataatattccatgtgtatatgagtgtgctattttcaactgctagaactttgtattttattcaatgatttctaacttctctgttttttaatatgggcaaggtgtaaatcataataatgctaaactccatgacttgtccaagtgccactgcattccatttcttgccctattattccaaagatagtatagagagaaataaccataggagcaggcctgaagaggcatttgttcaaatgtatcctccataggatgtccaggcaagaaaaacatcaaacatccagcttctccagaagttactctctaaactgggataggtatatacagagatttgatgggtcttaagttatttttttatcttgctgatttaaaagcaaaacacagtaatgcaaaatgcttcaaaactgtccatggtatgactatgaagtaggcagtgaaagacataagaagagaacccaacatcaacgggacaaaaaagtaaataaatgagagggaaggtgaccttgacagggaaacagaaatattcatgtataggactacaaactatgaaataatagaaaacaagtctacatcttattactactaaaattttaaaaatgcatcagtcatactatatttaacatgtagatctaataacactatatttctctggaaggaaagtgtaaaattttagagaggtacaagagtagagctgcatgaatattgaggctcgtcaaaaatagttaaaatttaagttcctagtataatacacagcatgctttatctcatcagaatgctgaaacataagctctttacagacatgtaagtggtgctaacttataattcccagtattaaaaaatatgtacctttagaagaaatgatgctccgtccacttctgctttgcccaagagctgacaagtcaggtcaaaatactgcattggctgaacatcacacaattttagtaatgtccaagacggtgacatatgagtagatgcccaaacacgtaaggcttctaccattttgtggtcctcagtagtgaagttaaaatacttgcttgaagtgcgaggtatgataggggctcccaaagttccctcaaacgtcaaagatgcaaagccagagctggtgataccctgagtctcctttttatatacttgaatctaagaaagtagggcaaagtagaaaacagatacaaataaaatagcttactgatgcacaacctacgaaccaaagaaactggaaagattatcaattttgccagcataattaagagagggcattttttaaaaactatttttcatttaattagcatgtaaattctacactcaagtgctggtgctacaccaagatacagaagtatcatggaaactgtgaacctccatgcaaaattcacttacattttttaaagagctaggtggtagtctccctaatcctatcaagcttgcagttttacatttattagtttttttattaaggtgtaatttatacaaggaaaaaggaccataaatgacagtgacttatgaatattatagaaaagaccagaacacttgaaatatgagaatataaagtgaacaaaatgaagctcaggctagagtttaatcagagtgactgagagcactgagatatgccataagctcttttgctttctgaatttgggggctgttatcagaggcacatacatttatattgttacatcttcatgaagtgacccctttgtccttatgaaatgctccttccaaaactctctcgtagtaatatcgttacttcatttcccttatgtttactttgcacattttttttcctacagttttagttctaacttgtttaggtcttcatatttaaagtgcatttctcataggtagcatatatttggttcctgattatttttgttcagtcaatcttttccttgcaattggaaattagtccattcacagaaatgcagttattaacatggccatatttgagtctactatcttatttgttttcctttttttcatacttcttgcttttttgcttctttgcttttttaaaaccattttttttcctattgttcctttcttgttttctttttggaattcttactagtgctccatttcgttcttcttagctatgaataaatctttaacttcttaatgtccacttggaatcaatattgttccactatgtactttctactttccatttcatacttgccacttcctattttacgcgttctacttcacaaatatcttttcaatggtagaattccatttacttatcccatccatcctttgtgttactgttgtagtattttttctacatattttataatctccaccatgtaatattattggttttgctttaaatagacatttctcttttaattaaattacggaaagaaaaacattgtgtttacgtatttgctatttttttccatcatttcttgtatttttgtcacttcttaactatccagcttctagttgctagcattcctctttggcctgaatatcattctttagcattaatgctatgcagatatgctgccatggactatctcatttttcctttatataaaatgtttttattttactctcattcctgaagaatgtatttgctggatataaaattctgtgtgaataaatttttttctatcaccatataaaacttacttctttgttctctgggtgtcactgtctctggtaagaagtgaaagatgactggtatcattgttctccaacaatgcatcatttttttctccagttgatttcaagatttttctctttctcaatggtttcacattgagaaagttttgtctggatgtgcgtttctttgcacataccctgcataaagtacatttaagtctttgtttttcatcaaatttggggaaattctggtccttatttctataaatattttatttcccttcaccctctctcctcttgcatcctaaattacatgtaacccttgatattgttccataggtccttagggtctattaatttgtatttaatccttgttcttcagattaggtagcttctaatgatttgtcatcaatttaacttatatctgatctatttagcccatccattagatttttcatttgttcttttcagttcctgaatttctatttttttaatagtttccacttctctgatgaaatttcttttcattcatttaacatcttcctctaattcactgaatctattttcacttaattccttttttaagttattttatttattaattattattattattattattttgagacggatctcgttctgtcactcaggctggaatgcagtggtgtaataatatttcactgcagccttgacctcccgggctcaagggatcttctcacctccacttaattctttgaaagtctatataatctgtgctttaaagtttttgtttaataaagacaacatttgggctaccatggagttggtttggaatgtgtatgattttttcttttttcttgactaagggtaacactttgttgttttcatgtagaatatatctttttttctttactagacatcatagatgctatactgtaaagactctgaattatgttggcttcttctgacaaacactgatttttgttcttgttggccactgagttgttgtctggtcatcttaaactcatgaatgcttgtttttatgctttgttagggtgatacgtggaaagcccatgatgtttcccaaagtcttctaccttgatgggactcaccctgcaaactctctgcgaagtcttctccgtagaacttgtttcaggctttgataaaacatgtgtagaataggccttactataagatgtggtccttcgtgaggtgagctacttttggggggtgaaacctttgtgctgcctcagctgaatgtccaagctgttaaggaggtattaataaggttatttgtccctgactatcttggacttccagcaccccattactagacctccagtatccatttcatgttcaaccacagttcaaccacacagcagcttttgtaatccttaagtagttctaccctgctctgtgcagcctggctttcaaccaagtattcgagcccaccccaaccctggtggacttttagacatccccttctgtataactccttcctctctggtttcttgttgtgaaaattccagctttcagctgccttgaactttgactttagctatagcaggaccacagcttgaacttcagcttactgtgcagtggttgagaaaatgtctataggcagggatgtggtcatcatggggctcactttataagtttctcttcactctctgatcatagctacccattgtccgatgcctaaaaaacagttgcctcataacgttttatgggtcttcgtggtagtagggctagtctagtaccagttaatttttcgtaacacagaagttcgctctgcagattctaactatacttgcctacaactgatcgattacctaacttttaaatgggttctacttgatgtatatgctgcttctcttttatactccaatgtctgattgattcttggttctgtggtcatcatttttatcaccaattccatgctcactagtgtatactgttgactaaagcttgcctctgctgattaacatagtaaaccagaacaatcttccagcttaggtgtgttggtagctttcacatatcatttatgagcaggtcctctttgcttgagattcaaaatataccttaattagtctacttctatttccaccaccactgtagtctaacgcatcctcatttcatgtctgtaaaactgaaatagccttctaaagaatatctttgccttcatgcttgttcttcaacaacccatctgttatccacgttagtaagagagatttttttcaaaatttgaaccaataatttcatgttcacatttaaaaccctctaatgacttctcattatacctagagtaaaatctaaataacttacctaccacaatttcatcttgcaacacctcccccatggctgcccatgctggtcttatttctgtttctccaataccatgctcattcctatcacagggccttggcacctatagtgtcatctggtggaaaacattttccctcaaatctcagcaggacttctcattatcatcatttgggtctcaattcttatgtctcctcattagaaaggcctttcctgattttgctttattatttttatttatttatttatttattattttttttggatggagtcgtgctctgtcacccaggctggagtgcagtggtgcgatctcggctcactgcaacctctgcctcccgggttcaagcaattctcctgcttcagcctcttgagtaagctgtgactacaagcacccaccaccacacctagctaatatttgtatttttagtagagacggggtttcaccatactggccaggctggtcttgaactcctgaccttgcaatcttcccacctagccctcccaaagtgctgggattataggcgtgagccaccactttattttctttatagtagctatcactacttgaaattactttgatttatatgcttactttcatactgtctgcttctttgcattaaaacagatgcctatacaataaataaataaataaatatttgctggaaaaagaagagtagatcttgactcttgttttaatgtatatttttgctatgaactatgatcttcaaattgcaataagaaaaacaagaaaaaataaattctgatatctaaaacaaatgtctgtacttagaatgaccttgctcaaccaaagacaacagggcgattcaaagctagtggaactgtcaacataaagagtgtaaggaagcactactagccgtaaatatgaacatttcatgaaaatagagaaacaactttatagaaaaatatagtaatgctaaatctatacaggagcctcacaatatataaaacataaaattaaataagaaggcttaaaccccattaacattgccttaaattattaagcaaaatcgatagagctaaaggaaacaggcaaatcctctatcatagtagcctttaaaacagttttcaatagctgataaaatagataagaaataaaaaattatattgaccatatgttagaatataaagtaagcatccacagatttcaaaatactaaacatttcagagtatgttttctgaccaccacaataaacaatagtaaaaaaaggtaactattaaatgatttaaataaatataaaaaagtaataatcctaaggaattggattgaatataattcaatatatatattatttggattatttgaatataattcaaatataattcaatatataaatatatgttcaatataattcaatatattatattcaataataattcaatatatattcaatgataattcaatttttttgaattttcatattgatttcctctctgacttatggattatttaagaattatttataaacttacagatcagagatgaaatctatgatcaatgtaaaaattcaattatatattgaactgaatggtaatgaagttatgacaaattaaaaactgctggatacaactagggcagtacttaaaaaatttatagtcataaatgaatatattacaaaagaagtggctgaattattatagtagtacagttaattttatacagtgataataccgcatctttacattcattcacatttctctagactgtgaatggagccatgcatggtctgttagtgtttgtgtatacaaattgttgaaaatctccaaaaaattttccaaaatacttattgaaaaaagtctgcatataagtgtacccatgtagttcaaacctgtgttgttgaaggggtaactatatgctgttagaggtcatgagactctttactcctgtagcaggagacacaataatgaccttactggagggggttatgaaggaagtttccagagtgttagctatgtgagtatggttatattgtgaatgatgagatgtttatctatttgctattaaatagtaacttccataaacaataacaacaactaaatatgtttatgaagagtgtattgtttgaatacagtatacaggaaacaatactgtgaaaagtaagcaattttttgacgtttaaataagtatgtattacatttctatgatgataatatttctttttatttatttatttatttttgagtcagagttttctcttgttgcccagactggagtgcagtagcacaatcttggctcaccacaacctccgccctccgggttcaagcgattctcctgcctcagcctcctgaatagctgggattacaagcattaccaccacgcccggctgattttgtatttttagtagagacagggtttctccatgttggtcaggctggtcttgaactcctgacctcaggtgatccgccagcatcaacctcccaaagtgctgggattacaggtgtgagctaccatgcctggctatgataatatttctatttctttttatctttacacaaacattctctattatcctcttattctcaaggaaacagcattaataggtcataaaaagtgcctaagagtagaacacagctgaacactgtcctcgtttatgagcagcagactgaccatgaaggacagaattaaactcaagcattagaagaaaaagacaaccaagatgatgaagaggttacatggaaacccatgtaacagaggaaaagatgaagaaacagaaatatttaaaatctaagggactgaatatatacaaaatatttaaaagctgtccaaagcatcatgtagtaatttccaaagaaaaattccagaagtgcattgaacaaaaaagctcaattaaataaatattatagcaataaagataataattttgagaaaataataatcctttgtatttgtaagttctaaaatttttttaattgtgctatttaataactctaccctatattaaaggctttcttacatttagttatttaactacaggcataatttttaaagttcctgttcatatcttatttcttataaatgaaaaccaacttaatttgattttatacttagtatctcaatgttttcattgaacttgaattaacacaagaaatgggaaagaataatataatctcctaatctttgtatacattttttcttgttgacctaaagctcttttttaaaacattaaaaaataaatgttctttatcaaaatctacagataaaacttctatagcattagtctgtatttagaaacagaagacagaatggaaccagttttaatcatggcatgtaatacatttctggggaatgaaagcagtggtttgttcaaatgaagatgtttcttactgtaaattatttgaagtctgataatatttacattacttcttatctcctgaaaagcttgctgtcatgttctaacaaagcaactatataattagtgctaactagtttcagtgaacaatacagagttctcttcaaataaatataagttctagacaatatgaattataccttcagcctgtgaaagcgaacaatatctccatttttataaattattggaagggcttcatagtttccactaaagagcaggcaagttagttttacatttgtctggtccacaatagttacaactgagcaataatctggaaaacacaaaaatattttacctgactttcaatattttaaagcatttgataaaataagaatatgcttacttcaaaacaccaaaccttattcttccttttaattaagtcttctaagaggattaaaacagagacattttcttggctttcaatacacactgcaaaattattttgcagaagtgttctataaatactaattttagaaagtttagtaaaacaaaaataaaaatctcattcagtgtaaattgtctggagagaaaataaccttttctattgcttcaaggtttacaaatcatgaaacataaatgtagtcaaataagaaaaatgcaatttataaaataaacataactaaatttagaatgaaaacaaaggctaagatatttacagcagatatgaagagttgcatccatactgcataaagaatttatgaaaactgtcataaaaatcaggatgatacagtaaatatgtcgtacaaatgaataaacaatacatagaaaactatgtcataacaaaaactcaaaagagaaaatggtaattcttgctagtcacctataaaaaattatacattataacaaaagagaggtatttttaaaatttaaactggtagaaaaatttaatatttgggttgctataaaacgataacttcaaacactggtggtagtaaaaactgtaatagatcctgccttaaaattttttttttttttttgtaattaacatataaaagattgtatgtatttatggtgtgctatacatggttctgaagtacacatacattgtgaaatcatcaaatctagctaatgaaaatacacacattacctcacagttatttttgcagcgagaacacttaacatccattttcttagcatttttcaagaatgcaacatatttttcactatagtcactatgttatacaatagaacccctgaacttattcttcctaactgaaatattgtatcagttgaccaacatctccccaaaaccttcccataaccacacagacccctggcaacaaccattctactctctacttctataagatcaattttttaagattctgtgcctggcttattttacttaagaatgtcctccaggttcatccatgttgttgtaaatgacagaatttcctttgtatgtctaaatagtattccactgtgtatacagaccacattttctttattcatccattaatggatgcttaggtttattctatgcctattgtgaataagcctgcaatgaacatgggagtgcagatatctcttcaacatactgattatttacttttgatatacatagtagtactccctatctgaagtgtcactttccacagtttcagtttcctgcagtcaactgtgatctataaatatttaatggaaaattacagaaataaacaatgtgaatcatctcttcatgcagggtatccacactgtccacgctccctgcctgtttgtcacttagtagctgtttcagctatcatatcaactgtcgaggtatcgcagtgcttgtgatcatgtgacccttattttacttaataattgccccaaagtgctaaggcaaagtgataagtgcttaaactttatcacagatacgtatatttaggagaaaacagtatatacagggttcagtaccatccacggttttgggcagctgctgggggtcttggagcatatcccctttggacaaaggaaaagtactgtacccagtagtgagattatgggatcatatggtagttctaatttttggaagaacatttatatgttttccacaatacctgtgccacgtacaacgtgcaaatgttatcttttcttcacaccctctcgatactagtcttctttttgataacagctatcctaataggtgtgaagtgatatcttgttgtggttttaatgattagtgatgttgaacatcttttcgcatacctgtctgccatttgtatgtcatttttaaagaaatgtctattcaggtcctttgcccatgtttaaattgggttgttttctaaccatctagttgagttcctcatatactttagatattaacccattatcagatacagtttgcaaatattttctctcattctttactctgttaatgttggctgtgcagaaggtttttaagtttgatacaatcccatttgtctattcttgctttcactgcctgagcttttgaggtcctttccaaagaatctttggtgagatcaatgtcatggagctcttcccctatgttttcttctagtaggttcatagtactacattgaatagagtgggcatctgtcttgatacagatcttagagaaaaagctttcaactttttctgcatttattaaaatgatcatataatttttgtgctccattctgctaacaaacattttgatttgcatatgtggaaccacccttgaatacctggaataaatcctacttgatcatggtgaatagtctctttaatgtgctgttgaatttggtttgctagtattctgttgaggatttttgcatctgtattggcctgtagtttttttgcttgttcagtttttattgtgtctttgtctgtcttcagtatcagagtgatgctggcctcgtgaaatgagtttggaaacattcccttctcttccatttttggaagaggctgagaagaattggtgttagttctccattgaatgtttgatacaatttgatgctgcctatatacatgattcagaaaatgcattgactttctgtccttcctagtcccctagtaatgaaggtatagagattgaaaggaacaaaccccaaaacagtgaaggaaaggagagtggaagaaaatatcaacatatttcaggaaaatggaaggtaagtggttaagggataaaataaacagaggaggccaaaatccagaagatactacaaggtggctacagtgaagatgggagccactgggattaagggtgagagtaaaaagtagggctgaaatcaggggatcaattagaagtttacacacagaacaagtgtttcaatgactacccatccttattctccgcttccctgaaaatgacttcaggcagcatctttgtatttaacaacctttccattttgcaaaattctaggaacaaaggctcttttccaagggggctgcactcattaactgggaagtggtaagacttctcatgttggtgttaacaactagaataatttcctcctcaccatcacattagggaacctacagcctagttggaagttctcatcccacccaccctaggctgaaaatttcaatcaatatgccctaacaagtactattagtcactatcaagtttcccactcaaggggagggcgtattagagaaacaaactacttacatacaaagcaaaggagaaaggtatataaaacctaaaataaactatacctacatttttaaatataaaaagacagcagaaaattaccagacattagaataaaaatggaagacactgtaatcctagcactttgggaggccgagtgggtggatcatttgaggtccgcagttaaagaccagcctggccaacgtggtgaaaccccacctctactaaaaatgacaaaaattagctgggtggtagtggtgctctcctgtaatcccagctacttgggaggctgaggcaggagaatcgcttgagcctgggaagtggaggttgcagtgagccgagatcatgccactgcactccagtctggatgatagcgtgagatctgcctcaaaaaaaaaaaaaggaagacagaaagaaaatgaggttaggaagacaaaggagagaagggaatgagggggaggaaaaaaggagagagagagtaaaggggagaaagaagggaggaaagggagagaggaatgggaagggaaagggagacaagaaagaaaggagggtagaaaaagagaaatctgaatttgtgagaagggtgaaataacttggaaccaaaaaaaaaccctaaaaatgaaaaacctttaataagcactttcagaaagagtaaaaatatattatattctcatcccttgaggacccattggctccagttttaggttttaagtttcctttgtcaatatttcttactattagtaaggactgatacttcatgacattttttctttgctagtggtcttccaaagaccaaagataaattttatttattttccaaaatagagaacacattcttacttgcaattaccatatggctctattgtacccttttatatatctgacatacattatgggatcttttttcctatatcttgaaatatagatattcattatctgagtaattatttcatcactatgcattaattatttctgtgtacacttaaaaagactaatttttaaaatgtgaaatgaggcaattgtctaaaggatgatacaagaatgaaataaataatcactattatatcattcttcagtttttgtactgcaagacataaaagaagtctggagacaccatcttttgagtttcttctttagctttatttaaacatggttaaaaattcagaattttaaaatttgtgcccatggtcagtgagaacactgatggaggaagtcatttaaccattattagatgaatcagaagctaaatgcaaaacagcagcactttagctaatgatgataaaattgatcacataagtgaaatctcaggctatttatctccagatgatatcctatataaagtttctcaagctcaaaaattgatgcatgaaaatatgtttctaaaaatagggagaaaatacaaaatatttctgaaaacagagaggaaatatggtattcttatccagtaagtcattcaacaaaaatgatttcaccatacgttattctgggacatgactgaggaccattccattttgctaaaatgacttgtgatggcattctttcatcttacatgatatttacataccaaaatttacataaaatggcatggaagtggatatgcagtaggcaaatgtataaataaaggtagtggaaagaataggtgatatcaaaatgaaagatcaatctttaatcatttgaattgatgttcagaaatctaaaatagaaactgctttgtaattatggagcaaaaacagctgctctctccaaaaaaatttttgagtcgacaaagttttcaaaagtattttgatgatgcaagtgcaagaagaaaaaccaaaagcagtaataagctagaaccatttgtttgtatatctttaaaactaggaaaatatgggattatgaaataaaaatgactttgctatgtttatatcctttttataatctttaatgactttattacctctttattcgcactgctgtataatatttgaaaaatgacttaaacattcaaaaactttaaaaggtctggactcatatagtaaaagataatgattgtttttcctattatgcttaggtgtcaaaaaactgatatctcctagaacttaaagcaaaaggaaaaagaatgacaaaaggacagaaaatagaaggaaaaaaatgaatgagacagcaaactcaaagaattgggccttctgaactctgccttctgagaaagagatcctctttatggatatctggatatggtgcacctgcttccccacaatgaggttatatcctcacttacgcaatttggttcaaaactcaggggcactgaacatatgtaccattactgaagtatacagactgtttctgtaaatttttctggaacatacatattaaaggaaattcatgtggcaagaatgggcccttgttctcaactgcagcacttgtgcacttttgtggacattccacagcaaatacatactctgtaaaaaatacaggagcaaaagaaaagccatacaaaaatattctactgactgttctactctacatagactttgtttctgttaaattctgtaccccaggcaaaaaagtcagaaccaaagaacagctaacaatcttattccataaaatcaaccttagtacaatatctgaccaagagaagccccaaaagtaaattgttcaagaatagaggaagaacatttactagaaatgaagatgcagtcttccaattaaaagggcccattgaaggcaaacaggataaatgatcacaccaagtcacataattgtgaaattagggaacaccaaatattttttaaaattctgaaaacttctgtagagaataaaacaagttaccaatgcaagactgtgaagcagattaacatcagacttttctatcaacatgactggggttactaaaaagacaacaaatcaatggcttcaaaagtctaaggaataatttcgatacttcaactttataaaacctgacaaaactatcaatcaagcataaagacagatgaagaacatttccagattttggccaatcagatattttacctccacagtatctttcttaggtaattctccagcaatacaatgggaaaaaccataaaacagaaaaaagcagagtacggacaatagtaatggatctcccagatagatagatagagagcaggcctagcaaacaactactctagattggagcagaagaaagggagctgataagaaaggagaggtccattaaaaaaaagagtaatcaaccggtcgtgggggctcacacctgtaatcccaccgcttaggtcgaggtgggcagatcatgaggtcaggagatcgagaccatcctggctaacacagtgaaaccccatctctactaaaaaatacaaaaatttagccaggcatggtggcgggcgcctgtagtcccaactactcgtgaggctgaggcaggagagtggcgtgaacccgggaggcagagcttgcagtgagctgagatggtgccactgtattccagcactccagcctgggcgacagagagagattctgtctcaaaaaaaaaaaaaaaaaaaaaaaaaaaaagagtgatcacttagcataatgttctccagattccttcatgttgtttcaagtgacggagcttccttcttttttccacataatttcatttatacatggaatctaaaaaagtcaaacttacagaagtagaaagtgattatcaatgcctagcgggtggcagtggtgagaaatggggagatgctggccaggcacagtggctcatgcctgtaatcccagcattttaggaggccaaggtgggtggatcactagtggccaggagtttgagactagcctggccaacatggcgaaatctcatctctactaaaaatataaaaaattaaccaggtgtggtggtgcgtgcctgtaatcccagctattcaggaggctgaggcacaagaatcacttgaacccaggaggcagaggttgtagtaagctgagatcatgccactgcactctagcctgggtgacagagcaactctgtctcaaaaaaagcagggggtggggggaagaagctcaccaaaggatatacaaactttcagttcaacaggaggaataaattttcaagatttgcacagtgtggtgaccatacttaataatgatgtattgcatatttcaaaattgcaaatagattttaaatgttctcactataaaaaataagtatgtgatgtaatggatatgttaattagctttatataatcattccacaatgtatacacgtatctaaacatcacattgtcccccacaatatgtatttgtttgccaatttaaaataaaaatttaaattaaaacaataaataatcccatacacaactacatatttatataaacttaagggcatagtgaaggcgcagttttattattaataatgatagcaacaaaaaagaaaaggcattaaaaatcccacaaaatataaaaggctatacaggaatatctgatccaaatatgaagaaaactaaaatgtagcatagagatagccaaagaatggaagaaatatgtatggttacagaagagaatataaatgctcataattatgacaaaagataagtaaaggtatacctgacagaagactagagaagaaagtaaacaacaacactgaataaagttgacgaataagaaatgaaagacaaatatattatttaaagttaaagagaatcaataagaaaaaaagattaaaaatttaaaaggaattatattttccatagtataaaacatttatataatctaaactcttcctctgaaaatactaattgtttgataaattacaaccacatggtaacacttctaaaaaatcatttctccaatcataagttaatcccaggataaaaacaaataatccaggaggtgaacaaagatgggaggcaaattcaaaagctaaaacacatctgaaagggctctcactagaaatctagagttttggaaattatataccaagtctgagaaaagaaactacatcttggtctattgcaaggtagaagctgaaagtgagctatcagcagaaatcagtgaccttaaaaaacggtagctagggaaaaaaatccacctgctagcatagggaatcatgaagaaaatctgcctgtctgtgccacggtttggaaatgagggaaaaataataataggccagtttgtggagtaactggcattaatacattcaatgaaatttctgtagatatcctcttagtttggttttctttagtttttgttttgttttggttttcgttaatggcaaacgacatgctgactctaaagttaaaatggaagagcagggggctaccgttatttaagacatacttggaaaagaagaatgcaataggatatttttctgttgaatagcaagattaaaaagtaaagaaattaggataatgtagtgttttctgagagggaaaattcattctttagcaatataagattttggtgataaagagaaaaaaatcactatcacttctctatttgtacttcacctatgtaaaagttaattcctactacatacattaacggtttcatctaaaaacaaatcccacaatacacaatacaacaactgttcttccacacagtacatcatttatgttatgtgacatccaactaacaccctctcacagaggattttttggtaatagcttatagtgtttccccaaacactatactggctattaactttgcagctggattcataagcatattcccaatagtgtcacttgaacctgtttatgctgtaagtagaactgtgaataatgcctgtatagttttgatgccccttttccccacaaatgtgacataattaagcaatttcacagtgaaacaaatgattggtttgccaataaaaaaaaacacacaatgtactttgcataaaacacaactattttgaaggtttgaagtttcttaaaatttcgtgataaacacaagggcaaagagttcactagtctgacaaaatccaattcagattttaagctgcagtaattctgtattacgtctctcactttaaatgctccaaattgatctactttcgtaaactgtgaatataagaccaatacaggaaaaaaactgtgaatttaactaggcataaataatactaaatagtttaatttaatgttaatgttagtttaacttaatgtttaaatagtttaatgttagccaagatgaactgacaaagctcagtccctgtagcacttacataatattgaagaatgtaatgactacagaaaactattgagatttttgtaaaaatttagatttaatctaaattttaaaatactgaaaattgtttcacattttgatttttctatgaagatgtcaactttccaaaagatgacctaacagactgcaaaagactctaggtaacactttgagaaacattattgtagacccactatcgagatctttacaaggccacctcttgcttttgcagaatctttgtgcaagttagaaaaagactctcctttctcaaataaaagtactgcaaaaacctaaacaattttacagaggaacgtgactgagtccaagagagcagcagccttggctacatacacacacacaattctattaaatcactgaattgtaggctcagatatacttacagtagcaatacttccaaaatatcatctacttgctacaatgcaagctctctaaaatgacgtaactacacgttagcatgttcttagaatctcctaaggttatctataaaataatgagcagtttcaaaataaaatactctttcaatatacagtcatgtactgcttaatgatggggatacgttctaagagatgtgtagttaggcgatttcattgttctgcgatcaccgagtgtacttacacaagcccagacgatgtttatttttaaagttatatatatattttcatatgaaaaaacacaatgtcccagcatcattactacacatcagtcatttcccctaactgatctgttatgccaatattaagtgccacgtatcaggtttctacacatgctccattataatcttacgagaccactgtcatacacgcagtccactgttgatcaaaatgttatgtggcacatgactgtactttatttttaatttaaataagtacatatttattaaaagaaacaaaattcaggttaagagaacaagtggcatttaaaaaatctattcaataatctatcaagaacaataagaaaaaaatagcaagctaaaagaaatgttaaacacctttcaggttccctcaattagcattagattcatggcatgaagggaaccacactacttgttttaacaaatagtaacaatgcaaactgctaaaatatgtcttatttaactgctccaaggaagtgaagtgttttaccaaatacacacgcaaaaatatccttcagtaatgacttcacaaataaaaatattttccccatgccttattttttgctctttcccaaacgaaggtacaaagctaaaggtaatttagaagtctatcttcttgttagctaacattaacagggaaagtggaaagagtagaaaatcctttaataaatcagcattcgtactttaaataaatagtacacagtacttataatgtatatctttaaaccattgataaagtgttgtctttaatgctttagtaatacttcatatttaaactgctgacaaagtacttaactagtttaacactttggtaataattcacatagcttgatataaatctggaaaagataacaaatgataaattaagttttctattttgcaatcttgagcaattcaacgaattgactcagtatgattaagtgtaaattgccttggagttttattataagggagagctggtagttcatcttagcaaggtttttaatcaaagaagcatgcatgcataaattacacaatccagaaaaagttcttccatgaaagttgcttcatctcctttttatctactaaaacactgctgtttttaaaccaatcagtatttgagcaacactattccattggtagaaaagtatatcattaaaacattcaagtaatacctatgaaggcaaatcactgaatcaagctacattatgtgctgtcatcttacttcttttacaaggaaacttactgtacaatacaaaaataagagcactctttatttttctggtgtgagcttacataatttccacttgtgctttcattctattgcaagagcatgacagcatggaagatgaaagaagaaagaatatatgttatgatataataaatattatgatatatacagtgacacagattagatagatgttagacattgcatgagttcataaacgttattctggtggagttttacttccatgttttacactatacataagactagagaaaaagtcttttaactgaatgagtaaaagactgtaccacaagttttaagaattaaaaaaacagtactaaattttatgattcattaaaacaattcaaactctaaactaatgaagacagggataattctctaaattagtatgctaataatttgggaaaaagtcatgaaagacaagctagtgctcgtctcatagaagtcagatggaagcctgaagtctcatcaaaaaagtcattcctgaaaatgagaaatagcaaaaaataaatacaaagtgaagtgatagggagaggaaagtgtcttttctccatctccattctttagatgaaaattgatagaatagctggaaaacagtataagtaagctgaagaggggaggcttgtctcaactacccaaatctttaaagaggtaagtgataacctgccatgacctgaatgagtccatttctgaaaggcagttaagcatctgggaagagtctcccctcactcacctagacatatttattttttgactcctgagaaatggaaaactcagtgtctgtctgatccaccaactccattcattgtaacaggtaactcatcattcaatttgaaaatatatattcaaaaagcatggtatctttcacaaatgaaggttctatcttacatagccaaaaaacagaaaagtagagttttaccaattggggaaagactaaaaaaaagtttatgtaactaatagttatagtaattgtattgtaattattcattaatttatctgtcttcacaaaatttaatcccttgtcagaaacaatgacatatataactttgaatttcccatgtcatattatctggcatatagaaaataaataagcagtttgctgaacaaacaaatgagtgaaccgaaatacaaaactatatatttatttattttatgcgccatacattaaacaaagaggacaaccttacggttctaatattatctaaatattcaggtaagtgaatatgaacatatcacaggtcatgagttaacaacatggagttcaaagtgggagaagcatgaaccatagatatatgcataagtctgtatacgtgtatgtgttgtatatttttctaggataggttctataacttgtcatcacatgtgtatgactgcaaaaggcttttttgttttaaaatgccaaaggtgcattttcaattaaaaaaaattgaaaaatagattaaataattattacatataattttacatcatactagattctttcatctctctgataaatcagaaggctcctaggtcttatgaagtaacaatgagtgattaattactcagtaattaatacattaatatcaatatgtgtatcaataatacatagttgacattttcaactatgtcaattccggatatgtggaagtacattgttatacttttaaaaattaaaacgcaaaatatatattcatttaatgtgcaaccagtattgctaacacaaaaccaaaatattaaaacaattatgctacatgacactacatgtacatgacatgtccttctcagatgtgaaaataatcaatattacataacaaaaaacagcattctagagttagctgggatgtttttatagaacaggaaaagaaaaaaatgttagggccccatatcctagcatcctatcccaaaatctaaaagcaaacaaaactgacagaggctctcagaatccagtgttttggatgctactctgagaaatttgattatactgctcagtaagtagctaaaacagaaggtgtccttgtaagacagtgaacaggaagagagaaagatctgcttctagaaacactgtaacatccaagactgctaaacaaactacttttctaaaatgagttttaatgggaggtagggtaagagaaacaagtaattttggaacagaccatacctgaggtaaggtagtgagcccacaggtgatgtaccacattatgtggcacaaaaaggatgagagatctctagcaaataaaagaaagaaggactcaaaatttgaggaaagaacaaaaagaaggagaggcaaacaatgaatattttgcctctcccttcctctaaattcaaatattaggagattaagcacaaacaaggttccctctatttttcctatttgctcacgttgtgagtaggaattatgatattgatcaagcaaggatgagccatacactattaacaagtctggaaatgttttatggtctgaatacatttgttttattttgtaagagcagataataaaaacagagtaaatgtgtctcaagtttaaaaaatagctatttctaaaaaactgaaacacagctaaaattaaattcccttatatgtgttatctaggaaaatatgatgaatggtatgtgtccacggcaaaaactgcatacctaatactatctagccagctcccaaagcaaaagtataggtaaggttttcagagaaaattattgctataaaatctctagtcttaaagaaggcaatgactttgttttcctatatgaaagaagcacagtacgtatcattgatgagtcattatcaaaaccaattttgggcttggtatggtggttcacaccggtaatcccagcactttgggaggctgaggcagaaggactgcttgagaccaggagttttaggccagcctgggcaacaatgcaagacctccatctctccaaaaaaaaaaaaaaaaaaaaagttttttgattagttggacatggtggcacatgctgctagttccagctactagggaggctgaggtgggaggattgcttgagcccagcagtcgaggctgaggtgagctatgatctcggcagtgcactgcagcctagtcaacagagcaagaccctgtctctcttaaaaaaataggccgggtgtggtggctcaagcctgtaatcccagcactttgggaggccaaggcaggtggatcatgaggtcaggagatcgagaccatcctggctaacacagtgaaaccctgtctctactgaaaatacaaaaaattagccaggcgtggtggctggtgcctgtagtcccagctactcaggaggctgaggcaggagaatggcgtgaacccaggaggcggagcttgcagtgagctaagatcatgccactgcactccagcctgggtgacagagcaagactccgtctcaaaaataaataaataaataaaaataaaaataaaatcatataaaataaattttgatgataaaaggacatttcaatatatgttgcttctaaaatatgtgaggaattctttctcagttttcatcattaatcttatcaaaactgaataggaatgttagtatctatagcattatatgttcttttaactctgatagttctgatagactctatgtaaaaattaaaactttactccaaaggtgaatatgaacttaggaatagaagcatttctaccagaataggatttctaccagaaataagatagcatgctacaggtcatatgtaatctttattcaggataagagcaaagaaaaatttctgtcaaggagtaaagatgccaaattgctaattgcttctatcacactgaattgaacatttataagatgaattttcacgaaaaattctagctaatgatatgtaacagaatacactttttccatctacctaaatgtgaactgcataaaggtaattttccaccacataactagctatatacatctggatgttatttagattgtagccctgtatttgtgaaaaagtactgctttaggtaatattttaaaaggcacagctgtggactgttcctgtacatctattcttgtacttctctgtggtaatactaatgaaggttatcttttcctgaacacaaatatcagtgctatttctctaatataactgtaactgaagttactagagagagttttaaaactttattgtctggctagtagtcaagacatcttgctatgtcttaagatttatttaaaagcttcaacgaccaggttcagataaaattgatgacattcattttaatttagtatcttagaagaaacaaacatattatcttggtaataaaagatggctcattactagccatgaattttttactacgggactgcagtgattgaagtaaacatatctgatagagatataagacacatatgaaaatataatacatattcttgttccccatggctttcattttatatgcaagatttaataacattatcatgagaaaacatgatttttctaataacaactgaaaattaatgttgtcatcaatgttttaacagagctatcattttagtctatattatcatattttaagttttttttaaaatgatgtatttgcagatcaacttgttaaaaaaactttttaaattatatcttctatagatacattattagcaacaatgtagcttattcctaagtttggtgggccaattaaattcaaccaggtaaaacttcaaattcgaagaggatcatagtgattacatctttatggctaactcccagaaggggcagcacacgtaacatttgaagaaaattgatggggagaggaaactactaagggaaaagtatgtgagtttatgttgaacagtatgatggggtggggaaatgaagactctgggaataagctgaaatgagaatatttgaaaaataggtcttcaagcacaaatttctctacttcaactttaatgttcccctttcctctacaacaacagatattaaaaggattttccacaaaacattctttgcagtcttcaggcttagtatgaggtttatttaaaacttatctccgtatttaatagtcttcgcaatgttcatttacacacagactagttttttttacattatacgttaataaaatatgctgaccacaagaaaaagattttcccacatccacctgaccaaagagtagattcctagttcattcctcaacaataaaatttgtatatctttattttaaaaatggttttgtaatatgaagtcaatgagaacatctttgtgtttgcaacatgatcacaactcctggcatgcaggagataaagtctacatttcatcaacaacatccatgtttcactatttaacatctctgaaatacggctctatcttaaaattgacagttaagcatagtttaattagcatttttcccttctgaatgatacataaaatgataaagccttttacagataatggtgttttagaatagatgaaatacaataaacaatgttaaatttagtaaaattaaattaaacacaggtgaagtgtgtgtttctgttcactttattacctcacaataaactgaaattcatggcttttgatgttttcgtttacatgtttgttaaaaccttacattatcatatagcaattaataggttatacatttttactttacttttaaaactatccaaatatatatacacctctgtatcagttcatatatatgtatatatgtatataaaatcatggccagggccagtgccaggaaacctttcccctgttttattccagaacattcagtttcaggtcatactcttaagtctttaatccacattgaattgatttttttgtgtaggatctaaggatccaatttctttgcatgtggatatacagttttcccagccccatttggtgaagagactatactttccccattatatattcttgcacccttgtcgaaaatcagttgaccataataaacgtgtgggcttatttctaggcgctctattcaattccattaatcagtatgtctggcttcatggcagtaccatactgtcgcaatactgttactttttaacgtattttgaaattagaaagagagaagcctccaggtttgatctttctcaggattcttttggctattcagggtcctttgtgtttccatatgaatttgaagattgatttttatttttctatagaaaatgctacttggattttgatagggaatacattgaatctgagatgactgagtagtatgaccatgttaataaaggcataactcatgtaattgtactttactttgttgtactttgtaatactgcaattttataaattaaaggttgtggcaactctgcattgagcaagtctactgtcaccatttttgcaacagtatgtgcgtctatgttacattttggtaatcctcacaatacttcagactttcccattttcactgtatctgttatggtgatctgtgatcagtgatctttggcattactattataattgttttggggtagcacaaatcacacccatataagacagtgtacttaaccaataaatatgtgtattctaactcccccatcaacctgtcattcccctctccctctcctgaggctccttattctctgaaacacaacaatattgaaattagatgacttgataaccctataatggcctataagtgttcaagtgagagagtcacatgtctctcactttaaatcaaaagttacaaatgatgaagcttaggaaggcatatatccaaagctgagatacactgaaaactaggactcttgtgcccagttagccaagttgtgaatacaaagaaaaagctcctgaaggaaattaaaggtgctactttagtgaacacatgaatgagaagaaagtcaaagagccttatggctgatacacagaaaattttagtcgtctgcatagatgatcaaaccagtacaacattcccttaagccaaagcctaaagtagaatgaggcactaactctcttcaattctttaaaggccaagagaggtgggaaggctagagaagacaaatctgaagctatcacattggttcatggcatttcagaaaagaagccatcttcataagataaagtacaaggtgaaacagcaagtagcaagtgctgatgaagaagatggagcaagttatccagaagacctaagatcatcaacgaaggtggctacacaaaccaacacattttcaatgtaaaccaaacagtcttctcttggaacaaggtgccatctaggaccttcacaactatggagaagtcaatgcctgccttcaaagcttcaaaaaacaggttcactctcttgtgagagtctaatgcagttgatgactttcagttgaagccaatactcacttagtctcaaaatcctagggcctttcaaaattagcaaaaccaactctgcctgtgctctttaatgaaacaacaaagcctggatgacattgctcacagcatggctttctgaatactttaagcccaacgttgagacgtactgctcagcaaaaaagattcttttcaaaatattactgctcattgacagtgcacctagtcacacaagagctctgatggagatgttcaagatcaatgttattttcatgcctgctaatacaatatccattctgcagcccacaaatcaagtaataatttttacttttaagtgtcattatttaaaaaaaataccttttataaggctatacccaccatagatagcaatccttctgatggactgcggcaaagtaaattaaaaacctagaaagtatttattctagatgacatcaagaacatgcatgattcatgtgaggtcaaaatccaacatcaacaggggtttggaaaaagttaattccaaccctcacagatgactttgaggggttcaagactttggtggaattaagtcactgcagatgtggtggaaacagtaagaaaactagaattataaatggagcctgaaattgtgactgaattggtgcaatctcataataaaacttcaacagatgaagagttgcttcttatggatgaggaaagatagtttcttaagaagtaatctactcctggtaaaggtgttatgaatatttttgatatgacaacaaaagacttagaatattccataaacttagttgataatgcagcagcagggttgacaaggactaaaattttgaaataagttctactgtgaataaaatactatcaaacagcatctcatgttacaaagaaatcttttgtaaaaggaagagtcaattgatatgagaaacttcagtattgtcttattttaataaactgtcacagctacaccagtcttcagaaaactccatcctgaccaatcaacctatcatctccaccagcaaaacgatgataactcgctgaaggctcaacttatccttagcattttttagcaatactgtatttatcatcaaggtgcatacattttttaatgtaaactagtacaaacactataaaaaacagcatggagtttccttaattgctcaagagtgtattgtttaatatccacacatctaaattttataattttcctcctgctattgatttctagtttgattttattgaagtcagaaaagatcttgctattttaaatttattcacttgttttgtgacctaacgagttatgtatactggagaatgttccatgtgcacttaagaaaaatgtatactctgttgtagctgggtagaatattctgcatatgtctgatacgtctgttaggtccatttggtctacagtgttgttcaagttttctgtttccttattgatctctgtctggatggtctcccccattattggaagtggtgaaatgaaacctcctactataattgtgttgctgtctatttctcccttcacttctgaaatgtctgcttcatggattaagcgctctgatgttagcagcatacataattgttatattttcttggtgaattaacccttttatcattatgtgatatccaaaaactgcctgttgtgacagtttttgacttaaagtctcttttgtctgatgtaagtatggccacttctcctcttttggttaccattggcaagaagtatctttctccattccttcactttcatttagcctatgtgtgtccttaaatctaaggtgagtttttgtagacagcatatagttgtatctcgttttttttaatgcactcagctactctatgattttttattaggtaatttaattcatttataataatagtagttattcattaggaaggtcttacgattgccatttaattcactgttttctatctgtcttgtgacactcaattccctattttcttctcttgctatcttcctttgtgtttcattattttgtaatgacatgctttgattcccttctcattttcttttgtgtatcttttataggtattttctttgtggttaccatggggtttacataaagtaccttatatttatagcaatctactttaacctgacaatttaactttaattgcatacaaaaactctacacttttacttctaccccccaccacacttcatgttactgacgtcataatttgcatctttttatactatgtatccattaacatatttctatagttatagcttttatatatttgcctttcaacttctataacagaattaaacgtgatttatgcatcaatgttacagaattgcagtattctgcatttgtttatatatttaccttttccagtgaattttatattttcatatggtttcacgttgctgtttggcatcctttgcttcattctttgtccttactgtctttaactagactctagaatctaaagatcacgtttattttacaaattaaactagccaaagaatatgcatcagtgttgtttggcaattataggtcagaactgagcttctattctaggacttagggtacagatggaaccgtgttcctaaatcaataatgcatttccactccaaaaaactccaccagttttaatacctaccagttcctttgcttagatatgggggcttaaagaacttcacaacaccatagacattgacaattgtaccacccttaagttgattcaggggtgtatatatataatttgttgctggaacctaaagaaagagaagacagtgaatacatttatacaaagtatttacattgtagaatcatgttataatcatattagcagcaaatccatgtaactattttatccttttaagtgtctaaaagaagttataacctgaaataaggcaatgcacacagcttagcttatccaactagttttccttagaactttgtttataaatggtacaatttgcacactagctcataaaggcataacctataatctaattaaaacattatacttcttcaataaaaacatagcaaacagcatatacatatagtccctgacttatgatggttcaacttacaatcttctgactttagaatgggtctattaggcaatttaatgcattttgtatttataaaatttttgacttatgatgggtacactggatgtaacttcattgtaaatcaaggagcatctgtagtgaaaaacagcaatacatgtcaaaactgaagcaataacacaaaacaagaaaatacttttttttaaatatgtacatcttcaatgtaaaaggtctaagaaaagagagttttattaaaggtaaatgactaggcataaagagatatttttagaagccctgaaaatgcaactagaacactagtcttaacaatacaagttacatctcttgtaagtttagaaaactttttttttaaggacactctcaaggaatcttttagtaattaaatcatcctagctatctttaagttagtatatccctagcttatttggtcaagaaactgtagctgggggacaataaatcaaactgttaacagagagcaaattctaaaaaatgcaatttaagagattttggttctattttttaactaatatctctttgaaacttgtggtacaatttctctcttccccttacccccatgctattatagagattttccataggcctaaattttgactcataactcaagccaggttttgagtcataaatggtataaaaagatttaaaatgctaataatgaaaccctaccccaaagaattaaaactaacaattcctaaattcttgggcttacagtatagtagataagaaatgaaaacttattgagaagttgaaatcagcaactaacacaaattcttgagcttgcagaatatcagataagaaaagaaacaacttgctgagatactactgaaactcctactgattttgagagcaggaaaaaactatctgaaatcagttgaaaccaagatggctgactggaatttgagaacgagtctgctgatatcacagtatgaatttccatcacattcatcatactaactccacctgaatttgcacatgcaacccatgcattaatgtgaagaaataactatgcttgcccaaggactttccaaacttcccctttcatccaactaatgacttactaatcccagtatctactctttaaaacttttctaataaaattactgccttaaagacagcgcagggagacatatttgagctcagctcgtgtctccttaggtgttgactttcagcttttcttttctcaaaaatttgatttcacagtattggcttataacacatcaggtagcgagctccttttgttctataataataagagaaccaaaagataattttttgaaataactgtgaataagttgggaaagaaaagggaaagtggtttacaaggacatgtttgcatattaacagtgatactaaataaagccttaaagggctttgtataagtgatcccaacatcaaatggaaataaggatacctatcactctgagagttaaaattttaaaactcaaattaaaaaattagtttttccaaggaggcttctcagtttaaacaagagtagaatttgctaatctaatcaaacttcaatataaagaaagctagctcatcaatgattaaaaaaagaatgatggaataatggaatggaaagagaaataatggaagagaagcatactgaacagtagggagaaaacatgtgcttagcttacactcaatattctatcttaacatctcatggagagatgaatgggaaaggccagcaaaactcaatgacactaaccattataatcaaccaagtaaccgccatttgttaattcattaccaataaacaacttcttgtttggctttccatgcaaatcagcaagtatttatgtgtacaacagctaagatataaacctcattataaattcataaattgatattttttgcttcttaatcattctctaatgagttgggttaatattcttacaagtttggttaatgtaccattgagtaagctcacacttcaacaaggtaattaaatttacatgattcccaataagccctatcttagtagccaatttgcctcccttgctgacacaataaagtattgtattccataaaaaaggactgtagagggacatccaaatcagtgtgaacaaatgtgttagcgggagaaatagtgtagttagtaggagaatggtaagcaaaggctttctgaaggtggcaacaaaatctaaattttgaaggacaagtaacaaggagaaatgatagcatatactagcattatgtaatcagggatctgaaaatagtttcacactgctggtgcaaaaggcacatggctaatatctaaagcaacaggcatataatatttatgacatcctaacaactcctaggttaataaaactagcacttacaaaaatacttgttgagggtttttattgctcactaaataatctagaacagtactatccaagataatcttctatgataatgaaaatattctatatcaatattgtggctactcaggaatttaaatatgactagtgcaaatcatgaactgaatttttaaaagccacacacagctagttgctcattatcgcacagcacaggcatatgtccatgagaaaaccatcggctcatgatatactaaagataacttgatagcattatcattaagtacatcacttgatccacatttcacacagacatgaacaatttttttttttgactgcttaaggggcagcccattatggaatcaatcagtcaggaaaatgtgagccctggttaaatgagatgcaatttacagcatatgcagaaagttaactagcggacaaaaatcaagcacagcagacaataaaagcctgaagagagaaagacacctagcagcataattcgattcattcattcctttatttatttctgtccttccttcattcattcattgatgggctatgtactatacggggcactaaaaataagtgtgaacaaaacacaaatagaccctgcaccaatggaagaacaaaccataaaagcggagagatgtcttagaattgtcttagaaggtctatttgaaaagatatttaaagaaagaactaattaaatgaagtacagaagttgggaatgagataagcaacagtgttccaagcagagaaaacacattcagtatatttgaaaatccaggaggtttggatggctggagtgtactggtcaaaggtaatgacaagattaggttgaataaaaatataggggatagtttatattgggccttcagatcacataagtgggctagtaaagcttttaaatcctgaagacaatacaagatcaaatgattaccctgagtcacttgaaaagcaaactttctaccactgaaaaacaaatactctattttctaaattctaaaaacaccctggtcctcatagactacacttttaatactatattctcaaaaaaatacactttttcaggaaaacaagaaactcaaaaacagtaactccgttttcttgatatcaactgcaagatccatgctcagtttaaaaatgtagaaatgtaaaaacaagcatcttttgatgagtcaggaaaataaagtcaaatagatctatgcttgatttaacttacaatacctaggctttgtgaaaaaatatttttgcaaagttcagaggctttttcatttattcccgccttatttacaggttcgcagatatatcaaatattttaaattaaacaatttataacaattttgggaaatactaataccagagctaactcacatttttcaaaaagtacatcagttcttttattggtaacagttcccccaaaaatattaattatactaatactcagaatttagtaactgtgtcctacagtcattgtcaaccagaaacagttcctgaattctgtccatttgaaactaaaggttcaaaaacataagtagaacataaacatcatattaaactataccaataaattattaacaccttctttccagtttcactcggctacaagtagactatctgtaaaaatgggaatgggcatcttcctattgctataaggaagctatagctatatctatgctataaaatagtggggaaaatggttaaaaagaaatgtatcataagtataagaaaactacttaaaattatataatttgttcaattatataattcagcacataattgtctggttaaatacaagctaatgtaaaaagaaatgaatttgcctatggtttataacaaaaatttaaggatcttcatacagtaaaaacttattttatttttcttgtgtatgtatagcttacacaaaatatcagcagatattccagacaacagaatattcagatattgattactaggtaaaatatataactctaatataacattatcagctataaaaaagtaaagattatgtttttccagtgtattgataatatatcaatatcagactacaaagtggactgaatatacatacacatgtatctatgtgtgtggcatatacaggtataggtgtaatactctaaattaaactgaatatcatcttaccaaagacattgattctgtagaaaaatctcttaaagatttgacataaacctgaaggaaaaaaagaaagaacttatttgtatacagataacctccaatgtgattacatgcttttagttgtagtaaaagtacacacttacttgtaaaatattcaaattcactaggatgacataaagttatggcttacaaattaaaagtgaaatgtgcaaagttgtctaagctacagaaacttaaaaaaaaaaggcaaagatataaggtcaaatgaaaatgtactttattaaaatattagtgttcttacagattaaatctgaagcacagcaatattcagttctcaggacagttctcaggatagaatgtaaaagaatgccaactcctatcagtccaatagaagtggaaaatcagagctgatattcaaaatttttcctgcatagaaccttagatgttttcagaaagaaaaaaatcaataaggaagtgcttcagtgatcactctaactgcaaattttacccatctccagcctaattcattaattttaatatcaagcagagccaccaccagtgcttatagtacctttgtgcatactagaaaaaaaaaggcagatgttggcctgcaggcttttggcttagcccaattctacctaatagccttgactaaaaaggcagttttcaagtgtgtgtgtggaaggtagggtgttaaaagaggaaaggagaggaaggccatcttcacaacgaataaagtaggagaaggaaaaaatccgttttacctaaagaggggtagttgattaatttaaagtgaaatcaagtagaacaaagtgcctgatggcataatcacaaagaatatccagtctagaatgtctgtgcggttttgtaagtttcattaataagtatttattaaatataaaggaattccctattctatcttgtcattcgaaaaataaaaccaagaaaaaaaaacttctattttttaaacttaaaatattcaattaaaataatttagtcagaccaagtagtttatctgcagatttacagaaatactttcaatcccatcactttagctcattaaatctgcaatgtaattagagaataaaagctgcatacttacataaacagttgatttgaggtcttcaaatgctttcaaaaatatgcaaggtttaccatctctgcttgtagatgaagaagctaaaaaaacaataaatctagccactgcaatggtgtcctacatagaaaaaaaaaagtttttgaatcaatcaccaaaatacgtataatttggaatgtcatataaatccttatttatattattatgtttagaataaaaattacctctataaagtagaaaactggttaacctaaacttgtttaacacttgctgaatacattatttagactaccacttcctctaaaacatcttcaacatctacagctacaatatagccacagatgacaataacgtcccacttcatggaccaggaaaatgctaaatcactaagaaagttttatgtagtgaaactcagatgttccaatagtaataaggatggaatttaaatgaaactaaatctcaaagttgagaaactacattgagaaaggcatgacagtgcaaaaactccacatattacaaaactaatatatgtgcatacaaatacagggcatggacataataagaaatttccatttatatactaataagaacaaagatattttctttctacttaggtttgtaacagtagtaagaagccattctccatttatcccttcctctctcattctttaaatttccttttcttattttccaaatactaaaacagaaatactaaaagagttttgcattgctgcatatatatttttcattgtcttactcccttaattttaacaacgaaaccttaagatacaccaaaatgtctgggcttttggtcatcttccttcaataatttaaaactctatcaagtggaagtcttctgcattaccacagtgtgctctgcacatacaagggcctggtgtcaattctcacaatcctctattcagatttaataattggactgagagcatactgaagatagtggtcatttctaattctgctctgtatttacaggacttggcacaaagcaggccctcccaaaacaaactgtctatgaatcaaacgaaagaccttattttgccttttctaaaaatctcttgccctaaccaggtattgtagctctgcaattcctgcgtttttttcttcacatgagattgcaaacataactgagtgtatgctgataatgccaaattaccacaactcttcatagttcaatgggagaaaatttttcttcttactgaagattttatatttctccgaaaccttttatgcagtttaaaaaaataaaatgaacatgtttctggaataaaaataacaactgagttaccttttttcagttttacaaactgaagtatacactctgttttcaagtgacctcaaaccaatacattctgattaaatgaaaacttgagattttagtcaaagatttaaagttgtttatcaaactaacaccggaagataaacagaagtagggaagccaacagtttatcagttctaaattatccaagtagaaaaaaaaacctacctcttgttatcctctgttccacttaaaaatgttttcaaaagtaaatattatacaccaaatgcaaatgttagagtacagatgaccattttttttctattttcctgtagattctaaacttttttaaaagactgagtatgtatgcatttcttttatcatgaagaaaaattttgaaaagaataaatgactaaaagctggacatcagcattcataagaaaaatttttctgaatttaacagtagctacacacaattcagtaaaaagttacaacccttcctctggcatatattcaacagcatggaaataacaatcacagttttttttaattgaaatgcatttattatattcataaacatggatttatatttgaatatacatataaaaactgcattgaaggcccttcagtgatctcatcccaagcaactctgcctgttttatttccacatacttcccattcaatattagacaaattggatcctctcataagtatagtgcttttccacatatattctttatttattttgagccactgctacaaataaataacatgtttcccatctgtacatatctgacctaatctatatttcaaagtctagccttcttcttcctggtagaatctatcacagattctctctcagaaacaagtaattctaccttcctctaaactctcctatacagcgttttagcatttttcactttgtatgttatttacaaacttttcttaatgcctttaaagcccttaaagtcctgtaagttccttggactgaaagtaatggagatcattccaagatggccgaataggaacagctccactctacagctcccagtgtgagccacgcagaagacgggtgatttctgcatttccaactgaggtactggggtcatctcattaggacttgttggacagtgggtgcagcccatggagtgtgagctgaagcagggcagggcatcgcctcactggggaagtgcaaggggtcggggaattccctttcctagccaagggaagccatgacggtcagtacctggaacatcgggacactcctgccataatactgtgcttttccaacggtcttagcaaactgcacaccaggagattatatcccatgcctggctcatcaggtcccatgcccacagagttttgctcattgctggcacagcagtcccagattgaactgtgaggctgcagcgagtctgggggaggggcttccaccattgctgaggcttgactaggtaaacaaagcggctgggaagcttgaactgggtggagcccactgcagctcaaggaggcctgcctgcctctgtagattccacctctgggggcagggcatagctgaagaagaggcagcagaaacttctgcagacttaaacgtccccatctgacagctttgaagagagcagtggttctcccagcatggagtatgagatctgaaaatggacagattgcctcctcaagtgggtccctgacccctgagtagactaactgggagacaccttccagtaggggccaactgacacctcacacagctgggtgcccctctgagacgaaggttccagaggaaggatcaggcagcaacatttgctgttctgcaatatttgctgttctgcagcctctgctggtgatacccaggcaaacagggtctggagttgacctgcagcaaattccaacagacctgcagccgagggtcctgactgtaagaaggaaaactaacaaacagaaaggaatagcatcaacatcaacaaaaaggacatccacaccaaaaacccatctgtaggtcaccatcatcaaagaccaaaggtagataaaaccacaaaggtcaggagaaaccagagcagaaaagctgaaaattctaaaaatcagagcacctcttctcctccaaaggatcacagctcctcgccagcaatggaacaaagctggacagagaataactttgatgagttggcagaagtaggcttcagaagatcagtaataataaacttttccaagttaaaggaggatgtttgaacccatcgcacataagctaaaaaccttgaaaacagattagacgaatggctaactagaataaatagagaagaccttaaatgacctgatgaagtggaaaaccatggcacaagaactacatgatgcatgcacaagcttcagtagttgattggatcaagtggaagaaagggtatcagtgactgaagatcaaatgaatgaaataaactgagaagagaagtttacagaaaaaagagtaaaaagaaatgaacaaagcctccaagaaatatgggactataagaaaagaccaaatctacatttgattggtgtacctaaaagtgatggggagaatagatccaaattggaaaacactctccaggatattatccaggagaacttctccaatccagcaaggcaggccaacattcaaattcaggaaatacagagaacgccacaaagatgctcctcgagaagagcaacctcaagacacataactgtcagattcaccaaggctgaaatgaaggaaaaaatgttaagagcagccagagaaaaaggtcaggttacccacaaagggaagcccatcagactaatagtggatctctcaggagaaactctacaagccagaagagagttggggccaatattcaacattcttaaaaaaagaattttcaacccagaatttcatatccagccaaactaagcttcttaagtgaaggagaaataaaatcctttacagacaagcaaatgctgaaagattttgtcaccaccagacctgccttacaagagctcccgaaggaagcactaaacatggaaaggaacaattggtaccagccaatgcaaaaacatgccaaattgtaaagaccattgaggctaggaagaaactgcatcaactaatgagcaaaataaccagctaacatcataatggcaggatcaaattcacatataacaatattaaccttaaatgtaaatgggctaaatgctccaattaaaagacacagaatggcaaattggataaatcgtcaagacccctcagtgtgttgtgttcaggagacccatctcacatgcagagacaaacataggctcaaattaaagggatggaggaagatctaccaagcaaatggaaacaaaaaaaagcaggagttgcaatcctagtctctgataaaacagactttaaaccaacaaagatcagaagagacacagaaggccattaagtaatggtaaagggatcaagtccacaagaaaagctaactatcctaaatatatatgcacccaatacaggaacgccgagattcataaagcaagtccttagagacctacaaagagacttagactcccacacaataataatgggagactttaacaccccactgtcaacattagacagatcaaagagatagaaagttaacaaggatatccaggacttgaactcggctctgcaccaagcggacctaatagacatctacagaactctccactccaaatcaacagaatatacattcttctcagcaccacatcgcacttactccaaaactgaccatagttggaagtaaagcactcctcagcaaatataaaagaacagaaattataacaaactgtctttcagaccacagtgtaatcaaattagaactcaggattaagaaacttgctcaaaactgcacaactacatggaaactgaacaacctgctcctgaatggactactgggtacataacaaaatgaaggcagaaataaagatgttctttgaaaccaatgagaacaaagacacaacataccagcatctctgggacacatttaaagcagtgtgtagagggaaatttatagcactaaatacccacaagagaaagcaagaaagatctaaaatggacaccctaacatcacaattaaaagaactggagaagcaagagcaaacaaattcaaaagctagcagaaggcaagaaaaaactaagatcagagcagaactgaaggagatagagacacaaaaaacccttcaaaaaatcaatgaatccaggagctagttttttgaaaagatcaacaaaattgatagactgctagcaagactaataaagaagaaaagaatcaaacaaatgcaataaaaaatgataaaggggatatcaccactgattccacagaaatacaaactgccatcagagaatactatgaacacttctacgcaaataaactagaaactctagaagaaatggataaattactagacacacaccctcccaagactaaaccaggaagaagttgaatccctgaatagaccaataacaggtactgaaattaaggcaataattaatagcctaacaaccaaaaaaagtccaggaccagacagatccacagctgaattctaccagaggtacaaagaggagctggtaccattccttctgaaactattccaatcaacagaaacagagggaatcctccctaacttattttatgaggtcagcattatccttgtaacaaagcctggcagagacataacaaaaaaagagaattttagaccaatatccctgatgaacatcagtgtgaaaatcctcaataaaatactggcaaaccaaatccagcagcagaatcaagttggcttcatccctgggatccaaggctggttcaacatacacaaatcaataaacgtaatccatcatataaacagaaacaaagacaaaaaccacatgattatctcaatagacgcagaaaaggccttcaacaaaattcgacagcccttcatgctaaaaactctcaataaactaggtattgatgggatgtatctcaaaataataagagctatttatgacaaacccacagccaatatcatactgaatgggcaaaaactggaagcattccctttgaaaactggcacaagacagggatgccctctctcaccactcccagtcaacatagtgttggaagttctggccagggcaatcaggcaggagaaagaaataaagggtattcaagtagaaaaacaggaagtcaaattgtccctgtttgcagatgacatgattatatgtttagaaaaccccatcggtctcagctcaaaatctccttaagctaataagcaacttcagcaaagtctccggatacaaaatcaatgtgcaaaaatcacaagcattcctatataccaataacagacaaacagccaaatcatgagtgaactcccattcacaattgcttcaaagagaataaaatacttaggaatccaacttacaagggatgtgaaggacctcttcaaggagaactacaaatcactgctcaatgaaataaaagaggacacaaacaaatagaagaacattccacgctcatggatagaaaagaatcagtatcatgaaaatggccatactgcccaaggtaatttatagattcaatgccatccccatcaagctaccaatgactttcttcacagaattggaagttcatatggaaccaaaaaagagccctcattcccaagacaatcttaagcaaaaagaacaaagctggacgcatcacactacctgactccaaactatactacagggctacagtaaccaaaacagcatggtactggtaccaaaacagagatatagaccaatggaacagaacagagccctcagaaataataccacacatctacaaccatctgatctttgacaaacctgacaataacaagaaatggagaaaggattccctattcaataaatggtgctgggaaaactggctagccatgtgtagaaagcagaaactggatcccttccttacaccttatacaaaaattaattaaagatggattaaagacttaaacgttagacctaaaaccataaaaaaaaaaccctagaagaaaacctaggcaatatgattcagaacacaggcatgggcaagaacttcatgactaaaacaccaaaagcaatggcaacaaaagccaaaattgacaaacgggatctaattaaactaaagagcttctgcacagcaaaagaaactaccatcagagtcaacaggccacctacagaatgggagaatatttttgcaatctactcatctgacaaagggctaatatccagaatctacacggaacttaaacaaatttacaagaaaaaaatcaaacaaccccatcaaaaagtgggcgaaggatatgaactgacatttgtcaaaagaagacatttatgcagccaacagacacatgaagaaatgctcattatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactagttcaaccattggggaagacactgtcgcgattcctcaaagatctagaactagaaaacaccatttgacccagccatcccattactgggtatatagccaaaggattataaatcatgctactataaagacacatgcacacatatgtttagtgcgccactattcaccatagcaaagacttggaagtaacccaaatgtccaacaatgatagactggattaagaaaatgtggcacatatacaccatggaatactatgcaaccgtaaaaaatgataagttcatgtcctttctaaggacatggatgaagctggaaaccatcattctgaggaaactattgcaaggacagaaaaccaatcaccacatgttctcacccataggtgggaactgaacaatgagaacacttggacacagggtggggaacatcacacaccggggcttgtcgtagggtggggggaggggagagggatagcattaggagaaatacctaatgtaaatgacaagttaatgggtgcagcacaccaacgtggcacatgtatacatatgtaacaaaactgcacggtgtgcacatgtaccctagaacttaaaagtataataaaaaataaaaaataaaataaaataatgtcttattcatgtgtatatttcatataaatggctgccagaggcttctgttcatagtgttcaacaaatatctggtaaattaatgaattaacactggcaaaaactgaagtacagaactaaacaaagagaaaaaataaatggctcttaggatccagtttccatgaatttatgaatcataatggcttttaaaacattcaagtacacagaggataagaaaaatatataacagataatagtagtttgtataaacactcattagatcgaattgaaaatgagattttatatggggtgttctaagcttctgagaagagcatactgaagccattcaaacaagaattggaattacctagatctgtgccaagagtatattctgacataccacagatgtttaactcaattgggtgaaaaaagttaggagaccagcctggagaaaaaaatactatgctacaaaaagtgagaaggctttatcaatgcatatacgagttataaaactaaaaacacatttggaatcactgaaatctttaaactaatttaagatacttcaatattagcaaatgggtcatttcccttttgtgtctgtactacctgtcatccctgtcacattgccttacaaagagtgagctcccttgtcattaaacaattccctgtttagtatagccaaatagaatatttactgcaaaccagtctcagagaagaaaaatgaagtcagtaaaggtcttcttaacaacaagaagtgttcttcaaaaaatcaacaattaacttaactgcttcaccccccacaaaattaaggccacatactgtatgattctacctaaaagactggaggttgccagaagttagggaaagggaaggatgaataggcagagcacagacgatttttagggcagtggaaaatactctataaggtactataatgatagatatatgtcaaaatacatttttcaaaactcatagaatgtacaacactgagagtaaaccctaatgtaaaccatggactctgagtgataatgatgtcattgcaggttcaccaactgtaataccactctggtgagggaacactgatagcagaagaggctatgcataactgcaggtagagaatgtgagggaaatctctctaactttctctcaattttgctgtgaacctaaaacttcttttaaaaagtattttttaaaaaaccaaagctttaaacatgtattttaaaaagtatatcagattatttatttgcatattaacaaatatggtttttatatgttagtacctcctaataaaggaaacagtcagtggtgaaataagcaaatcaacaggcaaataatagcataaactacaagactcatgtattagtttgctaatttttaacaaataatacctcagaaattctcaagtcattacacttagtgggcaagaaaagggcattgaaaatataaaataactgataatccaaaatgaaaaacacttatttgactttaacaagcattaaataattttcctatattgaccttacaaatcttgttaggttaccatattttaaaacatttttcaagagtaagggtacaggcagaaaccaaggacctgacggcgttgatagtgcagtgattgacagaaaatgtttctctataaaaatgtatttcatgagcatttgcatgtactgggttgagtaataccaaggtcataattggaagtaatgtatgtgaataatattagcattaaaaaccaaaattcttaaattgcctacaaatcactgtatgatttgacccctacccacctcatcagccacatcagccacatattgtgtgactcactctggtattctgtcttctcaaaattcattaaatattccaagatgcttgctcaaggcctctgtatatgctattctctctttgcaatctataacccaagtatccctgtgatcatttttccattactcttctcattctactattcaatattcatagttacatatcatatctggataaaataattatgtaataattgtttaattcttctccaggggacactatgctctatgagggcaaggtccatgactgtcttattcactgctatatctccaacatctatcatagaatacaaaaacatttaacaaatgtttggacaactaaataaataatcaaagatattaacattcatacatatatagatagtataccttcacgaatcttaaaataaaataaactgtacaactgctacaaaacttacttcatagactgttagcattttagaacttaaaaggaccttagagaccatgtaatcaaacatcttcatttttcagataagggagaataaataaatgatctaaggtcacatacagttaattagctatgaaccaagacaagaagccaaatctcctgactttcaagacaggcaccactctaattcctctttcagaactaactctaacagggatacagggagaaaaaaggtattaataagtgtctttatttttgacagttttggggtaattttttttaactttcagaatactttggaaaagtctttcctcatattttatgtccacatattaaatgttaaaactgactttaaaatatgaaaactaaaacaaaaaatgtctcatacagaggaaggcttaattacagcttgtgtatttctgcaaaatatatcacattagtctaccaaagcaaggattaaaatcttgttaaaattcattttagtgttttaggattattgtattcaaatacaacgctacccttaagcaaacaagcaaatggcaaagaagggtttaagaatcaaattggagaaaactcattcctttaagcaaaaagttttacctttgggttggaacaatcttcaaccttgatactttaataaattggtatattagaccctcaaataatcagcatttctgggttttaaatccagaaataatttaaagtaaatgtgacctcagtcttcacatcattatattttaaaagcaagaaaccttgacttaccattattaacaacctctgttatctgacaggtactaattaactagtgtagttctattctattttaatgaatacctatttaaaatgtatttcaatagcagaaaacacttcacatgtcaggtaaaacactaatacctaatgtaatgtacatgttttgtagatgtactatacatgttttgttaattcatagcataacccttttatactgtttctcaaataaacatttaatataaaaatcttaaaggataaaggtgaaatatatttaaaatataaacaaattgatctctgatattcgatagcatgtatttatttttaaaacacatctctaaaatatccaagatatattaggtaaaaataaagcaaccttgcaaaaaacagatagttacttggtgaaaaatatgcacatacaggcttatccatgcccacagacacacacaaaagcatgtgcacatatatagacacacatataaaaaacctggaagggtactaaaaaaagcatagcagtgttttttacctgaagaatgggactaggaaatggcaagggattcagtgggaatgagggaacttttgcttttcagtttatagcctgccatactgtctgaatgtttttaaatcatgactacacaaaaacaacaaaatcttctcagacaaatatttgcaagattgtcaagtccataatactaccatgaggtaagaaaaaaaaggtgtggagatagagcggtttctctacttattctaagtcctttaacaaatgttagccttagagggttatcttcataataaaagtgcttatcaccatcatcacagagggctaacagttaatacttaaatgaaaaacatatacgaagacactttgcaatctgtaagatttcatacaaatataatattattagttaaattttaattctgaaaaaaactggttaaatgttaaaaattggctataataaacgtttgaaaaagaaacagtggtttttactatctaatggctctttaaatatagaccttatttgctattgaactatgtaaaataaacaaaggataggaaaagaaacagaaaaataagttatttaatctccttacctcacaagaaattagaatttgcatctctttacatcatacctcaaaacatctaaaatgttaactagaaaaaccctttaagttatgaattcccaacaaacataaacacacataggtgtgtaatacagacaggtatacaatcagacacaccctaagagtcatgagaaaaagcataacacattgatacactcaaatacatttttaaatgtattcatacaaatataatgtacacacacctctctcagagcaactctacctacatttaccccaacactattttctgtattatgttaaaacaaatgtttcaaaaattctttagtgaatgagattttgtattcatatttgcacctgacatttatttaacattcataaatgcaaaatttttataagctaccaacactgaattcttaataatttagaaatgtcatctcaaatattaataattttaactaagctgaaataaagtcttgccttcaagaggaagaataatacaaataacagtaatgacagcagacctttactggggccaccaactaacaaaagcaccttatcaaaatagatatttacaaagggattcatttggagcaattaattcctatctgacatcgcctcaagcaggcatgattgtgtgtatgtgcactcacgcttttttctgttttatttcctagtgtccttccctgatgactgtcaagagacttctttgtagtatatttgtctctagaatttttgtgccacatcgactagattagaactatatttcaatcaatattttaaaaattttatcagcaatcaatctcagagaaatggtccgatgatttgttctatgagctttaggacatgaactgtatggcaaatgcattacttccctaaattctaaagcaaggttttaagatataccgctgattagtaacagcattgcagatggaaaactaacacgacactgattttccttttctttgttcaaagtagaagtgagaaaaaaattaactgatttaacagttcttcacagcaacttgagcaaaaaagataaaatctgagtttgacaatgtatcacaaaattcttgtaacaaggaaataaaagcagatgttctaacagcttgcttgaaatggatctttattccagaccccacaggttttacaaaaatggtaccatttctcaagggcattgaattatttaaaccaccacaatttctgcaactactgtatgtcatagctattcagaattctcagctaatccaaaacccttattttatatttgattaaatttgaatctggcaacattcaatgttactcaagggccaataattaactgaagaaaagcagagattagaagctaaactactgggctcagggttcagatgtcttccctctactctcttcttcctcactgaggctgtatctaattacaataatagtaatgacaataataatagttgctatgtactgagttcccactatgtgctagtagtggctatattctgtcttgagttctttcaacaatccagaaaagcagatatcattacctccatctttaaaattgggggaaaaaaaaaaaactcagtggaattaagggttttaactccaagtcacacctgctgggttttagataccctgagcctctccttgacataaatgaaacatacactcacactgcagaacctttgtacttgctaagactgttctagaatactcttactttaaatatctgaaggatcacttcacatcacttctttgaagtctcttatcaaatgttacttgtcagtcttttcttcaccaccagataaatatataccttccctccccttctcatgtttacagttctgccttacattctccatagcactgtttccaactagaaaaggtatatatttactttttttggtttattgtctttcttccctagaacgtatgctgcataaggacaactttgtttggctcatcggtgtctaggaatagggcctgactcctcataggtattcaatatattgtttaataaatgtgtgaatggcttaatgaatacatgcaaattctcctatttccttcaggaagcacagatgtattcagagtaatatttcaaatacaaaagactagcaaggtatactgcagaggctccagttccagaaagccaacagagggccacagcctcaaaagataagatactccccagaatgccaggaccactgtattagtccattttcaagctgctaagacatacccgacactgggcaatttacgaaagaaagaggtatattggccttacagttccacatagctggggaggcctcataatcaaggcggaaggcaaggaagagcaagtcacatctcatgtggatggcagtaggcaaagagagagcttgtgcagaaaaactctcgtttttaaaatcatctgatcccgtgaaactccttcactatcatgagaacagccaaggaaagacccgcctccataattcaatcacctcccaccaggttcctcccatgacacatgggaattgtgggagttacaattcaagatgagatgtgggtggggacacagccaaaccatatcaacaaccatcagtattgtatttcttctttgaggatacactaaatcaaatcacctatttttttaattgaattgcttatctttttgttgttgaatttaagaagtcctttatataatcctggatagcaaatcctcattagatatatgatttgcaaatattttctcccactctatacactgtcttttcatgttcatgataatgtcctttgatgcataaaatttttacatttttatgaagcttaatttatcaatttttccttcattgctcatcccttttgtaacatatctaacaatccattgccaaatccaagctcatgaagatttgcctctgtatctctgaaggattttatggatttagctcttatatatagatgcttaatccattttagttaaattttgtatataatgtaaggtaagaatctaatttcattcttttgtatgtggaaatccagttgtctcattattatttgttgaaaagacaaatggtcattcttaaatggagatagttttattccttcccttctaattggaacgtcttttatttcttcttcttatttaactgtttttgcaattgactgaacatgtgatccttgtcaaaaaattacttagccatagaagtatgggttttctgtaatcccagcactttgggaggccgaggtgggtggatcacgaggtcaggagatcaagaccatcctggctaacatggtgaaaccccgtctctactaaaaatacaaaaaattagcaagacatggtggtacgcgtctgtagtcccagctactcgggaggctgaggcaggagaactgcttgaacccaggaggcagaggttgcagtgagccaagatcctgccactgcactccagcctgggtgacagaacgagactctgtctcagaaaaaaaaaaaaaaaaaagagtatgggtttatttctggactcaattgtactccattgatctctgtctatccttatgccagtaccactgttttgattactgtagctctgtgataagttttgaaactgggaagcctgagtactcagactttgttgttcttttttaaggttgttttcgcaatttgaagccccttgaaattccatacaaatttggggattggtctttacatttctgcagcaaagttttataattctgatggggactgtcttgaatctgcagctcattttaggtagtattgacagcttaacatatcaagtctttctacacaagtttctgctatgtacaaggcactaaccacagaaagtaccaaaaaaagaaaaaagaataaaagcccttcttctgacatatagttagccctgtatctgcaagttttgcatctgcaaattcaaccaattcagactgaaaaatattcagaaaaaatgttttttaaaaaattatactacaacaataaataataatacaaatttaaaaatacatagtctagctatttagatagcatggacattgcattaggcattataaataatctagagatgacttaatgtcaatggtagggagaatacacatgggttatatgcaaatattttgccattttatataagacttgagcatccacagatttttatatccatagggggctcctggaactaatctcatgcatatacagagaaacaattgcaactcaattttctacaagtatctgttacttaataaatgtatttatatttaatttattcagaaaattaatttatttctcataactcccctatgctctaccaccttaacttgctttttcttcagaccacatttctacctcatattactttatgtaattattcactgcatttcctcattcccctaaaatgtaaattcaataagacaagaactaagttttgttcacagcttataaccccagtacctagaacagtgtctgatatatacttagtagtcagtagttgtagaattttgtagtttgtttcccatttgctgctccagactgttctaaccaaccacaggcttcagatgagatctacttttgtccctaagtgttacaaagtagcccttcctagcttaccatgattacttgagggctatatggagaaagaattctccctgtgtaagaacaacacctaggtaacaaatacagctatgtaacaagtacatctatgtaacatgttaaaagccaagttttaagacagttaagctgctaagatgtttaagtcacataagtgaaactagaagcagttagctactgcaatggtctagatatgagagtaaagggctatgaagtagaatacacacacatatatatatgaagtcacatatttatatattacagggaaaaagataagtagaaatagtttgcttatactatataccttgtagtccaatctgcaaaacagctgttttatttccacgataagttaaagaagagataagtgaaagttttccctgaaatgagaaaaaaaaatagttacaaagaggagtcaaaggagtttataataaaaccaagatagaaataaaaattagaattttctatagcaacagttttctttcaagaagtcagagtactgtgttcaagtaactattttaagacaagaaactgttgaatttgtttttctagagaaaaatcagatctacaaatacttcaaggtttataatataatttcctaagtaatcctattagttaagtactatcagttccttattttgcagataactagatcaactttccctagctttgttttaatctgtaatattgttctctacaaaacaataaaatgatgtttgctcctagaaagaaatgaaaacttaataaagatttagaaatgcaaaatggaaatctcatatagtgtggacaaatcaacagattaagacacaagtacagtttagtctttgttcagtttctgtaactaaccagctctgtcagtttaaaaaaagttacttagattatcagataaaataaagtttttaatctggatggtttttgtaaataaaatttaaaaatagatcctattagcctcccaggctaatattccagactttgatatagctaataaaaaatagatcaattttacttataaaataggactcaattttacttatacatcaattttacttataggaacataaataaaaatatggttatcaacaaagcatgattcatagtcaaaagtaaaagtagttacacttaaaagatagaaagctgaaaaaagtgtcaacaataaaaagttaatctgtaaatctcagaacctttcttgacccatcagagagttgaggtcacagggcaaccaactaagcagaaatctgaggaaagcaagtaattctcattacttctaatgagaataaaacaattgttttatttctatgataagttaaagaaaagtgaaagatttccctgaaatgagaaaaaaatagttacaaagaagagccaaagtttataatcacaccaagatacaaataaaatttttatagcaacttgcttacctaaggtaaatgacaaatgttcccagacatctgtaagaaaaattcatctaacactttaatgaattgctagaggccaagtatggtgcaatgaaaacacatggagcccccaagctgcaaacacaggggaattcattcatttacatgcgcttctctacagacctgacaaggttcaggacagaagtagggcaatggcagcagcagttactgcacgaaaggctggaaactctgcttggctctttctcctctatctttctttcagaacaaaggacttaaaatgctgggagaagggcaaaaaaaaacatgtcaatccaagaccattggtgaaaacccactgcagctggaaggcaagaacagaaaaaaacaccttctatccctgttagggatgggcaggaacgggtacataggtgtaaggcccagacctatacagctagaggcaaagcaggatcattgagaaggccccactcacaagacccaggacctactgctaccaagacaggcttcatcagaacagagaacatctacctattaaaggctaaccagtacctagtaaaaagtaacatggtctactactggaagagaagctcttgagcagggaggagatcttatttgaggcaaagcacaaaggaaagacctaaaactaaggatggggaagacaagagaaaaatcctctcgtcaaccatctccgatcctacatacaaagtaactctgaggaatatgaagcctctagtgcattgaagcaccaaaaacaacaacaaatcccaaacctaactctaaacccgactagattaattcaatgcaccaaactaaaggcctagcacaaagaaagacctacacatgcccagaaataaaaactaccccagtctccactgtcctccacaagacgtacagctttgaacaataacaacatatgaggcatacaaaagaggcaagaaaaaacgcaaagcaatcaagagaaccacaatcaattagattaaaagacattaatcaaattaaactcaaagcaggtgcttttgcttcacttgtatgtgatccaactagaagaaaagtctcagagtagaggggataatcagaaaaaatataaagttatagttattggaatgggccacactggttttagaacaatgaaaagagagcaaaaagcacctaagcatgtaggaagacactcctagcacctgcgaaagggccctagcacctggagaagaaaactctagaacttggaaagggaatcccttaggtcccaggaggtgtaggggaggggaggcattaatcatctttgtctttcagaactccaggaacctcctttcccaaggaaaaatattctggtgctactctcagaaactactgggaaatttgaaagtaaatcaactgctaagcctgcctaccatgtctcacccaactgctctaaccatgagccagcagggcatggcccagctcctgcagcttggatgctgattacttccaaatgccatccataactaggacaaatggattagtaaattaagacaaatttaacaaactgccctgaggcagtctctctgaaaaccagaccaaactaaattaccgggactaaactaggggccttaggagactactagctaactaataacacaagaggcactgtcaacccatgctgcctgcctatctattaatacacacttcctagaggggggaccaacaattataaactgtttgttttcaggggtagcatgtgtgccactgggactgcgtttcttgtgtgaaaggcagaaactaaccaaataaacagtgtgacttgcacctaggagtagtaataagaaacataagaaacattcaagtcttcagtaaacgacctttttgggtgatcatgctatacattatgtcaacagttttacctacaatggaagttattccattagaaaggtggtaggaaatttgtccctgcccttgttgaagtgagcaaagaaaactggaacctgagttaaaagacaagctttgaaaattaaaggacactgagagacttccagagagactgatgtcccagaattacatgtttacaattcaacagatgaaatctatagctattcccttaaattccaaatgacgtatttacattaaggaaatgaggtttctctccctctctcgggaggggtaaagctgaatagctgccctatataaactcctagatgcatcatttcagccttcctctctgagagtacaagaaatccccttcacacagcaggaagacatctggccctcactgcatcactctgaatggggaggatgggcagggagttattgctgagaataatataattatgtggtgcttaacaacagggatacattctgaaaaatgtgttgtcaggcaatttcgtctttgtgtgaacatcagagtatgcctaaaccaacttagattgtacagcctactatacaccgaggctatacaatatagcttattgcttttaagctataaacctgtacaacatatacggtattgaatactgtaggcaattataagacaatggtaagtatgtatgtatctaaacatataaaaacctagaaaaggtagagtaaaaacacaatactatgatgttatgggatggaccaccatcatatatatgcagtgcagtgttgactgagatgttgtatatggtgcataactgtaataagagtctgcctgtattctagaaatcctgtttgcttttaggacaaaaatgaattagtatagatataaaaaatgtaacacatcctgttatggacttaattgtgttctcccaaattacaggttgaagctctaaccctcaacaactctgaatttgactgtatttggagacagggccattaaataggtagtttggttaaaaagaggccattagaatgtgcctcttttgtgccaccagtctgactggtatccccaaaagaaaatgggacacacagaaacacaacagagtctcaggcacgtacagagaaaatgccaggtgaagacacagcgagaaggtgagcatctgcaagccaaggagagagacctcagaagaaaccaaccctgcagccactttgatactgatcttctagccttcagaactatgagaaaataaatgtttaagccacccaatctgtggtactttgttatggctgacctgacaaactaatataccctctttaaaaactggggattttctaagctcagtgcccctcagatgtgctacaaactccgtgtgcacgttatgtacctgtccctgcccccatgggacttggggaggaaagaagaaccagtgcaaacataaagttcatgttccctgctgtgccaataagtaatatactacctaaatctatttgggtgccttgcctccttaacagctgaatctagagaagtgtagcatgccaacctatgagctatatcacatactgttgcttaggaactatttgaacatttgacctttactcaaatgaaataaaaacctatgttcagataaaaatctgtacatatatatttacagttgcattattcaccatcacaaaaactggaaagaatccaaatattcctacactgggcaatggataaataggctgcaacaaaattctaatcaccaaaagaaagaaatactaatgaaaaaaacaacctgaaagaatgttatacgtatcatagtaagtgaaagaagccagatgcaaaaggctacatgctgtataatgccatttatatgacattcttgaaaaacaaaaaaacagtgtcaggaaattggtaagcagtcatgagtggttagagttggcaaaacagctaactataaaattttggaaggtgatgaacgaattgattgtgattgtggttacatacacatttgcacgtattcgtcaaaactcacagaagtgtatgcaaaaaacagaatgtagcactaaaatccatttaataaaattcaaaaaacatagatatctgcaggttagaaaagggtaagtacacaatagagagctgaaaaattattcagatatgtaaaagaacacaaatacttcaatctttttttttaaaaaagtgagcattctacataacaatctgttaaccatgaaaaatacataaaagctatttcctagttttaaccctagtagatactaatgtgttcacttatagctaaaagaattcattaataaaaatgttaaaattggacaggggcaatgctcatgcctgtaatcccagcactttgagaggtcaaggtgggaggattgcttgaggctgggagtttgagaccagcctgggcaacacagaaagatcctgccactataaaaaaaaaatttttttaattagctgggcgtggtggcatgtgcctataatcccagctacttgggaggctgaggcagaaggattccttgagcccaggagtttgaggttacaatgagctacaatcataccccagcactctagcctgggtgacagagcaagatccatctcttaagcaaacaaataagaaaatgttgaaacttaaaaaaatatttcactaatataagtaagaacaaaaataaaataagaacttagcaaactgtcatagtatttaacatttctatatcaagcacacaaaacaataaaagtatgtcaaaactagatgcagcttggaaataatcagtattaatgatatgtcaaaaagaaatcaaatcatagcactttattaataaatacaagtatacaagaaatatcacactaactgaccaaatgtaaaataagttgagaatgctaacaagcatctgataatcatttaaatgcaattaagtagaaaagaccagctgtaattcataaaaccttatttaataagaaagaaaattccaggaaaataaatagaaataaaacttaaaaagaaataaataggtgagtaaaatgtgtaacaaacgtctatacgaagaatatagacaagcaaaactgaaatgtagatttctctctattatcagatgcattttgtccctcaccccctcaactaaaatttaaaaactcactaaaaatgcatccagaatattggatatggcagacaaaaggttcagtgaactcaaagagagagcaacagaaattactcaactgaaaatcctctctgccacacaaataaaacacaataaaataaaggagaaaggaacagaatctcagagatccgtgttacagtatcaaatagcctaatacatgaacatacacacgtaattggcatcccaaaaaagagaaaagggtaataatgtggcaggaaaaaaaaatatttcaagaaatattatacaataatttcccaaatttgatgaaaaatactgaatgaatccaagaagctcagttacccacagaggagaaattcaaagaaaaagcttacttaagcacatgccagtccaactgctgaaactaaaagataaaacagaaaggtggcaggaaaaaaaatgcaaatcacatacgaaacaacagaatccagaaagcagtggaccggcatctctatagtcctaaaagaaaaaaaaagtcaacacagaattctatatccaataaatatatccttgaaaacaaacatgaaataaaggcattttcaaatgaatgaaagctaagagaagttatccccagctgaaatatatgaaatggtagatatttttcacaatgaagggaaataatgcccagataaaaatggatctacaggtaaaaatgaagaacaccagaaatggtaaatatgtcagtaaatataaagactatactttttccttcttttaatttccttaaaagatgactcattgtttaaacaaaagcagtaatataacatagagtttataatacatgtacatgtaaaagatcataacagttcaatgaacaggggagtgagtaaatggaatttcactattataagattcttatatttgtcaagggggaagaaaaagcaggacatgagaaataacaactgtaacatggggagtggtacaatagtagctgtaagtataccttagtaaggatgtatattgttagtactagcataaccactaaaggaacaaaacgggtgttgctcaaagccaatggtgaaaataaaatagaataaaaaatatttaacccaaaagaactcaggaaggagaacaaaaaacaggcaaaacaaagggaactcaaattgtttgacagacaaacaaaaccatatcaataattattttacataaattgactatgctgattaaatagtgagactgtcagactggatcaaaaaagcatgatcccgttatatgctaacagatacttaaaataccaaaccataagtaagttgaaaaagaaaggaaatgttcatacactcaatataagggccacactaccacaggcacccaaaatcaaagccaaagtatcttaaccaacaacatacatacatcttcagaaaacatttctttgctacaaatgcaatttcaaaaaaaatagaacaagcaattgctacactagatgcacagatatcaaaggaagggcacaggaaacatgaaaaagcagggaaatatgatatcaccaaaagaccacaacaattatctagcaatatatatcaattaaaaaaaattcctcgaaatgccagataaagaattcaaaatagtgattttaaagaagtttaatgagattcaagagaaatctgaaaaccaatacaaagaaatcagaaaatgaattctgtttatgaatgagagatttaccaatgagacagacatctttaaaaaaagaaaagaaaacggaaaccatgaattaaaaaattgaagaaaatacaaaatatattcaaaagattcaataacagattagatcaagcaaaagaaagaatctcagaacctgaagacagaacgaaattttgaaataatgcggtcaggcaaaaataggaaaaagcataaaaaggaatgagcaaagccatttgagatgtccaggactacataaagcaaacaaacatatgaattatcagtattcctaagggggaagagagattagaaagttaaaaaaacctatttaaggaaataatcaatgaaaacttcctaagtctagcaagagcatcagacatccagatacaggaggcccagctatccccaggaaaatacactgcaaaaaggacttcatcatacacattatattcagaatgtgtaaagtcaaagttaaaaaaaaaaaaatcttaaaattaccaagagaaaagcatctatctagtcacctataaagaaaacattataaaactaactggacttttcagcagaaatcttacaggccagaagagaaagaataacattttccaagtgctcaaacaaacaaacaaacaaacaaaaaaactgtaagccaaaattttatatcctgccagaataagcttaataaataaaagagatataaaaaatttcccagataagcaaacaacgcgggactcagtagtgaaaaaaagtagaaagatcacaaattaacacactagcatcacacctcaatgaaaccagaaaaacaagaacaaacgaaagtcagagttagcagaagcaaagaaataacaaagatcagagcagaactaaatgaacaaaaatccaaaaaaaaaaaaacccaaaggatcaatgaaaaaaaagttggttatttaaagagagaaacaaaattgatgaactaccagctagactaaccaagaaaaggagagaaaagatccaaataaaatcagagaggaaaaaagagacattacaactgataccacagaaattctaaaggtaattagagactactatgtataactatatgcccataaactagaaaaccaagagaaaatggataaattgctggaaacatacagcctcccaagactgacccaggaagaaagagaattcctgaacagatcaatgatgacagcaagactgtatcagtaataaaaaaatcccaataaaagaaagtccaggaccagatggattcacagcctagatgtacaaaacacaaaaagaactaacaccaatccacctgaaactattccaaaactactgaggagggaattctccctaactcattctacaaggtatcaccctgatatcaaaaccagacaaagaacacaaaaacaaaaactacagactagtatctctgatgacatcgatgcaaaattattaacaaaatactagcaaattgaatccaacagcatgtcaaaaagatcatacaccatgatcaagtgagatttatctcagggacgcaagaatagttcaacatacgcaaatcagtaagtgttatacatcacataaacagaattaaggacaaaaaccagatgatcatcccaacagatgaagaaaaagcatttgataaaattcatcttccattcatgacaaaaatcctcaacaaactagatagagaaggaacatccctcaacataataaaggtcatgtatgacaaatccacagccaacataatactgaattggggaaaagttgaaaagattccctctaagaattggaacaagataaggatacccactttcaccactcttactcaatatagtactgcaagtcctagccagaacaatgaggcaagggaaaaaaacaaaaggcatccaaattgggaaagaagtagcaaattatcatagttggctaatgatatgatcttgtatacagaaagccctcaagactccaccaaaaatctcttaggttggtaaattaagtaaagcttcaggatacaaaatcaatgtacaaaaatcagtaatgtttctatacatcaataaaaatctagctgagtaccaaatcaagaatgcaatcccatttacaacagctacaaaaataaaataaaatgcctaggaatatatttaactaacaaggtgaaagatctctgcaaggaaaactacaaaggacggatgaaataaattgtaaacaacataaaaaaatggaaaaacatcccatgctcgtggatcagaagaattaatattattaaaatgaacatacttcccaaagctacagattcaatgcaatccttatcaaattactgatgtcattcttcacagaattagaaaaaaacaattctaaagttcatatggaaccaaaaaagaacccaaattgccaaagcaatcctaatcaaaaagaacaatgctggaggtacacgttgcctcacttcaaaatgtattacaaggctacagcaaccaaaatagcatggtactagtataaaaatagacacacagataaatggaacaaaatagagaaaccagaaataaagtcaaatacttacagccaactgatctatgacaaagatggcaagaacactacactggggagaagacacacttttcaattaatggtgctgggaaaacgggattgccacatgcagaagagtgaaactggaacgtatatgtcaccatacacgaaaataaacttaagacggattaaagatttgaatgtaagacccaaaactataaaaatatagaagaaaacctaggaaaaactcttctagatattggtttaggcaaacaattcatgactaagacctcaaaagcacaggcaataaaaacacaaatagacaaatgaaacttaattaagctaaaaagcttctgtgctacaaaagaaataacagaatgaacaatctcaggaatgagagaaaatatttgcaaactatacattcaacagaggactaatatccagaatttacaagggactcaaccaaaaaacccccaaataagcccattaaaaagtgggctaaggacatgaacatttttcagaagaagataaacaaatagccaacaagcacatgataaaatgttcaatataactaatcatcagtaaaatgcagattaaaaccacaatgaaatatcaccttacaccaatcagaatgggtattaaaaagacaaagaaaaaacagacattggggtgcaaagaaaaaggaattgttatacactgtcggtgagaatgtacattagtacaacctctatggaaaacagtataatgagttttcgaataactaaaaatagaactaccatttgacccagcaatcccactactgggtatgtacccaaaggaaaagaaatcattaaataaaaaagagacctgcactcatatgtataccacagcagtattcaaaatcacaaagatatgcaatcaaccaaagtgtacatcgatggaggactggatttaaaaagtcacatatgtacacaatactatttagacattaaaaagaatgaaattatgtcttttgcagcaacatggatagaaatggagaccattatcttaaatgaaacaactgagacacagaaagagaaatactgcatgttctcactcaaaaatgtgaactaaataatgtgtacacacagaagcagagtgtacagagatggacaatggaaacttggaggggtaggggattaggagtggagtggatgatgggaggttgcttggtgggtacaagctgcattgctccagtgacagatgcactgaaggcccttactttaccacagtgctatatatcaacatagcaaaactgcacttgtttcccacacctatttacaaaataaattttaaaaattttgtttaaattatcaaaagtatcacaactcatttcttgaaagacattttctgctttcattttttcacctgacattcaatcctcaaactactgaaaaatgaatttgctcttagtgtttaagcaaaactaatctttccaagtgatcaataatttcttggttattagaatgaacagatacttttcagacctttgagcatctaatagcaacataatgctctgtttagtagcaaagacaatgggaatgcaaatcactgctcagccacttactggctattagaccttgaataaatcacttaacctgtgtttgttttccagctataaaatgagaataatacttagagttcttaggagagaacatatacaaagagattacatatacaaagcatttaggagagtgcctactagacaacaatctatacaagtgttattgaaacttgcattcttacgtatcaaagactcctgagtttcttcctccttctctagaccatctctgctacttattcatactactttctttcactgactccttcaacatggttctcttctcttctatgctttggctcaaacccatctaaatgagagtccctttgggcttcaaactccccaatccacttgcctactgcacactactatttatatacctctaaagacctttcaaatatgaccaaaattgaacttatcatgtttctccctaagtatgtaccccctattttcttctccttgttggctaggaattagaaacagaagtttcctgaatttctctttgccactctagtctaattgttctctaagacctactgattctgcttctttatcctgtcaggtctaaaggaaatcatctatattcaaattcctgctctacttcatatcatcaatatgatctcaggcaaattgcttaacctttctgaaacacagtgtctttaataacagtacctatgtcataggtctttgtgatgattaaataatatacgtaaaaactacctaacgcatggaaaaaaatgcaatgaatgttaactttagttattattattactatcttttttcaatatccttcccatcatcccctctgccactggcccagatcatcatcaactctcacctaaattactgtaattgcctcttaactaaacatctttcctctaatcttgcattcgccaatatattctctacctaggagcaaagttttttgaactcaaagtaaatcatgtctttctcctgctaaaacctactaaagacttcccatagcttttagagtaatatccaaattcctcaacatgcacataaggactgctttttacctcaaaggaaggtacagcacagtctgttatcccgtaagttccagctcaactttcgtgatctgtcagaaccaaaagctctctcatgttcacacatcacaatgctaatatcacacctattaattttaattggagatcaggtgattgatctgtcagaccccacagaaatgtgattatctttagttccgggactatatttattcatctttgtacctcagaaacttactccaatgtttcacacacgaatttgataattgttcgctaaataagtactgaataagaataacttattgaaatattcaatctcaaatgttatgacaaagataaaaaccatacctaaaccagttctcataaataaactcaacacttaaaaactgcattccttttagtaggaaaaagcattctgagttatagaaattcttacctgaatatatttcttgctataattgtaacctggctgtagggatccgaaatctactttatgtaatttactcagcggctgaacttcaggcaccccattgacttcctttattaattcaagtggcatatcagttctgcttcacactgatgtccaaagcaaattcaactagggaatctgacaacttgctgctgaaaatacaaaaccagtgttttacccaaaatgaagtcaataatttgctttaagtctctttgacttagttatgcttttccttattatagttaacacggttcggggttggggggtgacaggaggatggattattttacaattttattgcaaagatcaatacaaaacattcttccaaggaactgaaacttaaccattttctacttagctgcgtaaagtacctccaaaaagccagttttaagatctgtaacgtcactaacaaacgcttttaacattgtgctttaaaatgtaaaatttattggggaagagggaggctgaaaaatcgtgtttttttttaacccccacgggagctgtaatattgtatagacaaactgtgcaccaaaagcatcgtactccaacatgtttctgtggccccctcccttcacccgctaaataaatgaagaaacaaaaattactgaactgagattaacttctgcatcgtaggctcaaccttatttcacagacctcttgacggggacactcactagtgtcgatatctaattttaatgtttgcgcaccaaccttcccccaagccacctgagctctgtgagggcggggacttggacttaactcctgtctgcttctcccaaaacaccaagaaagatgctgaacacagcaggctcgagataaacactcgtaagaaagcgtttctctgcgataattacatcaaattttgatctaaactaattcaatcccgggcccgttacgtctggcacccactcaaatgaacacaccaaaccttacaaatttcactcacccgtactctagaaagaaccctaggaagagtttaggcgggcgcgcaggtgacgtcacacgcacgctgacggttcagctccacgcatgcgtgcaggatccctgggcatagtcgcttgttctccgcccgcggtggaccagctgcgtaacggttcacacactgatggcgcctggaggtttggcgaaatactgac

SEQ ID NO: 139 - DNA, 107599 bp, Homo sapiens; identical to SEQ ID NO: 138

SEQ ID NO: 140 - DNA, 107599 bp, Homo sapiens; identical to SEQ ID NO: 138

SEQ ID NO: 141 - DNA, 107599 bp, Homo sapiens; identical to SEQ ID NO: 138

SEQ ID NO: 142 - DNA, 107599 bp, Homo sapiens; identical to SEQ ID NO: 138

SEQ ID NO: 143 - DNA, 551953 bp, Homo sapiens
taggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatgtaagtgaacataatgaacctcatgtgcacatttacttttatttatttcaagtaagttttgatgtgttcccatagacgctgaaacctaaagaatcaatcaacacactgcataattttacttggtcttcttcagagaagtctggtcaagatagtatcaagccagggtgttgtagtaagtttgtttatatgaaatcaagatgaccaatatgttattataagaaagcaggccgggcgcggtggctcacgcctgtaatcccagcactttgggaggcggaggcgggcggatcacgaggtcaggagatcgagaccatcctgggtaacacggtgaaaccccgtctctacaaaaaatacaaaaagaaaaaaaaaattatccgggcatggtggcggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaacaaacaaacaaacaaacaaacaattatgccttaaaatttttgcactcttcagcttccttgttgtcatgtacgtcttcaaagataagagaattgggagatttcaggatgctggaatcttatgtatatagctatatatattttctcctaaataatagctcatgggcctgtgtctttcttttggtaaacaaaattgtacttttctttctttcttttttttttttttttttgagacagtgtctcccgctgtcacataggccggagtgcaatggcgcgatctctgctcactgcaacctctgcctcacgggcttaagcgattctcctgtctcagcctcccaagtagctgggattacagacaccaggcccagctaatttttgtatttttagtagagacggggtttcaccgtgttgcccaggctggtcttgagctcatgacctcaggtgatccactcgcctacaatttcttatgtagctatcccaatgaagtttttcgttctcaggcatctgcttctgatttacagtttgtgctaagaaacctggaacccccggatgctggaaatgtataactccaataggaaaagactaggagaatcctaagacccatattttttattttttgtgaagtgccttgagctatgagcagtaggactttagttaacaatgggattttgtactggccaccaaatagttttatttttataaaatgatacttcaaaaagccctcaaattaaatgcaatttgaaatacacacacaaaaattcaagaatgcaaatatccatacctgttccatttttgttttgaaatatctaattttggaaacttttcaaacatattgaaatacctcaataccaaattttattgatttttttcccccaacagacccttttatggtgaatatgactggcattattctcccattttcaagataaagaaaatgatgcccaaaaagtttaggtgaccaagattcagacaataaattaatggggatgctagaccaggtcctgaatcttctaatttttatttttagggaattgtgtcatatttgaagaaacactctaaatgaaatctggtctattttaaatatataaaaattaagaaattttaatttttcatttttaaaattctatctactcagcagcaaataaggtgtttaaatccttaacaaaattttacttttcaaaattaaagtatataaaaattgacctgtcattttgttgtttcatctaaaagaattgctttcttttctaattgcgtcattaataatgaatcaaactgttctggtgggaatattttaaaccatgatttttgtgtgtgtgtgtaatgtgacagtaattttttttattttgaagtaaatgagctttaagaaatacttgaattactcatgacctagagaggaaaacaagaaggcttgcaaattggattagggagtgaataaaatccctttttctaatgccatgtcaacagttcattccatttgaggcatcacaaggtcaaataatattcatttatatgttgctcatctctttccattcgctcatcagtcttctatctttccttatgtgtttcataaaacatattaatatggaaatttgggttaaagcattgtgatttttcactacctattggtaactaatatgtattttcataaaatgacagaggaacagctgtagaggaacaacttcagattatgttaaattggccttcatattttagaaaactcaacataaatactcattgtggtgcattcacttagtttattaatagaaggcggatatccactgaaagaggtgttaaggaatagcaatgaagacacattccaatgtattctcaaagagctcacattctagttgggatgacaaacatgtaaataaagagttactataataaattaaatatacaaacaataaagcctattataaagacatgtaaaaatactacgcaaatccggagggaagacatttaattcttcctagataggtaagcttaagaaatgattctaagaggatacattactttcacagtgatttaaggtcatttaagaatgtcccaggtggaaattgaagtgaaagaccatccaggtagaaagaatggaagcttaaatgaacactgtgtattcggagaactgccaggtgtctggatatgaggttgagagcagagtaaattggaaaggtaggcatgtgctgaataaaaatctaagctattttgttatgagaaaagagaatctttgaaagagaattgaagattgcattaaaggtatgatgattgaagtcagagaggcattaagtagctgtcaaataattcagaaaagagttgatgctagattctgaactgaacatagcagtgaagattgaaaggaggaaacagcttgaaacatatttaggaattataaactatgtgacatgatcaatgagaagtagaggatgattactagatttgttttgttttgttttgtttttggttaagtgactgggtatatagtgctaccatccatagaggtgaggggcaggtacaggagaaataactctagggaacagaacagtatggtaaacgttagctgtattgtttgacataccaatgaaatagtaagcttaaaatatctcaagtttcattaaagaaacagcttcttctagagttgaggggagaggtctttctgagataggtgttgaagccacggaagtatatagaagtagatgtgatttccaggcaggctgtgttcagggagcagttaataagggctgagtccaattccagtgcttagaacagtaatatttagtggtggtcaaggcaagaaatgctcatgcaaaaggatcagtctcaggagaggtatcagagtgatagaatatgggcagtgaagtggcaagaataatcaaggaatacattaaaaaataataaaattggggccaggtgtgttggttcacacctgtaatcccagcactttgggaggcccaggtgggtggatcacttgaggccaggagtttgagaccagcctgggcaacatggtgaaaccccgactctactaaaaatacaaaacttagccaggtatggtggctggcacctgtaatcccaactactcaggaggctgaggcaggagaatcactcgaacccaggaggcagaggtggcagtgagctgggatggtgccaatgcactccagactgggcgacagagtgaaaccctatctcaaacaaacaaaccacaagagtactaaacatggttgacacgatgcaaatcccaaatgatgatcaaataaacagtacctgtgggctccagtgatggggacagaacagctgaagagcgagtagtggtgggatggaagtagcaaatgctgccgggtctttcctagaatggagctctgaatggagcatggagaattagagcagggtacctcaacctctgcattactgacatttgggatcagaaaattatttagtgtgtgtgtgtgttgcgtgggtgggtggattgtgctaggcattgtaagatgtttagacatacctctggcgtttgttcacaaggtgccaatgggattctccctagccctgttgagacaaacagtatgtctccagacattggaaatattcctcaggagagaaagtcagttgagaaccactgacctagatgtacctaagtagtcaagaatgtattgatatgtaggacataaacatgtcacaacttttatcataaaatgattattgattaaaaatatggaattttttttactattttttattcacattagttgtcatttttaatttcaaaaatgttcgattctactatgatacgaaatgtggaatgttattgataaccatctgtcttgactgattttttggaagtcagccagttctttaccatactgcattcattttggtgtttgttttcctttaatacatgcttcacctttatgttctggaacaatacagcagagggaaaaaaattcaggaccaatcattgcaatgaatcacctcaaatttgcttttatttttttcttagtttgcaaaaaaaaaaaaaaaaaatagctatccagaaagtgttttttgagtcacttgacctcaaaaataatctctaggcaaaaaatgttttttaaatagttagaaaacagttgcagagttaataagcaagaggcctggtagtcaaaaagctaatacatagttttccaatgggaccaccaggagagccatggtgtagctggtgcagataaagtttccgttctgaacactggcgctccctgtttatggagcagaaggagcacagggggtcctcacagagattgtagctgcctgtgatgcagctgagtcagtggcagcctctagagatggcagctgtagccccaggtggcaaatagatgacagcagcttgatctatcgaccagggtaagagggggttctggcctaaatgaaaattcatgaaaaattgatgaagtccccagattattttttccgtttccttttctcagcactgtgccagtgcagagagtagagattaaatgaggtgctgaacgctttagtggcaaggaggttgtggttcaaaggtcaggggtcacatagaaaccaatctttttttttttttcttttttcttactgctaaagcaaaacacaagaaacttttcagattagctgtgatttacctttgctttgataaataaaatgactacatgttcaaaagttggcttttgatgcagttacaagagagaacagatgtgattcataattcaagtatggaactggaaatagattgaattccatgacttcaggatgattattttttctttttctcttattttttgtcttctgtatgaagactcatgctgtatgaaagtcatttagagaagaagaaggtcttgcattatttatagggttacagattgcgagaatagcaaagctatggaacactgtccaaacataatgctcctgtttgcttaaatagaaaattaaattgatggtttatctgtacaaagaagagaggctacagaagtagactgactttagtatgagagggcacaggtggcactgaaaatgaagacaaggtaaagagcttccttgatctcctcaagttaataaatatgtaaatgtttgttttttattttattttggctgtaaatgcatcttatctaggcaaaatacctttacacatcataaagacacaagataaattaaattgcaaaaagatcaatccatagagagctttttaaaaaaaatgcttaattgagatatatttaacataccatatcatttactcatttaatatatacaagcaatgtttttggtgtattcatggggttgtgcaatgaacactataatcaaatttagaacattttcctcaatcctaaaataaactctatacccattagaactcagttcccattcctgcaccctctcaccccagccctaagtaaatgctaatctactttctatagctatacattttcctattctggacatttcatatgttagaatcatacaatatattgtcttgtgtgactataatagcatcttttccttaacattaatgttttcaaggatcctgtttgtttagcatgtattagtactttattcttcattattgctcaataatatttcatggtatcaacataaccactttttatttatccattcattgtatgatagacatttgcattactcccactttttttctgctatgaacaatgttgctatggaaattttgatacacatttttgtgtgcacatatggtttcatttgggtattctcataagtttatgcctaagagtagaattgtcgagtcatatggtaactgtttaactttttgaagaatatatatgtaattattattaagtgtagattaaatgatatttactggtgcattgaagtaactgtatccaactcacctctcaatatgaaacacagtcataaaacatttctactgttttatccatattattatgtgactgttatgttagattttctatgtcgtatgtccataatttcaggtaagagtcaactatttaaaaatatagaacaattaaccatatggaaacaacggatggccacaaagttcctaataaatccttgtgtaacttctactagactgttttcagtttggtcccaattaagttggataatcttactgtttgagtcttcacttcattttctgttctgtttgtatttgttctgaaagctggcaatttgtcttctcagaagctgacgttacccttcctgagaataactgacagtactttcttcattctcgggttactttctcttccaaatatactgaggttttttctttcacttgtcaggttcagactaagaaattaatgaacaattatactagaagtcagttaagtaagtctaagagtgggaaaacaaagaactattatcattctctatctttcttaaaacaaagaagcacacaaacaaacatatcaacttaaatgcaaactccgtggcgatgagttggactggaactaatatttacaggtgaggaccaaaaagaatataggagcaactttcgttttttgtaattttctccatttgcatttctacaaatgtcaggtgagatttcatatatttttggtggtgatggtgggtggtaggggaggaggatacttacacagctgaaaaacgctccctagctccaggtacttcacaggataatgctaatatgttattttggctgttttgtgagtgtgccttttaattttgccatactccatcaaatactttcaaatgcagtctctcctttgatcttcacaaatgaaggtgtgaaattgctacacctggggaacgtgtatgaatttgtgatctatttaagtatgtataatgctgtattttgatacgaggtttatttctgttgattgaattaactgtattcaaactctctctcaacaagtctcaagttgccattcactgacaattagcctgaattaactctgactcccaggaaagcacataaatgaagtgaagtcattgtgtcctctacttttcaaaaatttattcccataaacagtataattctgagtatgatcctgaggtctgcagtcaagtagatcctatccataaaatgacaaggaaacatattcatagtgatactaagagttcaggagataaaatatgttgaggtctgctccggttttcgatcccagaaacccttttcatataaagttaagaaaaataatttaggattttgaatttatttcttactgtaattttttgtttgtttgtttgttttgagatggagtctggctcagtcacccagactggagtgcagcggtgtgatctcagttcactgcagcctctgcctcccaggatcaagcgattctcccaccacagcttcccaagtagctgggactacaggcaggtgccaccaaacctggctaatttttgtatttttagtagagatgggattttgccatgttgcccaggctggtcttgaactcttggcctcaagcaatcctctctcattggcctcccaaagtgctgggattacaggtgtgagccaccgtgcccggcctcttactataaatttttaatttattaaatttcagctggtgtgtagatgcaagttgattttactgaaaatgtaggtaggttgacattagcttaggaaatataatttcgtgcagtaactcatatgcttttctcccaggatttgtgtttcggcagaatacagatttccaatttcccttctttagatctataattacttaaggaaggttacacttcttttaagcatgagtcagtatatatgataaggcctttacagaattatagaagtaaaaacaataggtgaagttttgtttaactatgaaagtttttgctttatagatgtttctaacagtctatgatttagctgctaagggatgaggttcaatagtattaagatattctctccactatataccattagaattgatttttcctcttaggagattttcaaaagcaattctgaaccacccatttctgaattaaaaatacttatacatttttgtcaattagatattcatccactttttgtcactgtctcccaaaaaatactctatgaaagcattactgagccccaggttgggttgtttctctaaactatttgaagttttctaacatagtcctcctttgtctactaagacgtcagtagtttaacaactctggatgtcttagtctgttcaagctactacaagaaaataccataaactgggtagctttttaggaaaataaatttatttctcatagttctggagcctataagcctgagttcagagagccagcatggctgggttttgtgaggccccacctcctggttcatagacggcatcctcacaaggtgaaaggcactaatcccatttagaagagctctgtctcatgacctaatcatcttccaaacgctccaccttcagtgacatcaccttcagggataagatttcaacatgtgaattttggggggatataaacgttctgaccacagctctggcctttggagagacttcaagcaagggttgtaagagaggcaggtgtttggatgcaatgacagacagggcctggaaattgagcttaaattaacacccaagtagagaaaaggctgttctttctcaccgatattggcagccctacacatttgtcggttcctcatctgaggagttaaccaactgcgaattaaaaataatttttaaaaactaacaaaaatataccaacaagaaatattacaaatcatgtggtatagcatctatttgcatatcatttacatagtattaggtattataagtaatcaagagatgatttaatatatacaggaagatgtgtagctatatgtaaatactatgccattttataaaatggacttgagcatccaattcaggggtcttgagaccagtctcctctggataccaaggaacgaatgtgcctctttctgagagccaggccgtttcctagtaatgcaactataaaggcaagcatcacattttttgtgtgtgattatctaacatttaagtctgaaccaagattttggaataaacgttacagtatctatatatggaaatgaaatgtaactattttttccataacatgaggtatatttgatataaaccattttatataaatctgcctgcctcattttctttcttcttgctttctttgcttattcaaattgaacaagtacattatacatatatatgtgtgtgtgtgcatataaacatacatatatttttttcttaacatgaggtatatttgatataaaccattttatataaatccacctacctcattttccttcttgctttctttacttattcatattgaatgagtatattatacatatatgtgtgtatccatgtttatatatacatatgtatacacatatgcatatatatgtatacacatatgcatatatatatgtatacacatatgcatatatatgtatacacatatgcatatatatgtatacacatatgcatatatatatatgtatacacatatgcatatatatatatgtatacacatatgcatatatatatatgtatatatgatgtgatattagagatgtgatcccactcactgtgttgcctaggctggtctggaactcctggccctatgtgacccccccctaccttggcctcacgaagtgctaggattacaagtatgagccatcagggccagagaatactttctcttaaatcaatgtttaaacatctttgttgggtttcctaatcgttaagagtaaaacgggttaaagagcacctctggtgctgggctgcatatgaggagtctgagtcgcctcaggtggcagtgaaccttccaccctggtgatgtagggtaggggccttcagacagggcatactgcaggagtgaggaggggccgcaagttgcttctaggtgagtctgaatgaaagatggacttagaaaactggaaagaagtataaaagcaaaaccctgaggttgtgcttggccagatttcgagcacaaataatgtattagcttaattggggagtagatgtagggtagtagagggagataatttaaatagcgaggtagaaattagtaatgactaaacgaattgatgagctttcatgttatcctagaacccaagggagcactgtttgatgtgggcttgttatttggaagtgaggtgtaaaaggagacatgataaacacagtgtggggtagatgggagcccaagagtgtggagggaggaaatctactgtatgttcaggtatagtaggatgaggattaagttgattaattaagttcagaataggaaaagaggagataaaatgttgaaaaaaaaggttgatagaaatttaaaaaacgcatctgtagttcaagtgaagatttaaatttagtttgctagagttttgtacagtaccttctactggtcggtactcacctaggtgttaggatacagatacttagaacaagctttgtttgatgggtatagagtttcagctggcaagatgaaaaagttctagagatctgttacacaacagtgtgaatatacttaacactactgaactgtacacttaaaaatggctaagatggtatattttatgttgtgcattttttttgccacaattaaaacatgaaaatattaacaaaacaaataaaccaccaccacaacaaaaaccaaggcatggctcttgccatcaaagaacattcaataggatggtctagaatgtggtatatgtgagagtgagggaggaggagttgctctggtgtgaaatacagaggagaaggaggctgactctgcaagagaatgtggaacaggtgaaatgattttgctagggagaaaataattaataataatctctggggcttgctaagggccaggcttatttctgtgtttcacacttatggctgattcagttctcaaaacaaatctaaaatttgggtactattattttctctctattgtatttgaggtacacagaaaggagagctgggatttgaacgctggcagcctagctctcaagcctgctttcttaattactatgctaagcatcctcactgatttacttgaacaagcaaacaaaatcatttgacacttaaaagagtcattagcattgccttaggtattttacccagaaacagttattcaattgtataaatacaatgatgacccctggaataggtgaagtccaagagtagcattttggcgcaaacaattctgtgattcctgggatatgacggaaagaaacaacagaaagagtaatcttttctatttttttatttagttacatattgacatttgagagctcattagtttattccagtaatttgattttctctgtacagttcctagttgtcaaatattagcatcaagaaaatccatcactttcagttctcattgacatgtttgcaggccaaagcagcttggagattaagaatccaatttataagacaagtcatctatcattgaatatccaaagataacttgactaagttttatagaaaaagaaatatgataatagcaatgatatcttactactttaggatactttctggagttttttgagtcattaacatatttatatgcattatttcattgctatatgtatttgtggacatttgctgacttagatagtttcaaagttcaatacatagtatcattaacattggtctatttgactttcaaattactctttttatttttttatatttaaaaatgaatcaaaggaggaagcatagccttttcaaccaatgatgctgaattaaatatccacaggcaaaaatataaatgaacagaaccttgacttaaaccttacaaattatgcaaaaattaatctgaaatggatcatacagttaaatgtaaggcataagactatatatatataaatatataaatgtaaatataagtatatatgtatatacatatatatatatagagagagagagagagaggcaagttctcactctgtcactcaggctggagtgcagtggcgtgatcacagcacactgcagccttgacttcccagactcaagtgatccttccacctcagtcttcccagtagcttgtgctacaggcatgtgtcaccaagcccagccaatttttgtactttttgtcgagatggggtttcactctcttgcccagactggtctcaaacttttgagctcaagctatccaactgccttggtctcccaaagtgctggaactacaggtgtgaaccattgggcctgacttaaaactataaaatgtttaaaaaataacgaaggagaaaatcctttgtgtctagaatttggtgaagaataaagcattaaccaaaagacaaaattaataaatttgactttattaaaattaaaactttaattcttttaaagatcttgtttatggaaaaaaaagacaagctacatacagggagaacatacttgcaaaccacatatctgaaaaaagcatatctagaatttataaagatatatcaaaattcaacattaaataaaactaataatctgacatcctttttattttaaaataagtatacacaggaagtatgtctactactagagatactagtagtatctctcttagatcctgtgaatctatacttagtacaaaataaaatattaaaattagttgtcgagctatcttaagtagacattaataatatacataaaaatgaatttggaactgaatcgttctttggaaagcatttgaatgtttgtttttcttaaatattgatgaattcatattttgagtgtccatgatctgttaaaaatcttattcaaattcatgtatttactgttttaaatttatacatttaacttgtgatacattctgtgtacagtttcatgaatttatcttcatatctttgatttttgttacatcgcagttttttagtttaaggatagattttatttcattttcttttttaggggaagggaaagaaaagagaggaatgtttgttcatgggagtttggcaagaatgcccaaaacatgacttaatgagtagagtgcattatggagctggcaagaagtccctactttaaacgaggttaataaagagatgcaatgcgtcttgatcctttgctgctaaaattatgcatggattattgtgaatatttctaagtacctgtttaaattcaccattacaactgaaatgtcactatcggagaaagatcagctgggcgcggtggctcacgcctgtagtctcagcactttgggaggccgaggtgggcgggtcgcttgagcccaggcgttcaagaccagcctgggcagcacggtcaaaccccatctctacaaaaaaatacaatagttagccgggtgtagcggtgctcacctgtagtcccagctagtcgggaagagcccaggaggcggaggttgcagtgagccgagatcgcgccgccgtcgcattccagcctgggtgacagagcgagactcgtctcaaaaaaaaaaaaaaaaaaaaaaaaggagaaagatcaaggagttttggggggtggagggggggacgcaggggccggagtctcgccttgtcgcccaggctggagtgaggtggcgcgatcttggctcactgtagcctccacctcccggattcaagcgattcacctgcctcagcctcatgagtagctgggattacaggcacccgccaccacgcctgggtaatttttgtatttttagtggagacggggtttcaccaggttagccaggctggtttccaactcctgatgtgggctgatgcgcccgcctcggcctcccaaagtgctgggattacaggcgtgagccaccgcgccctgccgagaaagatcaaggatttaagactatgtcccaagaaggaaaagctaaaggaataggaattattgttccaggagcattaaagacatcagtagatcctatcgttcctacccggcacctcaagaactattctcccaaagagagaatacatttattctatttaaccttaagaaagaaaaggatcagtggataaaagtttcagcttttcctcggtgtgccatacggtgattatgctatatgtgttctttcctgggatcttaaggaactgtgggccaaccaaaacaacataacctaataaacctaaataataaataaacctaaaaagttgcataaaatatgttttgatatggctttgccttacgtttttcctcagaggaaaactgaatctccaggataatgaaacaaggtaacaagacagttctgatgccctttcagttgcagaataattctcagcactttcctatacacaaggaattcaataaagtagaaataattttcttaaacttagcattatcactgttttgaaaagtccttgaaaaaatcccgtttgtgcatacgtcttgcacgtcttatttcaaaatccattgagattgtaagcaattaaatcaattgcattttgtagaccaacccctcatttgtaacatgtaattccccaggacccatgtgtccagattcaagagcagcttgatagaaagactgatttatttttattttcttcctgggtctgctttgaatattcttaaaagaaggaggaaaatgctgtgtttaatattcatacaggattttgtattaaaagcagcttctctcaaaagcctgttgttaagaaggactacctataaaggggtcaacttgtgaaatccttcctaagtacttatttggttcttggggattgatggataagctgatggagtctaatcttcaaatgtgtatgtcattaatagagatgtaagaatctcaatgtgctttgtcttttcctttcctgacacattataaggaaaagctttactaatgaagtacccaatggcaataacccattatatgctagaatctctctttgtatcagatgacatgcaaatgaactgttctatttctgtggagaaagagagacaaggagcggtctagttaatcatacttgaggactgcatggttgtcttctgggaaatattatcatgattcattcttatttaagggtcctcaccctatgcataagaaaatctcccattcattccatttgggtttgatgttaattataggggcattaacggaagctttctcataagaaatgaatataggattaaatcagaaaataataaggcaacctttagatgaatcaggtcatgatagagctatacatgtagaagctggcaggttggaggaagtttagagatcctcagtccctttgttgtttagatatggaaactgagtcctggaggagtgaagtgacttaactgaagtcccagctgatgagaggcaggcatgagatgacaaacgaagtagcctctttcatcgggcagcaatgtagagaaagataattctgggagtttaagagaccacgttctgaccattttctactattaactactcctgtgatttggggcaaaccttttaccttctctggatctgttttcttaaatttgaggtgagactagactaagcatttgccctctggaaaaggggaaatctaagcaagctcctataggagattagtgtgtgattattattccagcttagttcattggaaaaaagatatttctaaggtatcatgtatattttgttttcaaaattgaagacaccagccttggatatcaaataaatttagtagcacttttaagctaaccttttccctaagccatgaaaagacttttttcttattccagaaaatattttattttatttttatagcatttctttatgtgtcttatagttggcaagtaattgataatattgctggtaaaatgaggcatttccttaatcttacatgtcttgagaaattagctgttcatgtatccatgtctacacagtcctcgttcaccttgtgaccatgtaattaagtcatttttcttttccaatcagccattcaggtctaaggcaaatggttttttgaaagattatgcacaccttgtaccagtacttctggtccctttaggtttaaagtgtacaagtagagattcctagtatatcaactaaattattttcttcctttaaaagagaaaataatttttttaaaaaagcaaagaagtaatttttttactcatatatttgacttacaccttgtatataaaatgttttgttaggtgaaatgtattttatctatttaccaaaacattttcacccaaatagcataattttacaagtagcagtcatatattaaaccaacatcacatttgtcctctctttgaacccacattatctgaactactgtaaagatctttttcctgtgagtgtttttattttattcatttttttaaaaatgttatttattttgtgttatattatcttcctggttatatgtaacatctttccatcttagatatgttggaaactccagaaaagttttaaaaaattaccaacagaaataaacaccacttcttccattgtgttttaatttcatttctgtcaactgtatgacttgaatagacaatctgtggaatgaatttagttttagtactttaataaaataaaatataaaaatactacacatgtaagtaaagtaatttagagaaatttcagaactagtttttctatttttcaaagaatatttagaaagcttaaataatagcttgcacatgtactcagaaaataggagtcatctaaattgcaaacttgtttaataagttcttccatatatgagcgctatgtcatcttcaaagttttcatataattggcatagtgctaaatattttataacacctctgtaaaataagttaaaatatttttctgccacaaaacattgtttttttagctttctaactcttgtgatatctttgtgaatattagccctttctctactttataaaccaagtaacaaatacaataagcctcacattttacatagtaaaaataagcggaatcatcattactccgtgaactaaccgaacttttatagtccctttaaaaatgttcatctgttgttttgtttgggagtttaaagatagtttattctgcatttaaagatactgtttatttcagtacatagatgcatttgaaactagaaagcaaatttagaatacttttgtatttgtttgtgattatcagtccaagataaaaatggtttatcttatccaactagtctttctttacctataccagagtcctcagttggagtgacctttggagtggctggtgtcttgggtgatgtagttaatgagatctagcgacatcatgaccctgaccccttcgtggccctgactcctctcatccatcttcttaaccccacaaggctgcaagtcagtgtgtagaatcaggattaaacaagtgtgaataaacaagttcaagagttttctgcagggctgccagtgcatggcagtagcaaagtaagacacagagaacttaatacctgaaatgctctttgtgcacctccacgaatcctgttggagaaatcagtaatgtttgtggtcagcgtagtgcgtctaatctcctcagttcgctccattcctggacagtgatggcagttggtctttataatcacatagctgttggcacattcaatgaaagcatggctgatctatcacttacccaatgtcacacattgctaaagcttttatctcattaactgtgattaatgtttgtatggcatgggcttgtcatgtaactgttcatattcagcaattgtgaatcccttagtttacttgatgactgaagggtatttctcgtttcagaagagaactttatcttaggggcccagcagcctttttgcaagccaccattgtcacatggcttgagaactgtgtgatgtagcccttccttggctccttctccattactgtccttcagggtgttacttgccattaaacttggacacttagaaaaaaatacaagaaatgtagtagaacttcaaggaagtatttacctgtaattctttcgtctaaacattgcttttctaatatgatttccaattaagtctgtgttcccaaagtcagatggaaaggggtagagatgatggatgcaggtattttcttgcctttggctacggttcttgtctttttctgtgctatgcttggcaagtctttcgccttagcccagggcagcctttggtaagttgaccagtcagtgattaaacatatttatttagttcagtgggtcagagctattgcgacagatagaaaattactgatggattatcaatttcagcacctctgacatctggcctcagtgtagtccatcatctgaggactcataacacattttcttcaacaataacatgctcagctacctgtgtgatcacacagctgaatatcggaaagattttgttcagatttaataagacaaaagttgcagaaatcagacgagttctgcacctatacttgagaatctaaaagcacccagtggtttacacacaaggctggaataagaactgacttgcactgtaaatatgctttgttgatttttgtgatatttttataacatttttacacttacattttggatttgatgaaatagttacttggaattattttggaaacaatgtgacatataaaaataaaaatattacttgtttcaaaatattctattaaaaaatttaaggcattaaaataatggttttaaatgtttggtctactacagtgataaaattaccaaaataaaaccccaactcaaatacctatgatactaaatcttttaaattataaacaagatgtgaaataagatttgcaaaatttttgtgtttattgttattgctgaatggttcttttaacccaagggagttctagtaataaagaataacaaccttattgcaaatgctaatctaacacagaaatgtattctattcctctgtccattttactatatctcagtataattttcttcatatctgtatttcaaagttctacataaatttaagaataatcttgattcatttttcaaatgattaaggttagcagtttgttttatggtaagtttatgtcttttaaaaactggttatatttgttgagaaattaatagattgtggcagagaatacattgtaacttttattttggctttattctcatttgtaaatctttcatgtgattatccctaaggctttatactccttgcacctaatggcctactttctgatgagcctacatttaatatttatgtgtgctgtcataaaaatatttttgaagctaaaaattattcttaatcttcatatgatgcattttcacacattctcttgaattactaaactgataagaacttagaaatgttacctttgttcacaaaataaggattgagctctttgacattgcagtttacatttattcactaatacaccagtgctatgtgccattaaattgaaaggccctttggaatgtccagctttttacaatgtgatataatgtggcaatattacaggttattgtgggccattatttattgtcaaagacttcctgatttgtcttagaattaagtgaggtttcttctatagttctgtggaaacctttagtagttgactatggcatttaattaacccatctctcctttgatatctcagagctggcttggaaaatgttgggatgaattctagtcacagaatatgctcagtaatttagattgggctgaaaaaactgctgtggatgttcaaaaaagacacaatttaaaaaatgagggagatcagattagaatatgagtttgatttggaaattcatttgagcagttgtagggaagccattgtaacattttttccttaaagattaatccctataacaattagaacactaaacatttattggttttaaattcttaaatgtgatgcctagcacttatgcttcctcagatgttttacacagttattttaaaattggagatgctccctacgtgcactctatttcgcttgatgcccaagtttccttttgattttactctacgccattgacttctctctgaaatgacatgtattataaactatacatgacttgtcaggagcaggtcaacagatatttttatgtaaagcaagcatgcaataacagaaaagttatatacagtcacgcattgcttaacaacagggatatgttttaagaaatgagacattaggcaatttttacattgtgtgaacatcatatcctgaacttacacaaacctagatggcatagtctactacacaccttgactataacgtgtagcctattgcttctagcctataaacctgtacagcatgttagtatactgaatattgcaggaaatttgatatgatttggctctgtgtcgccacccaaatctcatcttgagttgtccacttggggagtaagggacctggtgggaggtgattggatcatgggtgagggttcctgtgtgctgctctgatgaatggtagtgagtgagttctcacgagatctgatcctttaaaagtgtttagcacttcccccttgctctctcttctcctgccaccttgtgaagaaggtgcttgcttctctttgaccttctgccatgattgtaagtttcctgaggcctccccagccatgcagaacagtgagtcaattaaacctcttttctttataaattacccagtctcaggtagttctttatagcagtgtgaaaacagactaatacaaaattgtaatacaattgtaagtatttgtgcacctaaacatgtgtaaacgcagaaaaattacaataaaaatacagtattataaccttacgggactatagtcatatgtgcagcctgttgttgtttgaaacatcattacatggtgtatgactgtatattattttagcataaagattacatggatcaaaccagtagcatgaacacttgttcttccatcaaaattaatcaacttagaagaaaatatttatgaatgtaacttgatatgggtcaaagtttctttaggtaaagaagcacggaagtaaaatctccagatgctttcacatagaaacggatcttatctgttacctcacagggaaactgagaaattaagcaaagtaatgcatatgaaagtacgtcacaaactataaagagctgtaacaatgcaagtattttaatgctgtgtgagttttttggtacagaccaagaaagaaagaaaatacatagctatccatttttagaggctctggactggcagtctaagagttgcggttttatggaattcacatcgacatgtaatgatttttcatgtgagcacattgacattgtccagtttcatatagtaaaatgtaattcagaaagacactgagaaccacagttttaaagtactgccttccttctaatgttcttgtcattcaaatgtccttgaaagcatttgaatcagtaattttgaatgactgttatgatagaatgtttaataaaccctattaagcatgaattattttcttcacttctcttacaatactggattagtgttttgaatcatcaacaaccttgatttctatactgaaattccattttgttagcatcatgatgaccgataatgattacaaatgtgtagagtaacaattattttaacgtgtaatagacattggcatttattccatgtgtccggcatgaacatttgtcctacgggcaaggtagtttggagagatatggcaaagaactaagtcaatgatgttgatatagcaatctaataactttactttgatgacctaaaaagatttaggcattgggagaatctggaaaattatgaagcttctaaaatgtgtcctgaagagattcaaaggaaatcacatttttctcctgctctggattgattcatactataatttacctctcataaaactgatcatatgttaatattaagttaatagttgtaagttgatagtaaaattttaaatgtggagtagctgcacaaaatatggaagaaaagaatttgcttttattctgtgaatttaagattagcctgacgtcgttatgctcattttagcagttgcaaagataaaattcattggcatagctggaattacagtgataggagttggctttgaagaaaaatcaactttgccacctattgccttgtctgtattcaaaatagtatacattttagctaagtttgaatgtggacttaaataaaaaccaaaactaaaagataagaaaaagcaactgagcagctttatactgagcagaacagggaacttaaacaggcattggtattttgaaattgatttacatgtagccagctttgtttaccatactccttacccttagaaacccaaaataatttcttattagtcagtgttatgagcaaattaatggtggaaagaatgcagatgttttattattattattatttttgagacggagtctcactttgtcacccaggctggagtactgtggcgcgatctgggctcactgcaacctccacctcctgggttcaagcgattctcctgcctcagcctcccaagcagctgggattacaggcacctgccaccatgcgaggctaatttttgtatttttagtagagacggggtttcaccatgttggccagtctggtctcaaactcctgacctgaggtgatccacctgcttcggcctcccaaagtgctgtgattaaaggcgtgagccaccgagcccagccaaagtattattatgctgacctgaatacatgctcaggttttgatattcttttaaaattctttcatattctgtcagcataatcattttaactaatatccatttcactatgaattcatgtaagtccttcattggttgaaactgagtggggaatggaatatcctgattttaaaattttctgcttaatgatacctattacatttttaattggcttctactggaatggggaaatacaattggattttgcatccagcaatcttactgacctctcttgggttctctgtgaaataattgttttatctgcaagtaacgaaaatttctcctatttgaataaaagtcttatttacttaaattaaataataaattaattaatattttctgcttaactacttaagccagatttgttttgtttaagccaccatgctctgttgaaatttttcttgtaggtattgttttatattatatattagtgttggaattgcttggatgattaagatctcatcagggtaataattctaagtgtcagttttctctatattatagaattatgaatatactatgttactctacagtgtaaaattcagttttcatccacataaattgagctttaattatgttctggaaattttcatacacatttcatcttcactgcaagccactgatatttagaattttattattattattctttttgaggaaatttaatggcagggtagatttttttaaaaaaattgcccaaagcctaacagctagccagaggggatttttgaatttccatgtgttagttcaatgacctggatattttttccacttcacacaatatctagagtgtttaatgtaaggaagaattcttaggattgatctctttgtgaatataaagtgcaacgagactttctgattatgggagttcaggatcttgatttactgagatgtaactctcttgttctacacagatgaagtagataactatttttaaacactgaaaggtgtgtgtgtgtgtttatgtctaaagagagaggaaggtagtattaaatattaatctgctccccaactctaaaaatgtagactctttgatttgtggtcatgaacatattttcttgtttgatttcaaatttcagtctagtgtcccttgccccttaggctgcagatgtcaatttgtggtcatccatgccgatgtgtaaatgagtaagtgttgccccggcaaagagctgaggttataatttagccgtcgctgcccctttgcttttgtgtggattaaaatagctactatgtaaaatcttcattaattttcatattcggagtatatgtagaaatccacaaagttagctaatttaaaatcagattattattacactcatagtaaacccatagagaatggccacttaaaaggctgaagtcccgtcaaacacctttttttaaagggatgacaacataaaaaatgaaccaatgatgcctcaccttctcagatctgttccacatgtggtgttgtggtaatattgtgagcactgaagtattaaaacagttttgtcttgtgttccctcattctgacaggccaatgacataatgtcgacaagccatctctgatagattcaaaattgaaagtgaatacactgcctctttttcctagttcacactaatggtgtttgagtcaacgtgctaatttcactgcttccaacatacagtcctccctagtaagtctgggaatagcttgtgaggggctttttttttcaggctgcaaagaactgtttgatcaaagtcattactttgttattaaaggagaagaatggagaggaatcagcaataaaagcaaagacaagtttaggatctgaactctgaaaagcagtttgccaataaagatattaactctatatgatttaatatttccacaacaatgttaatcagttgattttcataaacatacatggactgggagtattaacaatagtaaaggaagaaatttagtgttctgtgaattgatttttagttctatgccatattatacagtcctataaaggaagataataagctataaaaggaaccagaccttatcacccaggcaaatttttgttggtttgtttgtgttttttctgcagcagtttccaggaaatcaaaagttttgcttctctggctatataattcaagatgattcatcaaattattgcttttacaaaggtgcaaaaactttgaggagttagaaaataattgaggttgattattggagcactttggaagtattttgttcatttatttatttaatcactgaaatagttactagagctttctgtgaatttagcttgttttggtgtgtattaaggtgtggcccttgccttttgactgcttgcacactaatttgaaaaattagacatacacatatgaaactgtttaacaattctagagagtggacaagaaaatgataaacgtaggtaagggtagaggacagcagctttcatatatatatatgtatctatatagatatatagataatctatatgtatctagatatataatctatatagatacatatctatatagatgcatatgtatctagatagatatataatctatctatatagatacacatatctatatacatagatatataatctatctatatagatacatagatacatatatagatacatatatagatacacatatctatgtagatagatatatagattatctatatagatacacttgtatctatatagatagatatgtagataatctatctatatagatatatatgtatctatatagatatatatatgttcacaatggtgtgtaaaacatacgtgtgtaaaacatttgaaaaactgctttcttgcaataaaatcctactggaaatcccagtgcccagtgtctagatgggttaaaggcagatattttctgctcctttcgttctggatacttcaaagttcaaatgattgaaaattatttttgtaggatcagggaggcttgagccgaatgaaagatatgagttagaggaggtgatgaagcctccttcttcagaagatgtcttttgaatggaacaaaatttgaaaaattggaagagaggaaaatggagcatatcagaaggaaatagcacggtgaaagtagacatttcaagccgggaaagagtagcgtttttggactgtgagaagacccatgtgataggagtagagtttatattactgattcatgaggagcctgggttaggagaagccaagctaacaggagccacaaatgccaggcatagatatttcgaagaccatccaggagtcagtagtatgtatatattcaggaacctttgaaaatggacatgacacaatgtgatataacataagttatataaatgtggagttgtaggagtgggttactgtgcaaaatataatcagggtaggaaaaacttgaggggtctgttgtattcttgcattcacttttggtaataggtatactggcttcagaaatagtagtgcagttaccttaattttagtcataaactaagtatacaacttgtttaggcaaccatttttagttccaattaaaagtaacaaataaagtatccattataatttcttacagtttccaaggtcttaccctctcttcctccctcccttcttccctttaccttttctctcttcttactctctatctttattctccctttctttcttttttccccctttctttcctttttcctcttcctttcctctttctgtatctcttcctaccatataatatcctggacttttactcattataaatacttaactctaatatgatatgattatatcctcatattccagtaacatcagaattccaatgggaagaatctaggcaattttaagatatataatttaaataatggcatgtccctacttttgctcattttccaggtagtttttagatacaagctttctttgctatgaaacctggaactataataaaatttaggccagatattcacacttagtggaaaaaccatattaactataatagttgtggtctgtctgcaccacgccaatcacagtcacatgagtgtctgtggatttctgcttctaagggtgctgtttatataaaccaggtgactatagtgaaggaagagatttgcttttgaagcataaatcactacaaatttcaacctgtccaggacttatatcatctgtaggtgtttgttttgttaattactttgcatttcattcagatgtggtgctattgctttagtattctaagattaactctgctgaatttgggggtcaaggtctctatcatttgtttcactgataggcacacaatattctttcttcttaacgacgaaaagattgatcagtgaaagaagacaaacgctgaccaagctacacatcggtatttatgtccgcgtgcctgatcaaaagtgtgatctgagtgaatctaaacttttcagcatgaggaaatatgaaaaaaagtgtcttagatatagaaaaagtttgcttcaccataattataatgctttttcaatacaggtatttaccagttatttagtatataataaagttgttgtatatatataacttaactgaagtataagttgattaacagccaattttagagtgcaatttttagtaattcatatcataaaataaactatatacaattgtcataaaaatatggctatgtttagttcacttctacttctgaagtactattagttgtttcacttatataattaaaggaaaacatgtttgcagagtctagagcctacaaattcaaaactggttattatcatttattcagctcccagcgattgcacacatttgaccctaaatgacaaagtaaatgaaagccctttttcaaagtaatacaatcagttcaaaaaatattgtgctaataaagttatacattctaattgaaagattgatggcaatccatttagttgttactaggttatttgtgacagacagatgcagagtaacctcattacagtcagaattgtgatgacttgtagctgaggagaggaataaagctttaaaccattgtcacagtccctttccaaaacgtattcaaagatgatttaaaagaaaatatatgaccattaaatagaagttcgaattggttacctaggagtgttattatagaagcaatgaagtaatcatctgtttgatccacaattggcctacttaaaattcacaaatcagatttacagattccaatttgtgtaagagaaaaacagtgccaaatactggattaaaaagattatcccttgtggtttggcatttttagttcatatttttagttgttttcttcttgatcatcaaatatatatcggcttattttagacatttctgcccacaatcaccagttcatgataaattattccacagtattcatttgtacgttgtccaatagtttaaagtcaggctttcagcattagtacccaagggaactctatcaacattctgaagttatgtaattgagaaaaagaaggaatatgggtggatatatatatatatattttttttcctttgaaagatggtgaagtctttgtgggatatatttcatgtatatttgattttgaaacttcttttttttttttttttttttttttgagatggagtcgcactctgtctcccaggctggagtgcagtggtgcaatctcggctcactgcaacctccgcctcccgggttcacgccattctccagcctcagcctcccgagtagctgggactgcaggtgcccgccaccacgcccggctaatttttttgtatttttagtagagacggggtttcaccatgttagccaggatggtctccatctcctgacctcatgatccgcccgccttggcctcccaaagtgctgggattacaggtgtgagccaccacgccaggccgaaacttctttttttcttaatgaaaaacaaggtagaaatgttgacctacaggaagctccacctgctcctcatagtcttcctactgcaatatttgcatgtatttctaaaatttcttatgttcaggagcaccttttttgtttcaaatgtgacagtccggtgctatgcttggcacataaaacccgttttattctgatcacttctcatttgtggtttaatcttgcgcacagttgtccttgcctctctcctgtctcagcatttgagctttctgttactcttgtacatactgaactttttcttgtgctcctcactatcaccaccatgtcttttattatagatatctttcaccatgaatccttttattatagattatttttcaccatgaattctaaaattctcttacattgacaaaagtactctttgcaagaagactatttaccaacttgaaagaaggctaattctatttttttaagtgaatttctcaaaagaagattttcattgtgtgggtaagtcagttaaatatctattgggtatttcttatccgctagtaaacttaaaaaaggtgttctttctaaggtagtgtctttccataaagttgacattttatctttcctaatcaggaaaattaaggcctcattcccttgtaggttgtgttatcagttaaggctaaagttttgacttatccaagcaggtgaattaaagaatatgtaataatagagtcttaaccaacagaacaccagtcagttgagaggttgtgtgttgaggtgaaagaccaaggactgaaatgggaatgaaggaccttccattcaatcctagttatagatcatttaccaaagattacttactagctatgtaaggcctcagacaaattatttagtgtctgagtcacagtttttcgcctataatgttaaccagctttgatggttctaaacttataagggtgtggtgatacttatattttataattaaacgtgatttattcatttatgattcattaagatagaaaatgtttcaaaaattatacttacttctcatttatttaagcaggtgattatgggaggacttctagatgccaggtgcatatccaggtgttaaggctatgtcagcgaataagctagaaaaaggcctcctagagcttatattctcagtgcttacctattcagtgcagaagcttgaaacctatatgaatgtaaacacagtagtcctttcctcattgctttctaggggcgctatcctctcattagtcatttaggagacctcttggttatcagatcaaaaaaacatggtatatactgtacagtataagctttggtactatccctggtttcagatatccaagtgggggttttcgaatgtatccctcatggataagaagggactgctgtacacaaaaataaaactactcaacatttcactattaacaatatgtggatgactaattttttgcacgtttttgtgtgtactgtgttttgcaatatttttttcagattgctggtgtagtccatctattttgctttcttgtatgaattacataaatattttcccatattatgtttttcttcaccatgatatttaatggtggacctttcatcccatgttctgtgctaattttcttaattctttgtcattggatatttaggatgtttctagtttttcagggttgcatatgaatatatgaactatgaagaacataccgtgatacaaatccttgtgctcaaccttggttatttcctttgaataaattcatacagtagaattaccagtcagtgagtatacataaaaatttaaacttccatcaaaaaatatctgaaaattcaggcttactcatttcttttccttggatattttcctttgctaatatgataggtgaaaatattattgcataataattttactttttatttctagtgaggctaaaagctgttgcgtgagtattggcttaatctttctctttttgtgaattgcctatttatgtttaagtgttttctccttttggagtgctctttttagaaacttttacaactgtctttttttctactaattatttctttatttttagtaataattattaattattactaattatgtgtctttatttttcaactttattaatgtttacttgtcaagtaaaacttgtatatatttatggtgtacagtgggatgttttgatatatgtacacattgtgcaatgactaaatcaagctattaggtttatgcaaaagtaattgtggttttggaccatgaattttaaatcattataactaggctcaaacacatctttattaatcaaaataggaactattacaatcaacacatttttgccaatgagaaataagtttgtttattcctgtagcataaaaatctgtgattggggatttgacgaactcttggaaagcattttctgcattctgcaggttgtggaagcgtttttccctgcaaaaagttgtcgagatgcttgaagaagtgatagtcggttggcgagaggacaggtgaatatggcagatgaggcaaaactttgtagcccaattcgttcaacttttgaagtgttggttgtgcaacgtgcggtcgggtgttgttgttgagaagaattgggccctttctgttgaccactgtcaggtgcaggcattgcagtttttggtgcatctcatcgatttgctgagcatacttcccagttgtaatggttttgccgggattcagaaagctgttgtagttcagactggcagcagaccaccaaagagtgaccatgaccctttttttggtgcaactttggctttgagaagtgctttggagcttcttctgggtcccaccactgagcttgttgtcactggttgtcacataaaatccacttttcattgcacgtcaccatcagattgagaaatgacttcttgttgcatagaataagagaagacaacgcttcaaaacaacaatttttttttattattgctcagatcttgaggcaaccactgtgcaagctcttttatctttccaatttgcttcaactgttaaacaaccacagaatggttgacattgagttcttcggcaacttttcatgtagttgtaagagggtcagcttccatgatgactctcaaatggtcattgtcaacttccgatggccggccactgcactcctcatcttcaagcctctcgtctcctttgcaaagcttcttgcctcaccactgcactgtacgttcgttagcagttcctgggccaaatgcatggctgttgttgtgaattgtctctgcttctttacgacacattttgaactcgattaagaaagtcacttgaatttgctttttgtctaacttcatttccataatctaaaataaatatagaataaacagcaagtaataagtaattagcaaaaaaaaataaagtgagaaatgtgcattaaaatgatgtataacataaccacatttatttatgaatgcattccaatactaaacggcaaattttaacaatgcaaaagctgcaattatgtttgcaccaacctgatatttagcacaggcatcacctcacatacgtgtcttgtttaatggtgaaaatatttaagatctgagccattttcaagtacatacattattattaactacagtcaccatgctttatggagtttttattgatacgtacttcaatgcttggtatatatgtaacacattatcctctttccatgcacctctgtgtgtgtgcataaaggtttttcattttctatgtagaaaaacttcaaagtaatcgccatgattttctagtgattgctttaaaatggaaacatatatgattttccatcatttatatatgaattattttgatacactgacagtatggttagcattacgttgtgcaaacttctttcgttaactagttatggaagtgaaatttttttatttctgctgttttttcttattagagtattagaatttcttactgctttttcctttgaaatatatatattattggataagtttgggacactgccagccaaaagtgaaaatggcattaatgggactgagatgtacagatccagcatattctctatgtgggtatcatttctacctttctaattctaatggcttggtggaaccttaggcctacactggatctttggttgaaagatgctcccctccacacatacacacaaacctttccctctgagatatgctgaaggcatctgaattttcttccttagtattcatattttagagcaggcaaccaaaaaggctatgtataggcaggttcttttagccttcagtagcttgctgttttgttgtgttctaatggcattagatgtttctagataagtctgttctctccagatttactcatatctagcatgtttttcatacagattacttggctgtatccaggtggcatgtacgtttaagatagctgcattagtggttaaagaatgctaagcaaaaacaaaccaaccaaccaacaaacaaaaatcaatagtaaaaagagattggagatccttaggagatattaaacctgccagtaacataaggggaaatatgtaaccttcaagaatccataaacatgaaaagtaagttgttggtaagctctaaactcaatgagggaaggaactatgtatttctttacattaaaaaaacctataccacatatgaaagtgtctagcatagttatcaatgctccataaaatgtgttgaatgagtacagcatagtctccattctctttttataatttacttgtgagactagagaatttaggaaatattcttttgtttatcagatttgacaatttaatttttaaaataattaaattaattggaagaaaattactacaactttctggtagagtgtttatatacgtttgtgagtagctgtgttgttttaaaagagtaatattctaaaatagtgtcattaaaatagggaaaatacattattaagttataaagtgaattcatttgaaatcagtcatttaaaatatgtttaaactggattaatttgggtgcatgttttcctttagaataggacctaatatattgccatggctcactcttaaaattatgagaattaaaagaagcttattataatctttacccacaaaatgcatatgatttattatagggttgtgatttttatccaacactcttgtattgaatgatgatgtttaataatattgtaatactgtatgtcagaagatttattgtagttttgatttctctgagccaagagacagagtacttggatgtgttttggtggttgttgactgataagcaataaaatgatcctacatagacctcagtggtaaatgtttttccaactctctctgattaatatgggttttttttggtgtaatatgtcaattttatcagatttaaatttatcattaaactagctggtagtttcagcccctggaaaggctattttgtctgagctatcatattttaagcaatattatttataccacaaggaaggtcctgatgaaaaaaagtcattcttgattaccgtttgatcaaccaaaaatgtctctataacattagatgaaataaatgaactgtatagctgtaggatttgaaactttcaactattgcaaatagatgagtagaagtttccattcactaaagagtcactacatctcttttggccactgatttttttttttttaagtacaagagtctttattctctagagtgtgaaaatgtctacaatactgtgaggcactggaaaaatgaagattactaaagatgaaaaataattcatgtaaaccgtgtgtggtaagtttacaatatttttgagtttaattcaacaaatatgttttgaacatcttctacatgttaggcagtgtgctaggttgaaggtttacagaagtgaatacatcttaagagagagatgagtggagaggagatgtttatggttgctccatatgaaatagccaagcatagaagcatgctgtataaatgctccatgtacagttagctacgaataggagcatctaaataacttttaacttcttgcttcttataatcttcaatacgtctctgtgcttatttatttatatagcaaaatgcatcataggacattgtgtggcaattatggtttataagtacaatgtcaaagttttttgggggtcattgggagcaaaaagctgttagagatttgaaaggcaaacacatattatggaataaaaattttccatttttttgtcaggtaatattttgagagggtagcgatgaggccactggggaggaagagaatttaacatatatgtgattttcaaggtagcaaaagactctggaacccacattgtcccatttctatgaattgcatcatgcctttgttaaaatcactgtgctaacaataagatttcactcagggaaatcaaataacaactctattaagaactttgaaaccatcaaaagaaatcttgacattatatttatcaaatatttgaaatctacgtataaaacaaattatgattaggaaaggaattatgtggatgtaaagaactgtgtattttgcaaaaggcaaagaaacagcaatttagtactctgctctattaaaacacattccgtcctgggattcctttagtttttatatttattcctaatgaaaattcaccctgtaattttgcttggtattttaaaataacattactgagaaaattggacatatttagtagtacatagggataatttctaaaatacaactataagtatttacaaaatatagtaatttttagtgtcctaccatatttgtttgttatatatgttgggagagatgtcattttcttatctattttattcagaaggaaataaatctgatgatgctcatatattttcaaaattccaagcaaaattgttcagaaaaagagttggaaacaactgaagtttattctgttttatttcccaaaattgtatcatagaaacataaaaacaatctaaccaacatggagaaatcccgtctctactaaaaatacaaaattagccaggtgcggtggcacatgcctgtaatcccaactactcgagaggctgaggcaggagaatctcttgaacctgggaggcagaggttgcagtgagccgagatcacaccattgcactccagcctgggcaactagagtgaaactttggctcaaaaaaaaaaggaaaagaaacataaaaacaaggctaggtgatctttatgagaaaatgcttaaaagctatttccacagagtctttttggtctttttctccatgataggtaagcttttaaaaaccgaaagaattaaaaaatataccacacatttgactttttatttttgtagtaccgattttggtcaaagcattcttgaaaaatttaaaaacacatttgcgacttttaacctagtaatctattcttctcagagagcataataagaataccttgctttccaggtatctgggattatggtaccacaaacaggaaggagaaactgaaggataaaggttaacttaggattgggttttttcaagaagtttccagtgttggcacagacacaggctctatctatgcccctttcaattataaaccaacagctctgccgtgaggatatcgtgaatgttcacatctttacctgtcaacacttctgaaaccctttcagcacctatgtctcagtctattcttgatcaaagcatgacctgctcactaaagctttcataagataataatttaataagaaactcccagccagaagacaaaggaaaagattgtgaaggaggccactgctaatttccctccctacataatcaaatcagtacagctatccagccaggactcataacccttaataagtcactctactcgattaagagaaattgattttcctctactgtggatcatagtgattatgataaatatggtatctgccgttcactgcgctccccgggcccaccccccgtttgctgccagtgtccatctgtttgcaggacggcaggtaaacgagctagagagatgacgccgtgtcattaactgcagttggtatcagtgctttgacagctgtggaattgagtgtttccgtagatcagcctagaagcccgtataagaggcttgcgcagcaattacacctcctgacaactctaccagcagccttcaacatgcaaaactcctatgctgcgatttttaattgggaatagggaaagaaaacagataggtgggaatgactgcagtttgaactctagttttaggatatgaagagtgatgtatagaggccaaagagccacatgctaccttcactagattctaacttgatcctaaagttatttggagtctgtggtgggtatgtcttattgtgatctctgtaatcaagtctagatttccagagaaatcaatctctttttaatttaattaatttttttttagaaacagggtttctctctgtcacccaggttggagtgcagtgatgtgatctctgctccctgcagtcttgacctcccaggctcaggtgattcttccacttcagcctcctgaagagctgggattacaggcatgtgccaccatatccggctaatttttttttttttgtatttttagtagagaaggggtttcgctatgttgcccaggctgctgttggcctcctggaatccggcaatcttcttgcgttggcctctcagagtgctgggatttacaagcgtgagccaccacacccagccgcaatatcttaatacaccaatgttgactgtagaatgtttctgccctttcttctcactcacctgaagaatcttgaagcagttggttttattttaatcattttccatcactgtacatcattcaatagtgcttgatattttaacatcagtaaacaaacaaacaaacgaacaaaaaacaggaaagtaatatattctgtcagagcagaattattcaattgcttaaagttttcatataaactttccatgtagcatgttgaatgtttgtttctataattaaaaatacctaagattattgactgggtatctgaaagggattttatacagcacagtacatagagtagcaataataaagatatattttttaccagcttttgcctttgtgagtattttgggtttgggacatggttgtacatatttcctgtttatatattctacacataatgtggtattacagaatgacgaattatagaaagatctggaatattattcttaactaaggaggcagtaagataattaaggagacattgaaagtagacttcagagttcttttcataaaataatagatttatttctcttgattaaggtttttatttggcctaagtctgacttaagatttttataaattagcttcatcattaaataccaatgtactattttttatggtatactaaattgttgctccatttgagaatattctaatagtattagggaaagttagtcttgttaattcatatcttttcctatatatgaataagaaagggcataaaatatgctttttttttttttttttttttttttttaagaaatagggttttgctctgtcacacagactggaatgaagtagtgcagcctcaaactgttgggctcaagtaatcctccaacctcagcgtccccagtagctgggattacaagcatgtgccactacacccaattaattttttttttttttttgagactgagtctcactgtcaccaggctggagtgcagtggcatggtcttggctcactgcaacctccatctccctggttcaagtgattctcctgcctcagcctcctgagtagctgggactacaggtgcatgccaccatgcccagctaatttttgtatttttagtagagatagggtttcactgtgttagccaggatggtctcgatctcctgaccttgtgatccgcccgcctcggccttccaaagtgctgggattacaggcctgagccaccgtgcctggccacacccagttaattttttaaattattttttgtagagacagggtgttattatgctacccaggctggtcttaaactcctaacctcaagcagtcctcccactttggcctcccagagtgctgggattgcgggtgtgagcctctgcatccagcctcttttctaattttaaagatgaactggagagtttcactttattctcacgactcttattgcagagtctactctcctttaaagtaactttagtgttgttacttcttagcttttctcaagaaaataaagccatcacagtggaatttgatgattatttttttttgagacagggttttgctcttgttgcccaggctggcgtgcaatggtgtgatctcggctcactgcaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccggacaagtctgtgcttgagagaaactccccagacgactgcctgcctgtaagagacagtgaggaaacgcaaggcaggagacacattttcttcaattttatctgcgtaagcctgaaactttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtcgatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgagaaaaggaaaaaaaaaatgtctgactctggctctgtgttgcaaagcatgagggtctctgtgctagaccatgacttagcaaccgcgctgtttttaaaagtatttgtgttgtaagaatttattatataattatattctattaaaggtagaataggagcaatctggccagttctaatcactgaatctatagtacaatttgagttgagatgaaacaaaaacagcaatagaggaaaatgttaagagtttttaatgttactgagagttaatctgattatgcttaagactgtggagttggagacaaactgcttccaaattccctgattaaaaaaaattgaaaaattttattttatacaagtaattttctgatgttgaaaaccttgtattatacctccaaaatctgaatgttttaacaaaaggaaaaatctccttccatgtactttattccattaatacactccattcatatttgaaaattattaaattttaaattcaatagtggattgtacttggagcagttcatctaaccagccatttacctagggtgtattaatactaagcagccttgcagccacatctaccaatgtattaagagcctactaataaaaatatgatttactgcctaaagtttctttttgcatccttcatcacttgtctgatttggaagtgtggtatataatgcagatatgaaaccagctcaaagttaacagttcatagctgtaaagatcagtgcatgctcacggcagaacaattttcagagtatgttggtattattaccattttgcactttctaataaaacgttttgttcatgtaggctgtatcttctgcactcaggctttaaaaagacctttcatccccactttctctgaagttggacagcagccgcagtagcagctgcctctttagtcactttgcttcccctcattttgataattatgggcaaaggtcaatcattttcccatcaaggcaaatcctgacaaccccacatgtcagagcctaagttatagatgacatgcttgtcaacaccaaaactcagagagtatatctttacctcctcatgaccagctgaaagtcaaaaccctactgcaaaccagaggcaggaggggatgaaagaagggtggctgtttgccctgactttgtcaactgcagacatagttccaggcagatttttgtaattttaaactctataaatgaacaattacattccactttatacacatgaactgtgagcgtcctgattgaatgcaaatgcttctgttaacaacatgacctcgtagtgccttagacggaaagactttagttttattgtggcgattgttcttaaacctagctgagttttttagattaagatgaaatgttttaaagctgggaggggggacaaataatgatcttttaaaataataactagattctgggtgaactaaaagcctggctaggaccattataggaatacagacactcaattcagttcagtaaacactgaagggataaggagacagacattttatttatatcatgaaattggatattaaatttgcactgctcagattatgtcagatattgatttagattcaattacataatacctcccagtatccctagaatcagcattcaaagaaatatgcattagtgagtatggtggtaactgggtgctaaaagcctaggccaagcaaatcacagaactacctgcaatggaaagtttgtgctccaagggtcctagggtatttgaatttctgaccatctatcaacatgttacctacatgtaccttcaatactcccaacactttgtcctcccagaatatgatatgaggttaaaatttagcccagggtcccaatttaatatctactgatggcgtccctttctttatataatcaaacatttttgtaaaattatttgggtaattttattacaaatactttttaggggctttctgtttcaaagaaacctataataactcttctttttcttcttgttagaacaataataaatcctcctatacagtaaatcattacctcctcacttctcacttgtttaaatcaaaatttttatttactgcattctatgagtgtcagatagtgagttacttacaagtatgctgtgataaattggtaataggacattcattgtcaggatgaaagaaaacattactttccaagaaagttatgacccaatgtgataatttaggattacaaagaaagtgtatgaagtatttcctgaaatgaacaatgtaatttgatcttatagcaagtaatatttatcccagattcttgagaattaaagtctgcatagaaatgtaatgcgttgtgagtctatgattctgtgttgtagctgagcagtacttactctttcctttatatgctaagatgggatgtacatataaagccccccccccttgtaataggcttataacagatgtactcttttataaacagccattatccttggacgtatatctgttcaggcagaatgacctactattggtcccactcttgaagaccattgctttgcttgtcttctgctctggtccattgccttgttgcctacattccagttgttcaccttccatgatgcccgtaagaagagagtcaaaggctgacaaatgcacaggtgttttctcacttttcttacatcctaccccctctcagttattcattatggtaatggcactttgtgatgtgcaatttctggatttatgacccattcttgataagcatgaatctggactgcctgtgcatctttgataaggttctagttggatagcagtgacctttctggatgtaattctgggaggaagattaaaaagcagtccagaaagtgacaggtttgggacaataacgtatgaatttggctctgctggcaggcaagagatgtaagccgtgataaattagaggcaaaccaaacaagcttactgaatgatttttcatttctgctacatccttgggtaaaagtctattgtatgaattgcactaatactgccatattcctctagccgtgtgttagactacttgtttactaattgcataaactggcaaattattccgttaatgtagttttacagtaaccaaaggctgcatactcaattaaaaatatgggcaccattttgcgtacttgtgctgtcttatacgttgaacagtcagtgagcatttggaagagagtcatccaaactcataaaaacctctctctctgtttctctctctctctctttccttccaccccctttctcatatttgtatgaaaagctattagaaatttccatatatatacccaaatcctgaggacatcttttccaagtttagagagttaaagatggattataaagagaatccatttatcaaggtaacttgttaatacactgtccttaatattcttctgtatttgataaagtcttaaactcttaatatatgttccatgttgaatatatagcagaaatacacttgtatagataattatgtttattacgtatttaaaggataagaacacgtacactgacgtgcaagcacatataccccttcagagaaagacagacaaagatttgttttcctccaaagtgatacttctgaggagtgctaatatataataacctaatcttaaggacatgactataataaaggctaaaaagcagttttgtcaggtggctttgtaaatctgtcttctttgctattggagcctgttgcttatacacacatggaatacaaaataaattgtccacgtagcaggcaaatcaatacgcggtggtccctaccaggattaatcatgggaggagttccatcaccactcacacatggctgcattcagggtgcacagggcctattacttctgcatctgtctttaaagggagccctctagagcttgctacaaggggaggagaaggcagctacctcttctgagggcctgaggtaggtcagacaccaggctaggcatgtgcacatacagagttctgttccagtctcaatgcaatgcagcgacctgtcgctagtagccctgtttttacaagtgaaaagagaagtgtgtttccctgccccttcctcagcagaaagtctggcactcagcagtcactctgtcaacggaaaacaaaatgaataaggccgggagaaatgaagtaactcacctaagattgtactaattgaaagcccagcaaatccagatttgaataggactctgtgtgtcttaataccagcaagcaaaccaataaacaaaaagcaaactgccagctgcagtaccttatgacagctttgcaatttacctaccagacaccattttcttaaacagcagcttttttttttttttttttttttttttttttagatggagtctggctctgttgcccaggctggagtgcagtggtacaatcttgacaatcttggctcgctgcaacctctgcctcccaggttcaagcaattctcctgcctcagcctcccgagtagctgggactgcaggcatgcaccaccacacccggctaattttttctatttttagtagacattgggtttcaccgtgttggccaggttgttcttgaactcttgatctcaagtgatccatccacctcagcctcccaaagtactgggattacaggtgtcagccactgcgtccggccccacagcttttttgaaatataattcatgtaccatacaactcatccatttaaagtgtcagacatcactttaatatttatattttatacttactataaactcagtatatataaaatcatagtgcctcttcttttagctgtgtttaatacttatggactgaagacctgttcatttttaacctaagtagagaaaatatagagtcgagagtatttttctcgcttgaaatcagtagtgcctatttttgctaaattttttgattcctaattattgctattcttcctgcatttctctgacatccatcatttcttgcccatttttttttcatattttttagtattctggtgccttcatatttttaccatactggtgtgtcaggcattgggactattcttagaagttgttttgctactctattccactctgtaaacttacggaccattgaattgtcctaaaacatttactttctccatgacacgtgctattcttaaaataagttatgtcaggttaaattaaaaagaaaggccttcaatgactgtcagtgtcctgcatgatccgatcttaccttatttagacaacctttccttttgtaattcctatcagaaaatgccttttctgcacagaccagccacttaatgtctcacttacagtaatgtttatttctaactttgtggcttatctgacttgtttaaccagtttactctcccttttatttccctaattaatatgacccaggatgagaattaaatagtatttcctttatcaaggcttactctcccacacattctcctaatacctttacctaccttgcaatcctgctgggcttgcaatttgtcccccatatttaactcttggcagacagcggtcccatatttttttcctcatgagtatttcctatgtggacatctcgactctctaacaattttaaatttcttgagaatctgttccgtgcctgatttctccctcagcagctttctaccctctttgcagtatgttcttcttaaaataatacattttgatttgtctcaactatatataaaacgcacatgcataggcatatgtacatagttttgtttgaaaagaaaaaagatttacaatttatttaaactttgtaaacttcaaataaaatattggatcaactacattaactcacattggaaaggactctactgatgaaaaatatgacaaatatatggcactggggttttaatgtaaagttagtcactaatttttagaaagtaagctgactgggagaaggaggtgtagataagtagattttcatcaattccaagatacatgcttttgtgataaacttaaatataatttagttttctatcaggcctcaaataccagatagttgtgggccttgtgaaataattttttattaatgccttgccaagtggaacatgatgataaaaatggatagtagctacttctctcatcatttttttgtcttattttaatctctctaaaggtaaaaacatatattatgataggaagtagtcagttgccctggcacatttatttttttgtcattttctcttaagtgttagtattatatacaatgaaggtacttagattcaaattgaaatgaataaagttaattggctttatacctggtttacagttcagagtctctatgatagatacctggagagtgactagtatagtttagctgggtgtgcatgggctgaatggataatatgaagattacatttttatgggagtccaacaaaggagttctaagtaaaagtgatctgtgagccttaaaaaagtattaaaattaaataaaatgaatattgattcctgagaaacatgtttgaagtttgaaccttctggctctaacaattatggttaacaaaaaaatgtgtatttatattttcaaggatattattgtgatttcttgtagctaacgttctgaaggaaccgctgtattttaagtcatgtcttttggcttgacttttttatatggcatgaagttctaaatagctttatacaattaacagaggcattatttttaaatgttaactaggctaggttaatattgtttaggcttttacgtgttttaaaatactcccacatactctaaaaattaagcaaactatagaactatgatggatctagtaagggagcacttttcttggtttatcatcattttttttgcctccatcacacatcgactgaatgagataatcgatggaaagacttgaaataagtgtggcataaacacatcagtttatgtgtttctagaaaagatcttttctgtcacagcaaatgccatggtaaaattcttattttttaattaatattccctcatgttaacaatctaacagcatgcttattcatttgttcttcagtccagtgtggcattattgctgtttgttggttgaacattggctgtggtctgagacgcctggtatcttgagtttctgaggtgatgctgtcatgctcttcacctgcctgaggtggtgattagaaagcacagttacagccactgctcaagtcatctgaaaatttccttcctgctaaatgttacagggtagaggccattagttcttctacaagctacaaactcccagcctgctgccatgtcatgaagccagagaaatcaaaaagccacctactgaccctgcctattgtctgggcttgtcgtcttctgtcagtagtgtgccacaatcagcgagatacacatgtacctcctgcctgctcagggtttggccgccccctgctcccagcacctgtttgcttatacatgagctttgcatgtttgaatttaaatagacacaggagggtggagagagggaggaagggcgatgcctctgtcagccgtgggtcattactacagaggagacaaacccagcgagcagggaaactgggaagcctggtaacgtggtagtgggtgatgaaagatgagtattctccatggaaatcatttttttccccttttaaagttgaatggggtgggtgattattaagacaagattaataatcattttgattatcatatctatcaatagatgatttcttcaattacatagagaattataaatcagatgatgaattgtgacctgggtcttttccaaagttacctttccttgatctcttccaatgatgtcattgcaaaaaattgtctaatttatcaaaaaaacaacatgaaattcaggtatgcgtacaggtgtaaaaaggccaagatttggccaggcatggtggctcacgcttgtaatcccagcactttgggaggccgaggagggcagatcactgagatgaggagttcaagaccagcctggccaaaatggtgaagccccatctctactaaaagcataaaaaattagccgggtgtggtggcacgcgcctgcagtcccagctactcagagattgaggcacaagaatcacttgaacccaggaggcggaggttgcggtgagccaaaattacgccactgcactccaacctgggtgacagagcgagactctgtctcaaaaaacaaaaaacaaaacaaaacaagaaaaatggccaagatttagtaaatatgtacactggggactcatatctgggatatatgcaatatgcacctgtttatggtagaaatttttttacctaagaagaaacaatactatcatctttctatttcaacttgtttactaaattataattttcttaggtttagcaaatgctcatttagtaattgtgtcatcctgcatctgggcttctaggctttgaattagaaaatctgagactgcttgctgcctttggtatttattagttccatgaccttcggtgagttctttaatctgcctgaagctcagtatcttcatccacaaaaagggagcactggtgcccacttgagggggccctaaagggtggaaatttaatgacatgataattgtgagtgctcttttcaaactgtaatgtgttatataaacatcagatattgttactattaagactgatgtcatataagattaaccatggtctccaaaagatacaatactcatagtttcattactaaataaacttttaaagtaaaaccaaaatactttcaaaaataaattgtattaattattaccaccataatactgaaagttttatggaaatatttcctctctaaagcacaccgttgtatgttagaatgttttcctggtgtactcttttactatgtgtaatttaaaaagtaattctagactatcaagatagaattttattataatattactgcttaatatgacactttcttctaattttattgtgccaagaatttgtgcaaaagttacacaggcagatagttaccttcttttttcctttgggttttcaatacgtactctaacaaaggaaagatgaaagaaatcagggagaagatctggcatttagaaacacacactccctcccacacacacatccactccgaaaagttataaaggatctgttgaatttgggggataccttgaagaacttcaagctgtcaccatttcactaccccatgcggtttgagcaaatgagcagccttgaactttgcacacagagacgcgaggcctgggcagaaggcagtgcatctgcaggtccttgcatgactaatttcctgtcagcaagtgattttattatcatttaaataagaatggataataatagctgtaaacttggcagatggctgaattggtaaattttaaaggaggtaggtttgaaatacttctgtgcttcctccttcaatgccttcacccactccttaagccccgtggcaatcaactattttggttaccacttttgatttaaccactgtgttcattcctatcgattaaaggggctttaatagcacaatattgtgatggctgtttaagcagaggacatactgtgtttcattgcttcttatttacactgggcaagggggaagcccagttattggtaggtacttccctcttctaatcatttctgcatgaaactttttttctttctctcttcactcaacgcttaagaggaaaggaaaactacttgaacttcttagttcgtatttctcatataaagttaaaacaatgtataaaaagaactattgtgtattcagttctcatgttcccattccttaatcaacacaggcttatcaatacagcaataaatgaggacagtctgaagcacaggagagatcactaatattgcagccaattttctttcctaaaaagtacaggcgcaaaaataattcatatcagatgaggtcttacaaatattaaacaccattatgtcaagcaaataccgctaaatatgaaacaaaatattgactctattacataatatagttatggttaacaaaataaatctaatagggaattttaaactaccaatttagcttaattaaaaggtacaatttcctcaatcctgattaaataacagtaaaagcatagattgaatccactccctctgagatttttaaaagaatgtttgagaaagcttgatgttggagttataattacacaacagtaatctgcttattcctttgacttaaggtattaagatcgctactaaccaaagttcattaattgaaagcttggagacaaagtaaatttttttttttttttttttttgagacagtctcgcactgtcacccaggctggagtgcggtggcatgatctcagctcactgcaacctctgccccctgggttcaagcgattctcctgcctagcctcctgagtagctgggacaacaggtgcacgccaccacgcctggctaattttttgtattttttagtagagacggggtttcaccatgttggccaggctggtcttaaactcctgacctcgtgatttgcttgcctcgggctcctaaagtgctgggattacaggcatgagccactgcacccggcccaaagtaaattttaatggtatctcgcaaacatatgtgtgaagatagtagtatttaatgtatactagccatgttagcttggggaattagtatttatgcatgcccttactaagctttcttagcaggtgtcttcatgcttagaaaagtcaacttgcaacccgtgtgtaagacaaaacatttgtcacgagttcagtacttgtcaagtgggatgtacattctcagaggtcaatagtggcttataggagatttagatgtgtctgttggcattaatcagctacacacatcactctcatccaactcacagcttgaacttccttacctaccaatatctgtgttggctgcctgaaaagcaaactgttgagcaacagatttaagaatagatgattgacttggttccattcaatcttgtcccagatgtgatctctattaaatattttggtgattaggccttattcctattttgctttttttttttctgcttttgtgattccattgtccattagtgttgtggttctcatttcctttctctctaaattctgcatatttatttgttaatgtactgtatttagtgtactgtttaggcgggattacaaataacttgtgaaataacaggaaaattgatgaaaaaagaaagagcaaaagacaatgcttcctcaggaaaatgtcacattggatgattattttatttgttcctgattttttccttttctgcagatacatgattatataattgtttcagttatatgaaacaaaaattagatgtggaggaaaactctaaatagggaactctaatgttcttttaaaatgaagaatttaacgaaaacactcaaaactcccctgctgggctcaagcaggttgaaattaattcaagacggcagataaaatttttaaccaggccgagtggagatgacggatgtgacagctctcagttaaaatgtcttttagtggcgaatgcatgcatattagtcaagggatgtgacatagctgtcccgggtgagagaaaatgaaccaatgaccatttgcattgagaacaaaagaaaaattctttatagcaaaacgtaaagaaagacaagtaacttgaggtttcatatttatttgttcgtgtttgacaatatttttggtaatctttttactgcaagaaaacctctgaaagttagcacaaacatatgtttttaagcagtgattcttttctttctcctccatatatcagaaaataaatgttgagtaaaatgtctgtgcccaggaaagtcaggtaaactatttttttttcccttgcaaagaacaacagaaaagtatctgtagatggtcatacttcaaaagttgtagaaaaaaagccttaccaactgaaaactcagtttcaaatttgcctacatgaataaaatattggaatgagaagcctttttttttttattataagaacactggctccctacttttcttctttctaataataagacaatttggttgtgtattataaagcaaagcaaataaaacaaaaatggatgtgattctatgacagaatgttatagggaaggaaaattatttggaaactacaattggcaggatttgaccatgtgaaagtcaagtttaattaactttaggaacagatgctttcaagacatagcagttaccagttagagctacaagtataattgagttttatagtatagggtttatttttccaattaaaatcaaattgcattatcataattttgttattagaagatgtaacactctggcttaaaaggggtactcaaatgtagacctagatcttgtcctcttttgatcaaaagaaaagaatggacaaagatgtattttagtctcaacattaaatacaatttccactttagaaggtagttgttacttcctttaataatgtatcctccccaaaatggtatatgagaacataaaaatttattacaacattagagccaaaaatagaatacaaatatttgtatacaaatattcagtgatgctaactggattcagaaaatgctaccgaattaaaattataatttatctgggtcttcagtgataaataggaatcccttacttaagggagatgaagtttatttaaggcgaggtaaatggagaagtaagtttttctcctgtatttttggccttttcttgtctctcttttctggaattatcaagctttctctcattcagatgaatgctttgtgaatcttctctttttgaatctgcagtgtaattctatgtggacagacagctttctgttaacatacactattttgacagactacaacttgatttgctgttcaggctttgactatattcacattatggcttaagtattttctttcatagtcatttaccaagtgcccaacacatttttaaatcagagaaaaatacattttatttactttccatgccgagctcagcaagaaatggtattttctcctatgtcttgcattaaaaattgcatttgcaaatggcatatttagatgatgttgaagaaattaagcaatatcagttgtaccttttcatagtgtaaacatgtaaaatttctttaaataggaaaatactattggttttcttggaatcgctcccatttaaattctatcctttagatttttttcagtccaatgcctttgcaaatttctagtacacactttctactactgtaactttagtacatcctcagttttactacattacttgaaaacatgcatttttaacaatctcctgctcttttgcttttgattttctgggcatattcctgttactcaatgtattcattcagcagagtacatttatgctacaactatggactacctgttcacagctgtagattattcagaatcttcttgatactgataatatcttcttatttacagtttgctggtatactgagaaaatgcagtagaataacggaagtacaatgtaagccatataaatcatttaaaatttactaggttccatagtaaagaggaaaacaaaacagctaaaattaatttaatactatatttagcctaatatcccaaattttatatcaataggcaatcagtaaaacatattaatgaaatatgttcattcttttttattatactgaatctttgaaacccagtgcatacttaatacttgcagcacatttaattctaactagccagattttggtgatcaacagccaccgctgactgtggccaccatactggatagtgccactctaagaccttgatactcaaagtgccccatgaacagagagcatccacatcacctgtgagtatgttcgttgtatcaaatctcaggccttatgccaggcctactggatccaaatcttcctttcaacaagatcccgaagttactggatgcacattaaagaaagaaaatcactgcatttctggtttcccaaatgtatagaacattggtgttaatattactgcctatgacatagattcttttccaaacagctttattgagataaaattcatattccttataactcacccttttaacatgcaaagctcaatttttttagtgtattcacaattgtgcaactatttcagttatctaacttgataatatttttcttaccccagaagaaacacttctacccatgagcaatcactcagcacttccttctttgcccagtgactgacaaccactgatctactctatctatggaattgccaattctggacattttatataaatggaattatttaaggtgtggtctttcagtctgtctcgtttcacttagtataagtacattgatctgtagtctttatttcttttgatgcctttgtctagttttattaaaggagtttaaaaatgcttcttcttccagtttttggaagagtttgtgaagaatttgtgttaaatctcctttaaacgtttggtagacttttccagtggtgctgcctgggccagagattttcttgcaggacgttgttttggttatgaattcaatatcgttactggttatatgtctattcagatttttttattttttcttgtttcatatttgatggattgtatctttcttagaatatgttccatgaatgaaatatggtcattaagtgaattgaaaaaggcaaacacttttcctttaccattttcccatgtattttgcagtcaagatcattctttgtaattaccattgtgacagtactacaaccaaaatgagcctttagaagtgtgtaatttctgaaattaaatttatctttatgaattttcgaccaatgctgaatagagaaagatattttattttgccacagttgacttcctagttcctgatcacatgcaataatgagaggaagccagactggaaaaagatgtctccttactaaaataatggaagaagtagcccccattccttccttcgaaataacaacaacaattctaccaacacgcaaaaggtcagagccacattttcatggtataaatgacatctaggttaaatccttatattctgtcttggatgaaacttgatatgattcaatccaaccctccatctaataatgattctttgacatttctattttataatcgggttatagccctttaattttcttgaatgtttactataacaagacaatcacctctcataaaccaatctactctattattagataagtctaaaatttaggagaatctttcttattttaagtagaaaactgtctcctttctatacacatttagttctggctctgccaatatgagcaggatggaacaagcttacttcatctgctacttcacagcccttcagatatcagaaaaagcagtttcttcttaatagactgctaacagaattataatgggatcaaactgaaaaaaaaacttgtgagaacataatctacactaataataatcccctaatgcacttccacttgaaaaaatacacatagtttaatgtatcttctatcaatttctaaacatgggtttttctttcttagtacgaaactgttaaaaagcaatcaataataaataggtacagaggaaaaaaacaggcagtgaggtatgtttagctaaatatgtcctcaaagtgttgattttaaaatggcttgtttttagacgctggtgaggctgtgaagaaaagggaacatttatacatccttggtggggatgtaaattagttcaccactatggaaagtagtttggtggttttggaggtttttcaaatagcttaaaacagaatgaccattcaaaccaacaatcccatttctgggtatatatccaaaagaaaacaaatcgtccaaccaaaaggcgcatgcactggcaagttcatcacaacagtattcacaatagcaaagacatggaatcaaccaaggtgaccatcggcggtggactgtataaagaaaatgtggtgcatgtatgccatgaaatcctatgagccataaataaagaaaatcatatcttctgcagcaacatggatgcagctagaggcttatcttaagtggatcatggcaggaacagaaaaccaaatactccatgttctggtttataagtgagagctaaacactgggtactcaggtacataaagatggcgacaactgaaactggggacttatagatgggggagagaaagagtcagggaagggttgaaaagctacctattgggtactagactcagtacctgagtgatgggattatttgtactccaaacctaagcattacacagtgtactcagttaacaaacctgcacgtatactccctgaaactaaaagttcaaaaataaatattcatttttaaatttgggaaaataaataaataaataaataaataaataaaatggattgtttttgaggcaatgaaattactggacgtatggtcagtgctcagtaaactttagatgactgtggtatataggaaggcaggataatggtcctcaatgatgtctgagtcctaatccctgaatatatctgtgcatatatcagattcatagcaagggggaattaaattagcagatggaattaaagttgctcatcatctgactttaacatagggagattatcttgaatcatccaagtgggctcagtgaaatcagagagtccctaaaattgaaagagtggagggggataagggatcagagtcatctgatatgagaaggacttcacttgctctagctggtttcaaagatagaagaaagtgcctgccaaccaggaaataaaagtaacctttagaacctggaaaaggcgagggaacagatagtcccacagaacctccagaaaccccgtaaacaacatgatcttagcccagtaagactcatgcagacttctacaggtttctatgataaatgtgttgtttaagctggtaaattgtagcaatttgttacaacagcaacagaaaacgaatacacatgatagttatttaacagaaaactaacacagctactctgttctggattcaggtctaattactaaaacagttcttttgaaagtcaccagttatctccatgttattaaactctgcacattttcagtcttcgtttgacccctcaaaagcacttcatgtcgttaactattccccctttcctctttaaagtacttgttatctttgccttccatggtctttcacttccttgctttctttttaccttcttgacctctttcgtggtcccttttacagctcagtccacctcagttaaacattttagagccttctcctcttcttgctcaggagctctcatctgtggtcattgcttttattgccactctttctagagagcatgcaaattttcatcttcctctgggcctctcttctgagttgtacccacataacccattgcctacctgaattgttttttctttgtcttaaaatttcttcatctcaacatcatccaaaccgaacttataactttcctgtccactgggcaccattctccttctcctttcaaatccaaggcaccttcagtattgctataaattttgtgtctttctgtactggttgagaagggttgagattgggtagaaaatgcatggcaaatgttgtcaggtttgattttactttagatcgtgttaaacaatgtaagattgtttatttatgcatatgaatcattttgtatttttcataattaaattgatgtcaatcccaattttattgaatcccaagtatcagctggctcagcagtcactaagaactgttgtgaatgtgctattgtacctatgacactggaaaaccattatgagttaaaccaattgtcatacatattagttatttgaaattcagtgggaggaacattttcctgtgtattgcaagttgctgtgagaaatgatcagttttctttcaaggatttcagttgtgtatgtgaaataaattcttaacatttttaagctcctgtaatattgcaggcattttactttagtaaaatagtaaataaaatatacttcatttaattttaacaaatttctgctggtgattagtactttttaatatatttattagaatattaattagaatatataaaaatatttattagaatatataaaaatattcattagaatattcattagaatgtataaaaaatagaattaagctagttaattattaaaaaggcaagaatttgaatagagttcttctgtttctaatgcttatattatttttatctatatcggttgttcccaaagtttggtccccacaacagcaacatcaatatcactcgggaacttggtagaaatacaaattcttggacaaccaccccaaatgtacttaatcagaaactctgggatggagcccagtaattggtattgaccaaacaggtgatgtcaatgatgagtctgcacattaaataggccctacagatgagtttgatacacactaaatgtagaaaaccatattgttataccactgattatatgtctatagaggtgatgcgcccctatctttcttattattctcctttgactcactgatttttgctgctaaagcagaaccaggaaataattcaatgttttattccaacttactaagagatcccatacttaacaatgagtattcctaagtatattaaggttagcatataattgaaaggttaaaatatctaaaattcaattgaatgttttcactgtaaactatattcagcttcattgtcttctgctgaaagtcttattttacttcattatggcagcttaatgattctccaattcccatgttgaatttccaaggaaagaaacttataaaaagtttatgctcggggaattcttttgctttctgtgtgggagtggagcagttctttacacatcttccttacctccattgaaaaagacaaggtaactgaaggctgttggagtccatggggtgaggacttgttagcaattagtaatatgtgaagaaactgtctgttccctattttttggtatgctgaccataaattgatttgagtattcttgctttactttattgtaggttgaagggagctattgcttatgaggaaattcattgtgttctaaagccaattctaaatcagagtttgagacactgtttctatattagagattatctatattttattctggagggcaaaaattgccacttagatattacatgtcagtgcatatatatttctaaatttctcaggggagttgtgggagataaacaataatagtacacagtgaaagtccttgaatacggccctgattgtcccttcttttagcctagatgttcatatttcagttgtttgatttaatgaatagaaagggaaacataataattacaactcaaaattctcatatgaaatgaatctaatctcattcaagttgtctagtccctaaacacagtcagtaaaaggatactttagagctgttctcttgcaggctgagccgaggagtgaaaatggttaactgaaaactttgaaggatatttaagttgaccatgtgcagtgcatgtattggacaccagccaggacccagtaaaccccctgtgccaacattgggtagaactcattgataaccaaaagcagttagtagaacctgtctcagtgagtacgttggtcaatacaggcttcatgggaatggcccctgttattaatgtttgaagactatgacttgcccttacatggctgtgatttagagaactacccactgaagtcactgatgtagttcagtgtgtgaaaaacagacggcaaaccatatgaggtaagttaatacatgtaactggggatactgcaggaaggagacagttgaattctttggagaaaaagtggtttacaaattgaatacattaaaaatgaatattattactggtttactcatcacataaagaatagggccaggggataaatacctctctagctcttgcaactcaagagatgtttttcatatcttagataataaatacttgcagtaggtttagctcataactaaaagtatgtgctaagagactcccctagaagagtttgtcttccgacatgctgaattgccctggggttggtggcagcttaataaaatatgtgagtgttcagtgcggagctgttaagttatttattccacttctgatactgcatgcatgaactgccactgtttgatgaatcactgaagagaatgggaactgacaaacaactcttcctttagcggctgatcacactgacagcatcaatagaaaaacacatcatgggttctaaaatgccacattttcaccgtttaccctgaataagacatgaagctctttaaggaaagcagtagtacgttatcattaagggccagctgacagagaggcaagtgtgctttgaactctctcaagtcatcattcttaatttcttctcttcttagatggaaggcccacccacatgggttctgagcaaggcagggactgttgcaccttttaaaatctcattgatagattggtttcatcaacacccatcctgactcctgcccatcgggagaagctcctattctcattagggtcctgtaatgtctgcagctaacattgttctcatgcaaatagaatgacacagaagatcagtgccatgaaaattcaatttcccccaaccatcattaccctttttcttttagttattcccactccaatctgcaggaggtaatgtgtgcaatctgctggtactgtgcaagatgattactacattttagtgatgaatttcccagctattgcactagggggtgttttagcaggttccctgatacacctaatgtagatgtggcagtagtccttgcagtccttacccagctcttccatagtggatttccacaaggagtggatgcctggtcagtagaacttgtattcaatactgttcattctttagtcatcagtggcacttgtgaaagtagtgatttgtttaatgttgtctgaaaaataaaaataaaatatatctctacctgtccaaattgaaggattaaaagctctgtcaaaagaaatgtagtaatttttgtctttagtctatgatcaaacttgggtaatttaataaggatgtaaaattcagggtagctcatataaacatattgaaattataaaagtgtgtaagttaaataaaaatcctgttttagaaagaactatggagaagtcctacttgtgtgcagctgaaaagtaaggtaattaccaaagtatatttcaaattcctatacttaatattatcctttatctttgaagtttcttcagcaatgggattaaatatgtaaacattatattgtcagtggtttattacgttttagaagttctttgtttcttctgaaattatccccttgcctcttcattagtctggaagttagctgtaagaaaaaataaagggagagagaatgaagaaaaaatatatagattcaccaggcattacagatttgtatgtatgcccctgttcaccacaaacacaaaacatgattatagtttctctggcgattattagcctaataataattgtaaagggcaactatacaaaacacgattttcaatgtaatttttataaaacttatttatttcacaaataaatagatataatctttcccagtgaataaaatactttacatatggtagcattttacgtacaaaggtgactaaaagaattcagagttttaaacatttatttgaaagaaagaatgataattattttataaagtttttttggaaaatacttttttcttacacatggtgatgatgtatttgtagataaattgtatttatgcaattccattcacatgattttgagatattttcattggattgattactggctgaattagacatttttaaattactgaaatgtaccctcttaataatatatccttataattatgtcagagaggctgatataatgaaaaaaggagtcaagttatttctttacctgaattattctgttctataaactgatatatgtaatacatttcagtaactgtggcgaaaccatttagactgtctatgggacacaccatgcagtttagatgtgagcagttgcctacatgtggtacagaaagtcatatttgaactacagttttagtaccgctactttaagatagattctgagcatgtaattactgcagtcttggcatgtaattaccccggagttacagtttatattgacctccagaaataatgagactgtaattttaaagtaaaacatagaacttgagtgtaaaattgtatgttgattttgaactgcttgcattgtgagtttgttctcctgaagaataacttattactatgataattatcccagtttcctatggattcagaatatgtagagtgttattaaagcatcctttatgactgagtggttaactggttccacagataggtaaaagaaggagtactccagtggtttgaaagaagctgctgattacaaaagctccctccctgtaagcttcatggcctgcacttctcagaaagatagactcaatggagcatgactgcctagggcatctgggtcccaggaggttttagttgtttgtttaggtgttgagaaaaacacattatgaccgtaataataattatgtgtttggaattggatttttgcatctgtaacacaaagttccatcttgcataaaatgcaacctcagcaccattttatgcttaatttgcatatgaagcaatatgggactattcaaatataggcttcatttgactacgtaccaccagtgttaatttagtatagtattaaatgtctctgatgaccactcttcaagcaatgtttggactctttattaaggacaaatgtgtgtacacactcttagatgatattaaaactaaggttaaaagattttaaattattttcagtagtgtgtcacttttaaatacttttgcataacctgaagagagtaaagtagttgaacattatttagatagtgatttcatagcaattggttttttattttctgaaatatagcccagagatattttattttttgcttattataagaaatcacatttcaaaatacacaattcagtttgaaaatcagtaagttagctttatttattcccaggtgttttctgaaaatacgttttttttttcttagcctttcttaaggcaagaagcagtcattcaatttcccttattcttttctctctccttcatctttctcctttcttacccctttttctgttgtcatggttttttactaaagcatgtagttcttcttctgtacagaaacattccatgtaatcctcaaattaataacttcatccaaattatctacaaagtcatggtttgacagtaatgtacccacaatatttctctagtgcaaattcagccgtaccagtaatgtgttaaaaagtcatctttttctaaagaagctatagatataattcatctcttcttgaattcaatttgtaaaaatttgagagttaacttatcatattttaacttggaacatttgcaaaccttcttatgtcatagcttctcagtattaaaaaaaaaatagggcatatggcagaaaaccatactctgtaaaacacgacagctcaggagaaaaaaataaaacagcttaagaacaaatattatgtccatacactaataacaacatggtgtatatttgtactgtattttttattttcaccatttaatttgaaattattggatggtttaaatatataattctgaatggtggatagatattaaaataatatttagcttcataagtattgaccttacacatttagatgtcctccagacaaagaatgaacatgaaggtatcgtgctaggaaaagaattaccgttgtcttctgtgtttcattaaaatagctttcaggcagataaacaactgtttccgtacgtaagatccaagaaataccattttatggatgccaagttcagcgtcttagtgagttctggaaacttacataatggaaacagtacacacctgcctctgtgtcactctctccctgattaaaagtgatatggctaaggacatgaagaaccatctccctcttttatgaatcaaataacgtatgctttataaatgttatgtatttattctttcctctaataaggctacacatgggtttaaagcattgaggcctgcgttagggagatcagcactagaggtcagagacattcagaatcctgcagtttagcatttagcaatgttactttcttttttcttttcttttttttcttttgagatggagtcttgctctgtctcccaggctggagtttagtggcacaattttggcttactgcaaccttggcctcctgggttcaagcaattgtcctgactcagcctcccaagtagctgggatcacaagcatgcgccaccatgcccagctaatttttttttttgtatttttagtaaagacagggtttcaccacgttggccaggctggtctcgaactcctgacctcaggtgatccgcctgcctcttcctcccagagtgctgggattacaggtgtgagccaccgtacctggccaagggtattacttttgagttttcaataaaggcagtgttacagattttgcttcatttgaattctatgcaatgtttttgtagttcctgatatcaaagatgtctatcagcttttaaaatgtatatagttaaaggattcctcttgccatctaaacatgcatcaagaataaagaatctatacatagattttacaaaagttattttatgttacataaatcattcagaaatttctattcattcatgtaaggcagaggcatagctgattctgatggtagtcctgctaatcattcaactgctaacttacagagagtccaataacccaatgtcatatgttgtgttgttgtgttgtaaaccattcatttcacaatgctgtgtatttttaaactctttaatcacagaggtcaactataattgctggcatcaatttagagtcctcctgctcttttctttcataatgttccattgtcgcatgctacagtatttataataatttgaaattataactgtatgttcatgtgtttgatgtctgttttctcaacctgactgacaattctatttgttttgttcaccaacttacacctaatatttggacatggtctgggacacatactaagagctcaagaaaagtgcactgaatactcatggtttataatctttgaactgaatatcttactgttactttttttaaaaaaaaatctatatttcaaacttatttctagcatagtcaaaaatggtttctctcaaaggatggatgtatagctaggcagacatacatacagataaaattgatatattcatatacacatagagttctgttcttaagttgtaattatgtttgaatcaactacatatttcatcaacttcccactgcatagaaacagtctgattagaggatccattctaatacagaaacatacatagatgtgtagagatgctacatgaatgttgatactctggttgtgatattgtgctataggtttgcaagatgtaaccattggtggaaactaggtaaagggtgcaatttatctttgtattgtttcttgtagctgggtacgaatctacaattatctcaaaataaaaaataaaaaagtggtatgtggcatttgtgtaaaaattgaaccagacgtagaaaatgaggtgtaaaacaactctttttattattactttagcattagtgacattccatatttatcatttgcacatttaaatagtagggccaggctggtataaagcctttttaccgtccgggagggaggtggggggtcagccccccgcccggccagccgccccgtccgggagggaggtgggggggtcagccccccgcctggccagcagtgctgtccgggagggaggtgggggggtcagccccccgcccggccagccgtgctgtccgggagggaggtgggggggtcagacccccgcccggccagccgccccgtccgggaggtgaggggcgcctctgcccggctgcccctactgggaagtgaggagcccctctgcccggccagccgccccgtccgggagggaggtgggggggtcagccccccgcctggccagccgtgctgtccgggagggaggtgggggtgtcagccctccgcccggccagccaccccgtccgggagggaagtgggggggtcagacccccgcccggccagccgccccgtccgggaggtgaggggcgcctctgcccggctgcccctactgggaagtgaggagcccctcagcccggccagccaccccgtccgggagggaggtgggggggtcagccccccgcccggccagccgccccgtccgggagggaggtgggggcggtcagccccccaacccggccagccgccccgtccgggaggtgaggggcgcctctgcccggcggcccttactgggaggtgaggagcccctctgcccggccaccaccccgtctgggaggtgtgcccaacggctcattgagaacgggccaggatgacaatggcggttttgtggaatggaaaggggggaaaggcggggaaaagattgagaaatcggatggttgccgtgtctgtgtggaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggtggtgcaagatgtgctttgttaaacagatgcttgaaagcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatcagtgataatttgttgatatattcattagttgtccacattccctaactcctatatttttgtaaacttttaattgaagtataacatatatacagaaaagtaacaagaaggcttaagtatccagcttgatgaatttttgcaaactgaacacatctgtatcaccagcacctggattgtgaaatagaccatgaaaagcaccacagaagccctctcatgccgtatctcaatctttaccaagagaacctatcttctgactccatagagctgtcttcttttatccccaacttttctatttttaaaaatttcagtatatagaaatttcaaagagtaaagagtagcaagcattacccatcacctagatgcaatatttgttactattttgctgaagtctatctctctctgtatgtacaacacgtaccatttgagtgtgttatttgcagatggtgatactttacccataagtactccagcatgtatctccagccggatcaacatggcaaaacccactctctactaagaatacaaaaattagccagatgtggtggcatgtgcccgtagtcccagctgcttgcgtggctgaggcataagaatagctcgaacccaggaggcggaggttgtagtaagccaagatcctgccactgcactccagcttgggcaacagggagaaactctgtctcaaaatttaaaaaaaagaaaaaaaagaaaaaagaaagaaacattcttctacataatcacaatattttcacactcaggaaatttaatattgatataatcttattatttataaaaattccataaccagatatccccaattgattcaattgcatctatcataatgtttttgacacaagatttaattcgggattatgcattgcctttggcccaatatctgtttttccttttctcttgttctatctcttagtttgaaaactttttccagccttttaaaaaatatttaatgacacagaagtgttttttttgtttgtttgtttgttttaggcggagtctcactctgtcgcccaggctggggtgcggtggcgccatcttggctcactgcaggctccacctcccgggttcccgccattctcctgcctcagcctcccgagtagctgggactacaggcgccgccaccactcccggctaatttttttttgtatttttagtagagatggtgtttcaccggttagccaggatggtctcgatctcctgacctcgtgatccgcctgcatcggcctcccaaagtgctgggattacaggcgtgagcccccgcgcccggccgacacagaggtttttaagcagtccaggccaattgtttcatagatagatgcctcatacatatttatgtctcatagaaaaagttacaaatgtcaactcattgctatttatgatgtttctttattctttcttgcacttacatggttcagcatctggcccgtaggaggtaccaaatggtgataagttcattatactatcagtttaaaatcttgtctaccagctctgtgacaaactgtacaaatttgagtaagcctgttagcccctttagacctaaatatctcatctttgagtaaattgactggattatcttccattgataaaattgtgttatttatttaaacattgtatttggccatgttaccatatttgaagttagtattactaccatggaatggaaaattatataaatatttcatcatctagtattctgaatagagtatcaactaattgtacaatcttatgaatggttaccaaagaatttcagaacattctgtgtagaaaatatagtataaaaagtctttgcaattgctctaatttagacttccaagttgttaaaacatcttttgaagacctaggtggcctcactgctaggtatactctctttattcactttatctgttgcatcctttatagcctacttgggaactttttttccttgagctcccagcataagagaggctactggggtggcagttaaacccatatgtataattttgccctgtatttcatttcataaatatataagtctttttctgtattcttcaagacactgaattttctgcatgatatttaggccttaacaagttatggtagtttagaaaaagatatttaaaaaacattgtatcttgttgtgtacattagtactgttacaaaggttaatacatatttttttaatatgctgaattagcccttgggtcttctcacttaacaattttgacaaggttttatggaagttaccctgacacttccattagttattggacaactggaccttcttttctaattgtcttccaaaaaaggggacatgatgtttctctgccgcattaactttgttgtttcctgtaaaacttagcaggcaaaaatctgagcttgtaaatgagagacttgtcttcgtcttgatcagagacatgaaatttgcaatttaaatgagaaaaaataatgaacttaatgcataccttgaaagaagtgttgtaatgtgccaatttggttctcataaagttgattctacacatccctatgaaggtattgattgtgtccatgtagtaaagctgagggtgccgtgaactcctcagtgacttggcatttcatcgttacagacaatcagccttccaagcacttggcttaacatacctccagcccctaaatacatgacgaagtcagtggcagaatggctgtgcaagtagtctggctcttaaccttaatgctagccttggtcttatgaaatcttgttattaagaaaacctcatggctatatacagttaaaaatgaatgtcactgtgaaatctctacttttaaggagttatctggcctccattggtagtatttgcctactcatatttgtcaagttattctttgaaaactagcaggaagaataggaaataagaagtctgatttgaaatcttggtcttccttttcttatttcctttaccccagagacccagaaaatggagctagctacatttctcacacttactgtcatagttacatgtttatattctattagttgtaattatttttcacctatcctctcattagaatgttatacctatagagcagataccattccagttttaattttttgccccgactcctagtaagtacgtgacctattacagggaacttaaaacaaacaaaaagtctgctgagtctgggatgttttaaggatcgaaggaacatgttggtccaatttgccttcacagagggttacctctgctttctaccgaatgtgaattgctcccatgtgattttgaagaattccagtctacctcagggaaggaccacatgtaatgccagagtctgcaaacttggcagcttttaccctctctcatctgtgggattgttttgtcctgggtttagatagctaagtgtctgtaaaaagattctttttgtcattaaggagcaacaggaaatggagagcagcagtgactccatttccagtgtctaaagaagaagacttaagcacaaagtaaggactttccctctccacttgtttaatataatgctctgattgcatccacacgtatgcaaatggaaacattcagattccagctcctaaggacatgtgaataaatgaaatatgtgtccgtgttcttatttgctgagtgaatttatgaacaagtcaataggctgttacagataaagtgattatttaacattgtgttaaaaacttcacttggaaacttggattatttcttaatatttataattggctatcttagccaattatcttagatacctatgattaaaatagccctgtttgaatttttgtcttcaaatttgtcaagttttagtaagcatgtgtcattatctaccagaccacctctaaattaaaataaaaagagataatcagaatactgacttgccaagttgtttgtgaatcacacttaccaggtaccagatttgtagttaaactcctcccagaatttttccattagtgttatagaaatttcacatgctaaatacaatgcaagtatatactgttaaaattttcagaatatcgtttctgaaaattactttgctccctgcaaatccaccctactcacctgtatcatttgagtgaaaacttttctgtgtaactgtgactgagcagttaaaccagaaacctgctttaggtaaggactgccttgatgtttgcaatttttcccacttttttcttttcctttctttttttattttttcattttaaagataaaggtcactctaagaaggtagttcctgagttaaaagtgttccatagggttggggattacaatagaaacagacaccgttccccaccaagggggcaggagttgagcatgagcctccccactgtggtcgtcctggggtctctggggggtgggatggcatctgacagtgatgggcttttcttgatggcttcctttctttgtacctaactctggtccataaatagagcatcacatcatgctcccagactgacaccggggaagcttcataaatcagcaagtgagtgttccggcatgatcctttggccactgccttccctccagagctgacacctgtcaccttttaaagagtgtacattctctgtcactgtagctgattcctgtcttttctttattcattctcatatgctgcctaggtggtattatctgggtggctgcccatatattatttaaatcattaccagtatggcctaggtaggtttttaattatgcctaaaaacttgatagttccagatagttattgggtatacaactaagaatataatacaaaatgcattttatttttaaaagaacatacatatgtgtttaacagatctaattatatatatatttataatcaacaatagaatattgcatttaggtggcttataaataataccttaaagcacttaaaatgataagaattcttaagaatctgtaagaatctgagagttaaggaaagtgctttgaatatccttagactgttaccttttccaataagtcagtaagcattggtgatttgttaatattataaaatacgtatcttctctgtggcacacgtcactttattggagaaacatatgtgactcaactcaactgttatctggtcctattttgccctaattatggtttctatttaaatggcattatagaatcgcttagcttttaaagaggggcagtggaaaagatctgtaaaacttcagcaagtctataatctacatgagcagaaatttacctctcttaaatgtctacatattaatgacattaaaaataaaataatcgacccatgttggggatttctgtgctttccccaaatgaatgtttaaaattttattttgaattctattaaagtgaataatgaccacaaggtgtttgtaattggggagatagtaagtgcaaaatacaagcagagggtgcttaaaaagaacaaaaaaagtctgtttcttattgattggcctgtggtgggataaatgtgtggcttctgcctttaatggaagctgattgttcagggatgtgccggtgagactggtcgattcttgagctgttgtttactgggaaggacaatatgaattttctagagggatgattggtgggatgtcaaggctgtcacccttttctcctcgtcactgacagacagcccggtgacaattaccagtgatgggacattgcctgcactggcatatacactagaggatataactggcaaacaacaagagaggaaagcactcctggaaaaaagatataatcagcagttgtcaggactggttacatatctgatgtctgcataacagggccaaggcacattagctttaccactggggtaacatgcagcctgcttcgtcctgcttagaaaactgatcttagaaattttgggaagtttagaggataacaagaattgttggcattctttctacttgacagttaatataagaaaaaaagtattttacttattttttctaattaaaataaactttgggaaattcaaatggactggaaagtagatatttgtattctttacagaaatagttatatttgtggtatgtttcctcatgagttaacttttatgacttttcttgccaggcttctgttattggcaaaagtccaaatggacactaataagttgtgttgtacaggtatcagaatgagagactcaattccataattttgccagagaagcatcatttaaatggtggagtatgttctatgctaggtaggtagtacacagacatatccaccagattttctataaagattcttctgtcagtctcatgctgtctatttccttccgttccattgcttcggaatttcaaataagtttaaagaaaaagatcagcatttccaaagcctaccttaatgtgtagagaaactaatacctaaattagaccacctggaataaaagagccgtcaagtagctgtatttatttctcagcaagagactattctttgtgttaatttacaaatgtaacttatttaattaatcatgtttaggctaatcacctcttagagtcaatgtattctgctggaagtttactgtttggaaaaattcacaataagtatagttttatacagtcaaatttacatatttttgttctgtaggaattagtcatctctttccacccagggttttcttaacatcaaaatgaaaatgtctccgcatgctcaggtaagaagatttttgtcagtttcccaccaaaatatggactgggaacaccttgtaagcttctactcaaatgcctaatgaggattacttttttcataattggtcactgtagagatgaaaataattggctacctaatgttggttatctcctatctgtgtggcatccatgacttacatcagatgtatttctttttttgtgagaattattttcttaaatgtcttttctgatttttttttaaaaatgtgttaattacagaatttggcaaacattataaagtgcaaataacggtatgaaaatcatgcattattctaccattcagaggagtgcattgttaacattttagtattttttccatttggcttttgtttgaagattttaactgtttacatttgtgtatgttctgttgagtgttttcagtgatgccatttttcatcttgaatcaatatatagacaagtagtgtgattttggtagtgtccttttattttaaataagtaggttttaatactgctgagtgattacatatggaggttatttctggttgggcttataagattccatataaaagttataattaatttccttccttaaaccaagggctaattgattttccattgcactcattaaaaatagatacttagcttttcagaagattgtctcagaaacccaaggcagggcccaggccctctgggatgccatcaactgaccattccatcagtcctagaattgtgaccctcctacttgtcagaactgaagtatttatcccatttcccagcagataaacatttgcaaggcaaataataaattagccattaatcagaagaatgtttgcattcgatgaactctgaatggagtggagatgtcaggtagatagacaaggtaaatcaacatggcagaatcaatcacaaggaagagccagccataatttagaaagcattgacccaaatatttaacgactttggaaggtaagaacattttgtaaaggaagaaagctatttagaaaaaggtgtgggtagattttaataatagatagcaattaagttttaaacatttaaggcttcagcctaatgatagacatttggaagtttgatttgaaaaaagagacactgtcaaatatttatttttaaaggcccgtgtgttcaaataattttttctttcccaggagtgctctcatgaaatgtacccacattataattttttttcaaaaaaacaatttagcaagtatattgttttaaaagcaagaagtgaccttgttatgttggtgttctttgattcctaattgtgtttgccccttcatgtgtatgatgcaaagactttcagattgagagtctgaaagtcccatgtgttgagctttgcttggccacttaataatcatgtggtcctggggaagtaacttaaccttttatgacccgcaatttcctcatttgtaaaataggtcttggcaccattcatttttttacgtagaagacatatgtgtgttgtataaatttattctaaggcattattcatattttaaaattcttaaaaaaatcagttattgttacatatcttgttctcatgtctaatcagttagtgcatatcttgtttctgaaaatgttatacctaaagggattaaaaggctcagtggttataaaaaacaatattatttctcctaattctcatgaggttagaaactacaacctttgttttcttagaactgaccatcagggaaattgcttttgactccaaacacctaccatctggcatatcctatcttctcattataatatgtgatgcctaaatttgtgagacatcctggactctccacatgtgtgtttttcatttcttgaccccaacgtagaagaaaggatggaagtaaatggaataaacataattctcaccgttgctttcctagttcttcatttctcacctactcactttcttcccatgagtacaattctatcccccagttaggttgtgcagatgaggtatcttttcaagtaatgacacctttaaaccaaaacattaactgagtcctgggtgtccccctccccatagctttgcttgactaagaaaattcttctaatccgaaattttaaatgaaaacatgtaatgttgattaacattgcctgaagcacagagtacgattaaaatgttttgagattttagaatatataaatcactcatgcaaaaaaaaaagagttttctttatacaatctagaaacaattatattagcccgtattaataggcttcaaatgaaaaacattgaagccaatacatttcaactgggtgttcatgctacttgctgtggggttttttaaaaatttatttctagttaataccccttatccccatgccatctttgtctttctgtcttagcaggtaactttaacctaaatttcctgaagaaataggaagttattgtatgtgaattatttattgcttacctcaaaatttctccaaatcttcatttatcatttcctatttctgttctgatactcatgtctgtgactaacaaacctatctgcttatgtttatgattttcatttactccagtcgaaacctgtcaaatagctactttttcagtctcattctttattaattcttccttacaatataagcatacccagttctcctccatcttaaacacaggagagtatagataaaaagaaaaattctataagatttcatggagaaaaggaattatgtttagctttggatttcaaaaaggcttcataaaagaaatggcatttaaaaatatcctgaaacactaatattataaagcctgttttaacataaatactacttactgtcaccatacggtttttgtttttaaagttgctcacttctaatacctgaggctacaataaggcacataatcttcctaacagtttcaatttataactcatatttttcatgacaaccctgtcaggtaagttgtattactattctcattctgccgatgtggaaactgagtcaaagaaagattaaacaacctacctgaaactatatatttagtagtaattgttagaaccagagtttgtacctggttggctccaggttctgtgcctggccactattcttattgcttctccacatagtacttgcatatatgattaaccatgaagctgttggctttagaagtcttgcaaatccattttcagaattagtttgggtttttgggttttttcggggttttatagagcatcaatagggaaatagcatgaaataggaacagaaatgtagattggaatgataatgtagaggtccttaaattctagactgaagaattctgacttaatttaattggcacacgatgaggaatcgctcaaaattttgaacatgaagtgatattgttggatctacgtgttagcaacagtggacagttggaggcaggaagtgtgtgaaatggataatcatttagaagctattgcaaccgtgtgggtgagaaaccaggaagcctaaatcaggaaggtgactggaaaggagatacatttgtgagaatggtttaggtagcatttacaggattggccaagctgggatagtcatagatcaaggcaagcagggagagaggtgactccaagattttaaatcataacttagaagataaggagctgctatctgaacactgatcaaatcagcctgaatatttattaataatttgggaaatatctgccttggtacatgttgactttgatatattaatggaaatttcagataacgttttggaaacgtcattctgtaagtagggagaaaaatcagagacagaagtataattttggaagtatctagccaaaggaagttgaaaccatttgagtagatggaataatgaaagaatgaagtatggaagctgaggtggagaaagcctgaaaaattagtctgtggtaggacctccattaaatcagcaaatagcaggaacagaaagaatgagctgggtaagaagagctccaaaagattgagggagaactagaataaggaagaatcataaacaataaaaggaaagggaattctaagaagcaagagagggtcaaaattcatttacttcagagctaattgagaaaaaaaaggtgtttaattcatccaaaatctctaaagaaaaccttctgttggccattattacagataacctttaacaatgataaatgtacagtaactacttacatatgaatgagtcagtgaaaatactcggacggatttttccctttcggtgcattcagggtctgtgtggaagaattaatgctttcagaatatttgtttgtaaacacaccatctctaaagaaaattttagggtttctattgattttttgatcaggtgttcacatatgtttaaaattataatggaagtcaatagataaacgtgacttggtgtacaatatttacctatacatggcattctagaagcatatatcattagaaagatcacaacatagtttgttccattttatgaattgattcttatttatctctgctgccaaaaacttgtggatctcactagagccacacatgcttaaacttaaaaaacaaaaatattttagattagtgaaatccaaaatttacattttacattttttaggaataaactgcattatattaaaactgtatcactggtttgcttgctagatcagaataaattttgatccagaagtctgtgacctcttgtttggatcaagggttgtttcttatataaaacttacaagttcaatactgagactgaacaaagccaggaaacaaaaatataaatttgatatggtctgtttgtagaaaagacaataaaaatgttgagtacttatttacaaagcatgtcttcaaatttttctttaaagaatctgtaggtaatctgtattgtggattcattaagtttttgacttaaaaaaatggaaaaaacacaaaagtaggaaaaagagatttctaaaaggttattgttaccactggttacttgtaaacctacagttcactttgcactaaaactttggatatgtctcattgattagaattttataatataaaaatgcagccaaaatattttgagttttgcattttaacaaaatttcaagtccaaaacctctgaagatgttttttctcattgaactaggcaagtcggaaacatactcttaatcctgtcaatggttctgagagcctctctgctttaaatatatgataatactttgtttcatgtcatcttattattggtagtacagtcatccctcagcatctgtgagagattgcttccaggacctccaggggatatcaacatccatggaggctcaagtctcttctttaaaaaaagactttaaaagtactgtttgcatacaatcttgtgcatcctccttcatactttaaattatttctaaatcacttataatatctaatgtaatataaatgctatgtaactggttgttatactatatttttttatttgtattacctttaattgttgtatggctattcttaaattttttgccaaatatttttatctgagcttgattgaatccacagatgggggccattggatatggagagccaactgtggtttacagtctagttttctatttttctagttaaatatataagtagaaaattaaatttttaatcaataggcaaaagagagcaaggccatatactttacaaagaccatgaatgatttgtgaagtagatctctttcccccttcatgttttccaataagtcaacacaaatctctcttccatttataattatgtacgtatatgtgctaaataaatattatgcttcccattcatacttctgcaactccttcattattttctatttccttcattcagctaatatttttctgaatatttatgtgtctagaagtgtttaggttcaaagagagagcagtagacaataaagacaaagccctgtctctactgaacttcctggggaaagagctcgattgaaggcaaatctataaacaacataaaatttaagattaagtagacagtaaagacaacatcacagaagataaggggtagaacatgctgttgaggtatgggcgcgctacaaggtaggatagatgaagacaatggagaagagcaatgtgttgcatactatttccatgccatataatccagatttatcttacccctccattgatcgttttgccctgtagatctgaagtttccaatgcacaaagatacagtggcagaatacctcaaatctctctcaaatctctgccatttagaactttttgttgatgcctagatggttggctttgtttcttaaagggaaaaagtactctttcagtgtgtttgctctcaactcatgctcaacagcaatgatctcaaatctccaacacttgctcatcaaaaaatatatgctcgcgaatagatttcagtgcttcagattaatgaaaaaatacccatccttactaaacaggtgagaatgcaagctcaagagagccagcaaagagaacattttaaaaaatgttaggcactaataacactttgaataagtgtcattttttgaaataaattttataccccccacagtgtgtatataattatatattgccatgtacatattttaaaaaataatttacataggacatatttgactcagattgcacttaaatattctcttaaatatactcctgaagacattcttatttttagtgctttacagaaatattttgaaaataggaaggctactattagtaagagcaaattgaatttgagtttgatttgttaagaaatacttacgctgttctctctagtcttagtgtggtttcagcattagtcttactcgaggcagttgaatactgatatgattgcagataacttggcaatctgctaatggttccaggaggttcattttgatgtatttagtgaatcttaggtaggtaggtatgtactaacatatcatagtatgtggtacttactatatatattcctcttatttacagctagctacaaaatattgcttagaaacactgaaaatgaaaggctatttttttttaaaaatctgtcttttcctaataaaaattcaagagctttaatatttagtaactgcctttaggtttagtttgtcagtgcccttcacgcgcttaataataggcttcaaaactcctggtcacttgctaataactcttcacttctcgggagattgaattgctataggccagttttcctaataagcctgcaaaaaaaaaaaagttaaattgaagactcatgtacgtatttccttttcagctattttttatacattgccatgcaaatatatttcattttttcatatagctcatgaatgtgcatgaatacatacatatgcacttaacaagaattttgttttgaaaaaaaatactgtggtatatgagaaaaattgtaatattttaaatgaagatattagtaccagagaaatagctaatcaaatgtaagaggcaagaaaaaaaaggccacacattaaacttgtgcatcatcaagatttaaaaaattaataacattaaaaacagttggttaacattcttttcttttgctatctatgtcccgtttcttttaaaccttgaatgtaacatataacatttaatctcctataaaattgtaattattttccaccaaaacacaaatgagtaaacataaacaaaacagaaacaaagattggcctttatggaggaattacatgtgactacaagaagagattttaaacaactgctagggtgcggttaaactgtctcttacaagttgcggttctggatgtactctgttaaggagatagtttcatgaacaggagcccgtttgtaattagataaggaaaactgacagcagcagttgagttagtggctcccatggaatgacaggtattgactgaaccctgggctgtgtttgagatggggagggagtcgataaaagcatcagggcttgtttggagtaacactgccagcaatgctttaatttgccgcctggaaaagagccacagacattcttcccccatgtttagtgttgatgagatctaacacttacatttaatcttctgtttaccactaaaaacacttgtaagtggtatatggcaccacaaagaggaaatagaacagggaagcacattttgtataaattctatgttgcagcccaagtctagaaaaaaacacctcatttgaatcattgaatcaagtgtggaaggaaaagtttaacaacaacaaaaaatcagtttagaacaaatgttttaactgattttgaagaagagatagggagtagaaaatgtttctaaactaccttttgaattctctctctctctctctctctctctctctatatatatatatatgtatttttttttttttttttttgagacagagtctcactgtgtcgccctggctagagtgcagtgggatgatctcggctcactgcaaccttcacctcctgggttcaagcgattctcctgcctcagtctcccaagtagctgggactacacaaattctttatctatttttctatataccatattggtttaatgaaaaaaagactgtaaatggaaaagctgtgatgttcatagacacattagggatgtattattatctctacataatttaaagattcaattttgtactctgtttaaaagcaaatgtattcttattaaatacttcccagatatttttgaaatgtcttacataaaaacatatgtatatataaattctatgataaaatattaatgtatagttttatatgtggtatacactttgacccataatatctacccataaaaatccacaaaagcacccagattttaatactgaccattagagaactcaagcaaaatgatttttgaaaaagagttacttctggaccagatccaacctagctgcatttaacttgctgccaaactcaacagacaccattataaaatttgcacctacttattattacaaattcaagtaatcccctaactgtgaccttcagtgcctaattaaataagggcagcatttaaaaatactagatgacttcaatcttacttagttgccagtgcttaatgcttcccacctgttgtaacacagaaaatgcccaaggtagactgcaatgcctttggttttgccaggaaatttcaaaagcttagggttttgtagtgaatccacactaaactcctgttaggctcaattagatgatgtactgagattatctgacttgttgtggagataattactgtaccagggatgagaggccacccatgcttccaggggaagctcattgaggaggctctttccctatttccatatatattccaaagctgtgtgtgtctgtggaaaatgaattcaccagtgactgagaatacggctctgaatttattaaaataggacttgctgtgctgaaagaattttatttcggtatataattttaagcatggaaaattaaagaaaatcaagagataagtataatagctagtactgtctcacacacgcctaggatcccttagatgtgtaaaatgtatccccccttctaaagtttctgcagaaattaaagagcagaggaattaggatttaaccaaataaaatgtttcgcttgaaaatgcattaatgaatactgtaactaaaagaaaatgatgctcaatattcttgcttttagtgtttttcagaatgtatcaataatgttggatcgcattattttagtatatgtaaattttcaaatatttaattatagtgaaaatattttaaaatgcgaagtctcatatcaattacgtaacatatttttgcaccaagtccaataaacttgattcagtcagccattacataagtagggacaactgttaacatctctcttactggtacaatgattgattgtagttaggataaccctgagtacttcacgtttcacaaaatcagtatgattttagctatatctatcctactgttatgaaagtttttagtcaccttctgatattttgtagatggttatttctttgtatacagttgtttcatgcatagagcttcattttatttctttgcaaagaaatatttaatttatatttgtcagcttttgtaaccatgattaacaagactaattgagattaaagtactgcctatcaaaaaatttccaacagttgggactgaatatttgggcaattcatatgaatttatatttatggtggtggaaaaagccaaataattcagaatttacttgttcattcaacaactaatgtttgagaaccatacttggggttaagctgggacaacaaaagtatacacaagttcctttcttaaaggatcgcttgtctaggaggagagaaagacatgtaaataaatgattgtagagtacagtgtgatcagcacagtaatagaggcatgtgcaagcttgaacagttattctgaaggagggagcaattaattctgtctgagatgggacaggggaaggattgaattcgagcccgttcttttgaataatacatgaaagagcactagtccatcctcctaaattgagtagtttagccaaagagagctgccaacctatcgatcaactgatgagaagacagaacttagacctagcaggcctaaatgaatagtgagctgacacaagcaggtatcagtgccatttgtagctttatccctgaaactgcaatgagttggtgctctcaacaatctctccatagagactctgtgttcccacagctgaagaaactttatacaaaggtgttaagtaaagactgtggagagatgcaggtaactaggtggataaatggtattatatgagacctcctgaatgcaaaaacttttcataaaatacaagtcaccaaatctctttgaatgaaaattttatttaagcatttctgtatgtttggtaaggtattctccctatcttagggaatagaaggaataaacaaaatgaaacaaacaaacaaaaaacctttacttgattttgttctctgcctcaggtcattataatctacccggtcaggctccagactgtctctgtaatttcatactctgtaattcactgatgctggctcctgttttatcactaagccattaagctttctcaaaaataaaacaaaaaacaaaaaattgtatttgttctagcctccaaagctgaaacgttctttcctttatcttctcccccataagctttaaaaatttcaggaaatctagaattccacattctccaatgttgctgtagggattaccttctcaactggacatatgcctgggtggtctataatacttatgggctgagttatttcctcacaaacttcgaatgttaaaattctaaaccctagtgtctcagaatgtaactggatttggagacagggtctttagagaagtaattaagttaaaatgaggtcatcagggtgggccctagactaatgcaacgggtgccctcataagcagaagaaattagaacacaaacacacacagtggaaagaccatgtaaggtcataggaataagatggccatcaagggcagaggccttagaaagaaccaaccctgctgaccccttgatcttgaacttctaggatccagaattgtgaaacaatatatttcttttgtgtcggccacccagaatgtggtattgtgttatggcatccccagccaactactacaatagagatgacaggtattgtttgtgtatttcatcagttcattagcattgatgttttgttccaactggagtttcttaatcacctcttgtgaacatcatacagattactgttcccagagtaagcaccaatacattgctgttgaattgattaactttcttttcatgttttcaaatgatatgccacaattcacaagttgatttgcactgtgctgcttatcacattagcacacagcgtcaatttttctgctgtctttaaccaccatatatttcacattaggttgcatatgagcttagtatcttttcccttctgatcctggacatcattagataccatgaaacaactgaacctccaggataaaaatatttatagctctgctcattgaatgaagaggagcatgtttataagatggttttaatgaatgaaggctctggaggttttcttactgctggacaacataacctgaatctccagagctggttttcactaattacaaagtgtatgcgttttctccttataaatcttgcatcagctttatttttaaattctgagatttgtgaaatactgggtcttttaaatcaaaaatgcaaaactagaaatacagtcattcatttaccaaaaaattttgaagcagctatgcgtgaagcactgtgggagatagaaagatgaattagaagtggactttgccattaataactttacattatgataaagggaatattatatgcaaaaaaggaattatgagtgagtggaaaaatatatgatccagaagtgatgcagacagaatgtgaagaggtcaaaggatcacttctgtttatgggaaccaaataatgacttctggaaagttggtgattgattttagcatgcctaaaacagaggatggggtttgggtttgcacatcagggagatagaagagagaaaatttcaggatggtgggacaatgtgagcaaaaggtaagaaaatatatgtattttcaatccttatctggatttaaagaaaacattgaaataagtttgcttaacattagttaatccttcagtgttagctttaagaaattataggaagtaaaaatacatctactgtttctgagtatgggtttcacatgaaaatgtgctgcgtcttttatgtatacaatgaattatgaagaaaagctttggataatatttcaggacctataattggacaagtaagactgagatgatataatgcttatttttgcatcctcagattctagcatcatagatggcatgtagtagcttacagaacttcttgatgaattcgttgtaatttcagcttgaaatagctaagtagccatagaaatagagtataatgcatggagcagatatctgaaaacagatttggcaaaatttgacaagtctctgggttcagcgctgccataaacagaattgtcaaatatgattttaaggcttgaagctgggatgagaggtagaatgatagttccatcaaaaatgaggacaggagtcagtttattgaaagataatgacttcatttggtgatctgctgttggaaatataggatagtggataggcatcttagattcagatatagataaagtggagaattatctctttggaatggttgttacagacagattactgaaggggaaagtatagagagtcaaaggtgatgctgaagagcaggtttttagtgaatgagtatttttgaaggagagaagaaacggaagcatagaaggaaagaaggcagtagtcagacaaatagaaggtacatcaaaacgtcagtaacaaaaccacaatgtaataccacgttagtcctgcaagaatggccataatcaaaaaatcaaaaagtaatagatgttggtgtggatgcagtgaacagggaacattgctggtgggaatgtaaactagtacacccattatggaaaacagtgtggagagtccttaaagaactaaaagtagaaccaccatttgatccggtgatctcactactgggtgtctacccagaggaaaagaagtgattatatgaaaaagataactgcatgcacatgtgtatagcagcacacttcacaattacagaaaggtgcaacctacccaaatgcccatcaatcaacgagtgaataaataaactgtgatacacacatatatatatatgtatatatatgatggaatactagtcagccataaaaaggaatgaattaatagcatttgcagcaacctggatgagattggagattattgttctaagtgaagtagctcaggagcggaaaaccagacatcgtatgttctcactcacaagtggttgctaagctatgaggatgcaaaggcataagaatgacacaatggactttgggaatttagggggaaaggatggaaaggggatgaaggataaaagactacaaattgggtgcagtgtgtactgctcgggtgatgggtgcacccaaatctcaccatcaccgtgaaataacttgctcatgtaaccgaacaccatctcttcccaaataacctatggaaataagtttttttttttaagtcagtgtcataggaataggaggttagaagtagacaaaaatgtttaatgtcatggggagattaaaatgaagttagtggggaaagacctttggttttgaagaccagaagctttactggtgatcttgtaaagagcaaattctatagattaataactttagattctaactggtaacagagttaagaaataaatgagagattattaataaagtaggaggtgatggtttacaggatcagcaagatgagaagaaaggccctttggaatcaagggagagcatgcaggcaaggctgaggaattgaagtaataatagaaagctagtcagtgaagcagtactttagtcaaatgcaaaagagattatacggagcacagagggcagtctaggacttttacaaaactaaggatgttgatttttcccccatattgagagaattgcttttaatagtcatctctttaagtgtgttaacaatccttgaaggctgatattaataatttcattttagacatcaaaactgagatttttttttgagagtaagcaatgtgattccaaagatataacctggctttaaaacctgcagcctttctactattaccatcttgttttttaatgtttgtcctgactgattagctaattttaaaaatgctttaacttcctttgattaggcaatattatttatagattgaactggcttgctgaattgttacatgttacgtaatgtaatatgaaccatgtcaatgtcagctgattataactcacacttgcggtattcaagaggcaggaagtgaaagctataagttttctgtaatcattgtcacaaatgtaatcgcagctattgtttcttctgtaagattctcattgaagtaaatgaaaatgaagacaaatgaaaacgaagacatcaataagactgatccttcattgtaaaaagctaaaacaggaaagcagtatcaggattaaataagacatctatattaaaatatttcttctatgaagtggataggttagaagaatatgaaattattattagatcctcttaagctaacttatctatctagattaacttgaaactggccattcagcaaagtgcaaactattaataacacattcaggttaaaatgaaatatacctaagatttgtttttgccattcttaggcatccaaaagttctgattggtatcccaaaggcccaacatcccaattgtaccaaaactttgaatacagttcaaaataagtacacttaaaattagcaaagtctatgtcaaaacagtaaaatatccttatatttatgatgattgctttttatctctatagttgtttttggtctcgtttttacaggcaggtgaatataatgacttgttgcacttataaaatacttcagtcccactgcagaatctgtggatcatccttacagtcgctgcctcatgagcaatgctacatattagtattttttgaaaagactttaggcaatctcttcaattttatttattttggcacttggaatctctcttcatattaaattgtagaaaaagcagctctgtaattattttcagtccccaaaagttcagtcttttcaagaataaaaaagtgtattatgtttaaaatgaatgtatagaagtataattagtatatttgtattttctttcatcatagaccattgaaataagtagcagaaaatgactttgcttttttactttaaaactcagtaagggatgaaagttggtaggtaataaaacatattaaatgtaatcaagaatactgactgtctaaatgtacgctataaataaaattatttccaacctctctattaccataaactattagaatagtattttcaaagaaggtgaatgagtaagaccataatttttgtaacattaaacataagaagtcctagatctattatgtcttgcttatgtatcaattatctttgatattatgtggattcttcttctgaattatcagtgttactaaaaaaaagaaagagacagaaagatttgaaatgaagtaggcttatttacttatatattatttgctctgaagggtaaaagccaactaaatggacttacaaacatacggaaaaattaatgtataggatatttttccaaccaaaggattaaataatatgaaagagaaacactaatattagtcaaacagagctacctttaccctagagagttattaaagtctagatgtgttttatatgcaaaatggcctgtcaggattatggaaaaaaattctgacacctgcttctcatcagtgccccagaaacaaaggtgaagaaatgggtttctgagcatgggactgcattgcttcctgggtttgtcttaaaaatacatgtgtttttatgtggcattttcatacttatgtatgagtctttcattcgtttaaggcagaaaaagtgccagtaaaagtaaatgtctagtgctaaaacaaaatacacccttttcaggataaaactggcaacaagcattttattatgttgtaagagaacatttttactgttttctcatatactgttacatctctctacattctgtgttcaccaaaaatttaaaaatcactagtcctgaaattatgaaaatcggccactagaatatttgactaatatatttttagaattatagtcttacatagagccaaatagcagactagaataaaagggattattttaatatattttcaaacaatgcttggtaggaaatgataacatttctagttcaagatcaaatatttgaaacttgaagccagattacttttgtaatcttgtgtgtgtgtgtgtgtgtgagagagagagagagagagagagagaaagagagagacttggctttctgattcaaaatacagaactttttcttatataaaatacgtgtttaagtagacatactgtgtcagacactattaaaaaatgactgagattattccagctgaattagaacccttctcacagattatcacagtgatttggcccccgatgaaatttctgagaattttatacttgtgatgtaacaaattttgtaaatgattattgtactactttgttttggtttgaaattttaaactcttacaactaggtatgatagggttaacatgtggaacatcttgaagattatatggaaactgaagaagttacaggtttgctgagacaagaacactgaagataagatttgtaacactccctcttagaaatgaccatggaaagatgataaatgatatttacctcatatgtcatgataactgttttttaaagaagatatctgtgccctctgttatcaggggtatgggaacatgcatcacttacaaacactcaatcaccgtgacataaagaaatagcaaaccttgaacatgtcagaacagtgcctgttcaatctacttctgtttcttgaacaccgagtttattctcaatattgtatccccaaaacaagtggtctttagaatatgatgtttactttctggtgagacttttgtgaaacatgtaagcgggtatatgagtatacacagtatgtaacaatttaataaaaatatattttagaggcaaaaactatttcgatagaacagcaatgtatctgtagttgtatctttacttaaactgttaatatttattgaatgctttctatatgccagatgctttgctaagagctcatattaaacacaggctggtactgtttttactcccattttacagatacaaaaactgaggcataaagagattaaggagttcaaggtttcccagatgtagttctaccttaagtataatttaccacattatttgaattttctgatactaaattcaattggcttaggttactggtgttagcactcttgtccgtgatctttataaagtatacacttttcatctccatgaaaaagaggaagtagtttgggttgatttaacattgactttgaaatgacgtatttgttcttctgtagtaatatagtatttttctgggggaaaatttgacccttgtttctaaagaatgcatgaaatttctgcaaagatcctatctatattaaacatgggttgtattccaaacatttatgaaagactagtgtacaagtaaaattggatagttatctcaaagttactagaaaattctagctgtgctcagaaaaagtcttgttttgtaggtatttgcaactttttcagagttgcattatctgtgtgtaaaatataaacaagaattctgacctctattcttaactgttgcaccagatgtttctcaaaataaacgatattgtctgagtgctctataaacagattccaacctgaatgcctccttttagcgtccctcccaatttaacacataaatatgaactctattttcttttcagacaaaacctgtatagtgtaactttttttacgagaaaacagtgaaatgtagcattataatctgtgaaaaacaagcaggatcttggcaggcagagtctagcaaggaagtcttgtgttttggctgaacatactctggacttttatcttggctaaagctttttttaaaagaacatgccttaaaataatttgtttctgctgctctatgctagattttgaagagttttatttagtgcctggactcctggtctatgaggaatgtgaagtctgtatacaaaaccattatactgatgacactttaaggaacttctaagatggtagtaaatttgtgttctttatataaattatagaatgatgtacaagaatggttaggtaacctttttaaaaggtgaatagtcctgctggcaagaaacataaatatgaacctcagaaaaaaatgcatcacagaagtccatttttaaataggtgctcctggaaatatttcaaatgttgtaagcaaaaaatcaaaacacagaacttcaggaagataaaaacgaattaacaaccttgctttttgactatagactcccattaaatgctaaataaacacattatacatgtgtgggatatttatctaagttcttatggtcagttaatagtaatagaatacactgtaatactagctacatgtattaatgacttactgggtgacagacattttgcttcgagtatattatttcatttaatcctgaaataaccctaatcggtattgtaagtttaccatgaaaacagattaatgtgagcaccttaattttttgacctgttgtgccactggttagtccagtagagagccataaattgagcagagagccttaattgctcagggactcggtgataggcctaaatagtcatgagggatttcactagatcattcaactctttaaaattgtggcctaagacagataggaactgtgatctctagggataagaggctaatacattaaacttgtataccatcttgcttttggcatttaccatttcgcccttgtattccattttatctaataaaattcaaggcacttggagttttttaaacgtggatattgctgaaagtttcatctaactgggcaaaggctacaagttatgatttagttgttaattagacttaaagaacaaagctaatgctgttccatttagtgagaaaggcctctgaggacctgagaactgaccaatattggttctcctgctgggaaaacactatgcataaacaagtccccagggcttcattactgggccttttacacaaacacaaaatgcatcttagtttatttgaaaatccttacaatgaagctttattgcatatctataaatttttcacgttgacatgtcaaagacttgtaaaagtatactggcgagagaacgataaacattataaataacactttccctttaaatgtaagatgattgtagatagtacacagcatggtcataaaatgaatacagttctgtttggggaagcaattgtgggaatgagtagtaatgtctaaacaggatggcaaactctttattgagaaagtaagcaatgtaacattatttagcgaagttggatatgcaatttttgaagattaggagacaaggtatgtcattttatttggtgattttattaaaagacagttcaaaaataaattttaaatgtcaatatattctcaatgatattattctatctttgcaagtatttttagtgttctgccttatgtgtatgttttaatatgctgaacatgattctttatttaaaaaaagggaaagtacattttcctaagaatttaaaatgtaattccttcatttcataaagtccgtgggtcatactactacaaatttctctactttgccatgttttttatacatatttcttaggaccaattcctatagaataagtataactttaaatgttgaatgtagctattcaagtttggtcatcattggaatgttagtatttctatttatctaccaactaatttgaaccactgagtaaacattcttagctaaaaattgtttcagttattttctactggtcatgcagatatcaaatgtggggctctaaactcagttatttctcattaaatttggaaaatcttttccattttatgaacaaacacaattcctttttttttttttttttttttgagacagagtctcacccaggttggagtgcagtggtgcaatcttggctcactgcaacctctgcctcctgggttcaagcaactctggtgcctcagccccccaagtagctgggactatgggactgtgccacctcacctggcttatttttgtatttttgtattttaagtagagatggggcttcaccatgttggccaggctggtctcaaactcctggcctcaagtgatccacctgcctcagtctccaaaagtgctgggattacaggcatgagccaccaagcccggcccacatttccatttttaatatatactgtgctttacaaatattataatatgttttaaaatatgttcacagaagcacctggtctgtgaatggcatgccagcattaaaaaaaataagcattctttgaatatatatttagttttttaatgtggtaggaaaatcaaagccagagggagtagaaacaaaatttgtgattttctaaatacttcttggctgcagggaagaaaccacgtcccaggcgaagtcctacctaatttgatgataaaattacatggaagggattcttgttggcatgaggacctaccaagatggtcaacagataattcaaaaaaaaaaaaaatttagagataaggtcttgttctgttgtccagaccaggttgtagtgcagtggctctatcatagctcactgcagctttgaacacctgggctcaagcgatcctcctacctcagcctcctgagtagctgggaatacaatagtacaccaccatgcccagctaagttttttttttttttaaagacagggtcttgctatgttgcctaggctggtctcagacttctatctaacctcaagtgattccaacagataacttttgatgaatgtgagaacctttgtaatcttctatgtacttacattaaccaagtaatttcacagacaaatttccttctttttgctaattgggccatgaccttggagtagcaaagggtgaggacaggtcatgacctaatcagcacagggaaataaaattatatcatccctctggtttaagaatttgcaccatagggaattgctctttgaacaagttcttgttctgactgatgcaaaacccctgatgtttcttaaaatttatacaaatttttccagtttccataaaactggaagaaaaaaaagaataaagtgaagcctaccccctcctttttgaagttctgcatactaagtatagtgctactaggaattatttatttgacaaataagtattcatctgttttttaatgtgaaaatcaggaactatattttcagatatttagattaattttatattctgttttgtttttcccacacaactgtcaaaatcaaaagcaaataaaagcaaagtaacatgttgtgtgagatgacagttgatgacagacaccaatgggcatgaatattgattcaaatattttgtttttattatttcacatccaacccagaaacatttgtataataagctagttcttatagttacagttgacagtaggatcagtggcagcttaatccaatcaatcaatttacagacttgctccagattctctgggggtctctccactgaagatctcttcttgtcattggccccattcctgctaattaatgcctagttgtcctgtggtccctggacctactgttctttacgtaagttcacttatgccaaacttaacatggctattagttacctttggcagctcctttctttggctgttacttaatctcacttccatactttctggttacttcagactccttcttacattaaaatcttctgattacatatactagatttgtatttaagatttattttagtgactgcagaaaaatgagttcatttattcaactcaacaagttgaattcattacttgaattcattactgggaattcattaattgacatatgtatattcattgggtaaatcttgtttataaatctctttttaccaatttgaaaaagaactctaaaattttctggaatcagtgttaggttaactgtgattattagtttattctgtctttgacctgttttattgtttaaaactttgcctgaaatgattgatttttggccattaggacaaaatagaaaatataaaattgcattattgggttattagaaatatggcattggatgaaggaatagttatagtataaagcttgatttgtaatattttatttctatcacaaatgcatttttatagtaatcattgtattagtataaatatttaatttccattgttggaaattaaatattacatggctcttggaagaaagaatttcataatataggggcaatgtaattaggattttgcatgttggaaatggcagtaaaatctatcaatatattcccttttataaatctcaacccatgagagaaatgtggtgttgcttcctttcagtgcctaaccaccccttcaaatatgtttttctcctagtttcattacattcaggtaaataggacgctatacagagtataaatctaatattcttttttccccgttaaatttgccatatgagcaatttgtcattgcatctttttatattatatctgacttgtttacaaaatgtagaacattttattatcttgatttttacatgtccaatactttggtgaaatggagaattacaggaagtcaatcaatgaaatattaagcagttataaacagaatgatgtaaacatttttcaaaggaaattttatttaagttaggtttatatagctttttctctttcaaatgaaggtaaatgcactgatgagcagttcaagaaaaaaaatctaaactgacagtaaaattgcaaatgaaattaaggaaaaaggaacagataacacaaaataattttaaagattctcttctttttaacaattggacatttaaagttcctggaagtatagttcacagcaaacattttaaatctgtcttatctatattaataaaacattctaggcttgctttataagaaaactttttagaacgaaatataagcagttttagacttccagatatagcttataataattgtctgtacttgccttgcaaaattatattacaagaagaagcacacttgttatagaagtgctgaattgtatggaacctaaatctgtcaagttacctgtctttcaggtccgtctccccacctaccagacctcattatattatcccgaaaagaacacgatctctttaaggctaggcaagtattgcgctgatgagccagggactgcccaccaattggcaggcccattgggtgataaatgtccaaggacctctaggctgacgacacatttttcatcattaatccagcctattgtaaccagggccactcacattgattcggactagggggcatcatctgctgttaagagggtgatgactcgctaaaaatgaaggcctgaaactaatcaaatatatttagagccttccctggcaacttgctgggagagcagcagtagacagctaataggggagccccagacaggtagcgcggtgctcaccatgctttgtatgggaatgtgagaaatccatttggaagcctgttgtgtaattccagctattatacattgtagtacgaatgtctgtaggattagtccaatactacggtatttgaatgttgcattaaaaatgtagttgagaaataccctgctttttttttttttttttaacctggaactcaattacaaagaacagagaattcgcaaacccagatctctttggaattgctaaattgtttttgtgtttttgaaagtttgcaacagatggtttgagacatatgcttaatatttattttactgaagttgcaaaatttgatgaggagggcatcttttttttttccatttgcagaactcaacaaatagttatgttttgctcttttatactttttaaaacctaattaatgtgtacttaatcagaatatacttaaatacattgtggcagttcaagggcatatgtacatgttatttattgatttttattattaattcatgcatatatattcattttagataaatctttattattttaatttgcattaataaaaaatggcttgagttaagtcataggtggagttgcaaacttgtttgccttaggcaaatgtagaaaaatatgttctttatttcctgcttacacctgattaagcaaaatcaggtacaagtaggaaatagatttaactgattagactcgttcaatggaaaatttcacttatatattgagcctaatatatcaaaaaagggcaaaatatgagaacaatttggcttaattaaaaaaaaggagacctaatgaaattgcttttgataaagaagaaggtagagaaaaaaaaaacaagaaaaagaaaaagtaaaatgaataatgcagaccctccaattgttcaagcagtcctaatgttctacacaggaaaccactatcttctaaaatattttatggaatcatgaaaaaatatttctgctgggtgggaaggcttccgtgtgatttctcttgaagaaagtcttcaatcccattttgaaatctcaattcctccaaattccaaagctgaaatttcacacctttcatgtttgcaagttttaatgagaattatatgtatacttaggtatcaactgcttctagtgttggatgagcttaggtggaaagcttcattaatgagcaatagacaacctcactgaatctacttcgcaatgaatattcagtctggagttcatcttaactgggtccatgaggcacactgccaaaaagcaacttgctattaagcatcaggtaggagcagaaaagagactgggtaaaataattacgttctttaaaaaacaagtttgattatggaatctatttaggtcctgttggttctagtgaagttgagtcagggctagtaagaaaatgtctggaaaaagaggaactgatttgaacactgctgacctttatgcttctgccatcagaaagggggtgagacttcaacagccaatgcaaaggaagctgagaaaaaatcaatttagctttctctgctagacagaataaaggtctctaaagatatccatgttctaattcccagaaaccgtgaactgttattttatggctcaaaagggattgtacagatttgatttaattagggccttgaaatgggaggttatctcaggttatctgggtgtggccagtctagttacatgcacctagaatgtggagaaccttccccttttgtattcaaagggagatgtaattatggaaggcaggtcagagagatacaacattgctctctttgaagatgggggtgagggggaatgagctaagtctatttgtgtatttgtactccaggccctagctagaatgccagcttcacaggggccagaattttgtcctattcacatttgtatcactggcacccagtacagtgcctgacacatagtaggtgcttcataaatatttgattgaataagtgaactagtgaacaaatgaatcgattactacgggcacagtttttcaaattttgataacccataagcataaagaaattgcatgatctccttgttacttacattctttatttataaataatgtctattcatcatacattaaagcaaggggtgattgatagagaatagcaggaaggcctggtcagggtggtcagcactgagaaggaaacatttaagttgaaactcaaggatgagaaagactcagtcttataaagacctaggggaaggaaattttagacagcaaaaaccacctgcttaaacttcctgagatgaaaaagcagttggctgatttaaagcaatgaaagaaggtccggtggctggagagcagtgaacaaaggctagagttaactaatgggaggttagaaggtcattgtggcaatgtcccaatagtgggacacttgaggaccaaaggaatgagttcagattgtacatggctttttcagccgggccccaaaatatttcttagaaagacattttatttacggccaggcgcagtagctcatgcccgtaatcccagcagtttgggaggcccaggtgggcggatcatctgaggtcaggaattctagactagcctagccaatatggtgaaaccctgtctctattaaagatacaaaaaaattagccagacatggtgctgtgtgcctgcaatcccagctactcgggaggctgaggcaggagaatcgcttgaacccgggaggtggaggttgcagtgagctgagattgcaccattgcactccagcctgggcaacagggcgagactctgtcctaaaaaaaaagaaaaaagaaaaaagaaagacattttattttaccaagtattttgtaaaaatatgctctatgttaatgtccttggcattcaatggtccctaccctcaaagattccagactcaagggagacaagtgtgtaaacagataaataaaatacagggtgatacatacaaatgacattgtaaccaacagcaatgattcccagcaggataatattcagtggaagataaagtgtttgctcctctggtgaaagatattttatcatctcatgcaagattccttcctggatttttatctctttgaggcagtacccactccttcactttttcatgcaattgttttccctcttattttgccataccttggagtttttatctaacaagtcttaaatcatcattgcctgtttcccttggaaaccaaggagaacctggttgaacaccagttggggaaatagggatgttgcctgagcttgcagatggtaggagcagacacagtcagccaccagtctttaaatgacggtggtcaggaggtgaccagggagccaccacaagcatattcagagaaaaatcatataggcaagttcagctgtttttattacaggttgaaagtcagtgatttcttagccaaaatggttgatgtcttgttctttagctgattcatctattcatagcggacactcagtgactgaggctgtttttattctgatggactcagtcaccattttttttttttttttttttttgtgacagattctcactgtctcctcaggtctgagtgcagtggtacaattacggcccactgcacctcagcctcctgtgctcaagcaatcctcccacctcagcctcctgagtaggtgggacaacacgcttgtgccaccgtacctcgctaatttttttttttgttgtttatagagatgatgaccccactatgttgccaaggctggtcttgaactcctgtgctcaagtgatcctcctgtctcagcctcccaaagtgttgggattacaggcatgagccactgcacctggcctaattagttattctttatattccattgaaatatactcttagagatattgtaatggaaatattcttattacatattattgcatgcaacaagtaagtgaataaaagagcaggattttatttatataaatttaaaaattatacacttttagatgtataagtatgtataaaaacgacattagaaggagacacacaaagctatctactatttgaaagaagattgcatttggaaggtgttatgaatgactttccttctaacaatgtttttccaacattttaaaatgtagtagtaaagaaatatatgctaataatttgtgtgtatgtatatcctaactaacatattttatatatatatatatatatatatatatatatatatatatatatatatatatatattttagtttctataggtaaagggaataaagcaggaaacatttgaaagattccaaatctggttacttttggtaggtgtcgttattattaaatcaattttagagccacgaagaaaaacacaataaatgcaacttttaaaaatttcaaaaattaaatgggtatcaccccctcatcagtcatacaaaagttttccaaaaacaatatttatattgtgttatgtgcaggctgagggtcccatgaacagttcttttgtcttgcataaagacgatgctcctagtctacaggcagaccagctgttctttccattgtaaagctttatcagaagggctatagttcagctcctttcttagtcaccatatgactttggacaatgaaaatgaaaacaatcacaatgagaatgttcttaaaaggagaaatacctaaaagccattttattttctgagatggtatatggtgtgttagttaccagtaactggagggctgatatggttaagcacattgtgtctgaataacataccaactggcaagcgagggttaccacagacaccataggccaggcacaccttttgcccaccaaggcctcaaattccaggcaatgcataagtacacagtagcacaagtcttttggctgaaaggattatatataattcgaatgcaattattaaacttgctacctctgtcattgctcctgttctttctagttatcatatatgaagctcctactaggtgttcatcattatcactgacctaactagtgaagctatatgacttcattattcttataacaactttgtagggtaagatagtattaacctccttatgctcagtgtggaaaaccaaagctacagagattttatgtaacttgctcaaggtcacactgctcataaaatagaacaacctggagttgaacccagaactttctagattttgtgctctttctacaacttcacattctttttctttttagtgagggaatacctgaccatttcgccactaagaagttttataaatgttataggataatgtaagtggaaaatctttccagaaagcagcaaactccattgcagcgatttgtgcttaactgggaacttgagcacataataacaattacagtttaatttttcttattttttaagttatatttatgatgttactctttgtgcctctaaattgatttaataacaaggccgctgaacctttgaagaccaaggaacatgataaaatattttagaaactcatatatttttacatttgaagatataatatcaatttttcatatttaagttttacataaaagtatgttggtctgtttcctttcactgtatgtgacattgcaatagggcatttatttctgtgtgtcttagcatgtgcatattgaactgaacttgtgcatattcattgtatttgttgcctaaaatttatataatagctggatcttgattttgaagtcatgggtattatttccatgaggggaaaaaacacaaaaaactagacttgtattctaaaatctacagtaagaaacggtgagatataactgccaacaaccagcttcctaaatattgtttatctttagatttttgccttgatcttcaaggacaaaacaagttatgggtggcctaatgggttttactaacttaaaaattgtacatttagattactcacaaattcctaggattaaaacaaattatatatacaagctatttagagctaattgaggagtgtgtatgtttctcaatctacatttttaattaaagcaatagctttaattcctgcatgcctagataggtatgcacattttagaagtcaaagaaagagtcaagaatagtatcaacgatcagagggaagccatccaactgtgaaactactggtcattgagttttttctgagttttaaccatatgtgttaatagcatttgttatacaaaatgttgatcattgtgactgtacaaaatggtatcaacacattttctgcagtgcacaacacttctacctcatgatactttattctaatttgctttatctgattacatctacattttagagtgatagagaaatgctgaatggtttgaagaaagtcaaattaatgatacttctggaggggtgatatagtaacaactactagtgtttttaatatacatctgtcatccttttcattaaaacttagggaaatgagctgggaggaggttgttctgaaatatagttatttctgtccttgtaacttcatcatttgctttaaaaattattattcatagataatttgttttttcttagcatgagtaatgaaatctaagaaatctaagacagccctcaacttattacttgactccccgacttcattcttttccatcttccttcctctattctctctttccccattcccttccctccttccttcttcctcacattcttcttctctttctttcttctttatttccttcattcatcaaatatttattatagtgcctatcaggtgcctccctgggtgatggtagcagcttcatgaaatgaaatttttcaccttctcaagatcacatgaccaagtttaaggcaaaggccttaggacagaaaatactcatccaggacagtttctagcagagctgtggttccgaacttttccagcagagatgcccttatccacagtgtattttagcatgtaggaaaacataatctcagccactcacaggaatgtagctggattggttggcagcagagagctttcaatatcaagtcatggtgtaaagtcagttgggatttgaagggaggtatgtctccctatcatgacgttttgttttatgtccagcgaatcaataaaacaagtaatttattgttccagttccaaatatgcttaaagaataaaagcactgcacataaatgtgctaccctaattgtgtgaaggatttatgtgatttgtaaaatattttttgctagatcactttatccacacttctgattgtgttgactaacaaaattaagtaatctttgatgcaaacatgtcttgagggtgattgatcacactcagttcttgggggtggggtactgttacggcatattgagaatttgcaaataatcttaggttaagcatctgtttttttcttagactgcttactgtgtaaaaataaatcaggttttatatctttgggaaggaaaacctgaataaggaagattgatgtgtaaccgagttatcggaagccaatgatggtgctgaaatttaaaatgtcagttttacagtgtttgaatatagtttctctgtaaaagttactgaatcagacttgtctttttcaagaaaccaaatgccaatttattattcacatagatttcattttttcgtcccttatactacttcacatttttattgaaagaggcttcgaggcttctctttacaagacattttgataatgattgtgttgatagtggcggctgaaactgccgctgttggaattgatttagcagtattttctcattcagtttttgctgcaactctatgagacaggaactttattcacaccgattttgcagataagcaaactgaagtacaagtgaattatggatgtcttcaaggccacacagcttccaaaacttatgcccttaattatgatgcaaagttgcctctctgcatggaaaaagtaactttaataaaagtaaggcctctcttttggcaactatctcttttaggataaaatacagcccacaatttggcctggccttaacctcatgaacacaacttacagaggagataaatgtgctttatagtagaaagtaaataagaatgactcaccatcttggttatgtaaaatatattgaggtctattttgagttagggctcccagcaaaacctggtttaattcttcagtatcctaggaggaactagagatgtaggttcagcaacccagcacaactccatttttacctctgaacctgcttcctcacaatcaatagtaattccctgatcataacatggcattcagtgcatgcaactaaaatatgttactttttttttagcaaaatatgctacttttattttgttcacattatccaaactgtaagaatttttactttaaataaattatatttgatgcttaattgatagatgataaagaattaaggttcagctttttttgtccctcaacaaatatgtgaaatcatttttatgatgcatttatggcaagagttttgtagctttaagtgccatgtttttttgttaggcttttataattttaaaaatctatatgtttaagtttgtattttgaaactttttagacttctaggcctcccttcatttctaataaacatagaaaaatagttaataatttttctagaatatgcaattttcatccttccttttagaggtccaattgactatccagtgggccacctgacagcatgttttataatttagtgttttctctcgaattgtaaatgtgtccaccacaacaaaaacatacgcttcaagacagattatccatgttgttttgttgaaaggtgtaatactgcccaattaaattaactaaaatttaggtagggagataggaatgggtcaagattcgtatcagcagttcaactgaaacgcgacagtccactgattccccttgcggggcctgtgacaggggtgtagctcccctgttcagttgctgcggctgctcagacccctgacgggaggggagcacagaccggcaggtgcaggagccgggcggggcaagtgctctgggctgcagccccgtggtaggtagtatctaggagtggatgcctggggctccagtgttgcaatgctcttttagcctttctgtccgcagacagcttaagtgttaaccagctcagtggaaccattaccttttcaccagggcagagggctagtgtgacagctttctgtatcctgaattcttgtccagtgtcccagaaggatcgggtcacacatgggcttgaaggatgaatttattgagtggcggaggtagctctcagtggggagctgggcgggggcaatggactgggaagatgatcctcccctaaagtttggctgtccagcggccaaactcctctctgagcacccccagcagaactcagctttgtgttcacactccttctcttctctctctttctctgccgtgccgttctgctgttcatctgcttgtctctccatctccttgcctccttctctgctcctggagcctggggttgggagtttatgtgggtacaggatggggggacatggcaggccaaaaggcaactttttgggcttgaaaacagaaatgcctattccccctaagggcagcaggtatccagacttgagggtggggcctttgcatgggaaccttcctcttctaccgtatttccctgtctcctctccatatcacatgcacatgtagtcttaaaccagcttaataagttgcactattgtagaaacaattttacttttttaatgtatgggcaaaaataatactgccgattatatttcaaagataaggaactcactttgagtgaagataaggcaaatattgaaatatatagaaaggttctcacttgaaacatgcgtaagatcagggttacagggaataagaatgtgttagtttcctagggtgactgtaacaatttactacgaaatgagtggcttaaaacaacagaaatgcattatcttacagttttgggggactggaaatttgaaatcaagggacacactccctctgaatgccctgaggaaggatccttctttgtgtctccattttctggtgccctcaggcattccttggttgggctgcgtaactccggtctctgccttctcttcacatgctgtcttcgctttttttctgtcttaacatggtgctcttcctgcatctctctctctctctctgtttttttcttattttattttattttgagacagaattttgctcttgttgctcaggctagagtgcaatggcgcgatctcagctcactgcaacctccacctcccgggttcaagcgattgtcctgcctcagcctcccaactagttgggattacaggtgcccgccaccaagcctggctaatttttgcatttttggtggagacgggtttttaccacactggccaggctggtctcgaattcctgaccttgtgatccgcctgctgtggcctcctatagtgctgggatgacagggtgagccaccgtgcccagacctttcttactataagactccagtcttattgtattaaagaaccacctacccaagtatgacttcatcttaacttgattatgcctgcaaagactctataccgaacgtggtcacatttataggtactgggatttagaatttcaatatatctttttgaggaacacagtctcactcataaagaagataatatatatttttaaaatttttatattatttctttttggaataaggtaattttaatgctagccttttttgcatgaaattaatttagtagtactctcatcagaaaataattacttggcatttttaagtttttgatggacattctaaataacgttgcaatattcttgaattgatagagaattcaagaattctgtaatccattgatgaaaccattcaagaattccagaatccattgatgaaagaagaaaaacatagacaaacagctcaaaccaaggctatgcattatgtgggaccagctcgttaatggtacacagtattttttctgctttcattaatggattggtgatttcaaggacactaactaacctttgcatcataaacattttgtacctataaactacaaataaagaatatagtttaaacaatcgtatgcaaatatgggcataatattaattgaattgatttatttggcaacgcaaactatagttataaataatataaagactatttttatttatgttttgtttttctcacttaccacttatctgcttctctaatcgtctctcttataagagatctaaaattttgaaggagtttgggatatgggagcatttaactggacaattatttctttttctatctattttagttagaatcattctaaaataggataaactttatatgataccaaaaatccattcggacagtcacatttttcatagtaagcgtcaatttaaactaactcttctatatgacataagtcagaattaaagttttgatctgaattatgtatttagatgcttaaatgcctctcattaacttaaggtttttgctaatgcttctatcttttgttcacttagccatcattttatctttaaaatatgcataggaatgtacataagtggagtcataacatcatttttagataaaagttaaaaatgagactgtaattcatttttaacatatttgtatgttgtggctgtacaaaatccaaaagtattttcactctccaatggggatgatgtgcagctcccaaaatggaaatagaggtaacgttccagtgatcataaaaggacagtcataagcttttagtgtgcagcagttttaagactatcctcagttaatgtgaggcaattgcagattcactgcatctgagtttaaacctctcactactttgagtgaagtctattaatgatatgccttccatgcagctgacattttaagatccttgctgcttttcaaaacgcgtgggcactaaagatgtcttcttgctcttgagaattgatttcatacacaacaggagcttgtgatggattcgctcccactgtgggaattgtccgtgagtatccgagggcaggaattggctcagataaaggatctatcctgagcgctctcctgtaaagagtaagatgtgcgcattagaactagctgatgccgagtttaattcccagtctcttttgtgattctaaaccatttgacaagcctctgcctagtgtgagcagattgatcaggaaatttattcatttcatgaccttgtctactcatttatagctcttaaaaaagtacctcacctggaactcaaagctccctaagaatttaaaagttatgaatatatttctttcatctataaaactacattttgctttggataaaatatctagcatttgaggagaatttcatgttagcgcaattgattaggctctatgttacatagatacatcataaattgcttttataataaatttatgttttcttttgttttaaaggacatggggattgagttgcaaccaatagatacagttacacaagccggcatggtcaatagcatgtggatagctgataacaaacagtactagaattgtcagtgtgttttcattgactcctgacctgttaaaacttagctcctgaagacccattagactggacaaaatatacccatttgaatggacagaactaacaggcagatactattattataaagccataaatgagcaatcagtctcatatgtgtttgaagatagactatagattatggttctatgccttatgatacaattactgggttatttgtgtaatttgaaatttgggttttaagaaaaccatattttcttatttcttgaggagaagaaagaaaaccgatatggttggtcatagtaggtaatgagaaaaatggcagaagatgagttcagagagaaaggcatgtccagatgacattgggctgtgtaggttaaaaccttagtacttggacttcattttatctgccaaaagaaccactggagtgctttaaataataacctgatatgtttcatatatttttgagagatcattatggcttatgtattacaaaaaattctgcttcatttctgacaatttataaaatgatttcaagaaacagatctcacatgtgattctttgaaaagcaggcacgatcttctaaagtaaataaagatttttgtacagatattcatctattatctattaaaaactttattccagaattatctggtaatgttaatttcacacagccaatataaacagtaatgaagaaaatggaactcagttatttttgtttcatgatctatgaatctaagaccaaataaattataaaaaataactattcatttgccttagataatcaaaaaacatctctgttgctgattatcaaaatatttatattacaaaaaggttaatggattagtgtcacataaaaacatcttaactgaaggcaaaattgcataacagtattttacttttgcaatgccatctaattttcaatacgttcaaggtaaaaaaaagcaataaaatggaaatggcaataaacataattcattaggcacacactccactttatgagatgatgcaatgaatgtcattagacaatcaatttcttccctggttggtcatttaatggtagaaccagtgggccgattataacgtgggtatgccatattgacaaccgaggcaaattaatatagtggaaaggacactcgtttgagatttaggaagccttgatcagcctattcaactaaagagttgcacaaaaaccatgtttgtggagttagtttcctaatctacaaaattagaggattgaagtagatagtagatccaaaatgctggtccaaggatgaatgtcaggctggccttatcagaattattaggataacttttaaatacaattgattcccagattcttcactcagaaatacttacttattgtgtccagagtggggtctggacagagatttgtaaaaatcacccaggtgattctaatgtgtggggatcttttacaacagatggaatgtatgaccccaaaacatctttctttttgaaagaaaaatctttgaattctgtgtttctctaggctgtttccaagaatctttacattataaattaggctacattacatttgtggatttggtactaaagctcaagatttttttcttctgctttggaggtaagcttatgctttttctatagttagcagcatcctgcacagacatttgtacaaatatctcaattttccttcttcattgtggaaaattgagacatttgtacaaatatctcaattttcctccttcattgcagaaaatggcctaaaaatttgcatgcattttagcctagccattttcttctagtaattattcctaaattatgttcaaaaatgtatgcataattaatgttcttcaacatattttgtaatagtaattaatttaaaacattacaaatatctacaaacaagacataggttaaaaagaattttatgataataatataatattgttaaaaattgtcatataacaatacaatataccctacaggacttaaaatttctgttctagaacaatatttattgacataaaaagtattcaccatatattgctcggtaaagaaacatcaaatggtattcccctatgtttctaaagatgaaaaataaaatctcacaaataatttttttattatactttaagttttagggtacatgtgcacaacgtgcaggtttgttacatatgtatacatgtgccatgttggtgtgctgcacccattaactggtcatttaacattaggtatatctcctaatgctatccctcccccttccccccaccccacaacaggccccagtgtgtgatgttccccttcctgtgtccatgagttctcattgttcaattcccacctatgagtgagaacacgtggtgtttggttgtctgatcttgtgatagtttactgagaatgatgatttccagcctcatccatgtccctacaaaggacatgaacttatcattttttatggctgcatagtattccatggtgtatatgtgccacattttcttaatccagtctatcattgttggacatttgggttggttccaagtctttgctatcgtgaatagtgccgcaataaacatatgtgtgtgtgtgtctttatagcagcatgttttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgttgcctgactttttaatgatcaccattctaactggtgtgcgatggtatctcattgtggttttgctttgcatttctgtgatggccagtgatgatgagcattttttcatgtgtcttttggctgcataaatgtcttcttttgagaagtgtctcttcatatcctttgcccactttttgatggggttgtttctttcttgtaaatttgtttgagttcattgtagattctggatattagccctttgtcagatgagtagattgcaaaatttttctcccattctgttcactctgatggtagttccttttgctgtgcagaagctctttagtttaattagatcccatttgtcaattttggcttttgttaccattgcttttggtgttttagacatgaagtccttgcccatgcctatgtcctgaatggtaatgcctaggttttcttctagggtttttatggttttaggtctaacatttaagtctttaatccctcttgaattaatttttgtataaagtgtaaggaagggatccagtttcagctttctacatatggctacccagtttccccagcaccatttattaaatagggaatcctttccccattgcttgtttttgtcaggtttgtcaaagatcagatagttgtagatatgtggcattatttctgagggctctgttctgttccattggtctataactctgttttggtaccagtaccatgctgttttggttactgtagccttgtagtatagtttgatgtcaggtagcgtgatgcctccagctttgttcttttggcttaggattgacttggcactgcaggctcttttttggttccatatgagcttgaaagtagttttttccaattctgtgaagaaagtcattggtagcttgatggggatggcattgaatctgtaaattaccttgggcagtatggccattttcacgacattgattcttcctacccatgagcatggaatgttcttccatttgtttgtatcgtcttttatttcactgagcagtgctttgtagttctctttgaagaggtccttcacatcccttgtaagttggattcctaagtattttattctctttgaagcaattgtgaatgggagttcactcatgatttggctctctgtttgtctcttattggtgtataagaatgcttgtgatttttggacattgattttgtatcctgagactttgctgaagttgcctaccagcttaaggagatttggggctgagacgatggggttttctagatatacaatcatgtcatctgcaaacagggacaatttgatttcctcttttcctaatcaaatcccctttatttccttctcctgcctgattgccctggccagaacttccaacactatgttgaataggagtggtgagagagggcatcctgtcttgtgccagttttcaaagggaatgcttccagtttttgcccattcagtatgatattggctgtgggtttgtcataaatagctcttattattttgagatacatcccatcaatacctgatttattgagagtttttagcatgaagtgttgttgaattttgtcaaaggccttttctgcatctattgagataatcatatgttttttgtctttggttctgtttgtatgctggattacgtttattgatttgcatatgttgaaccagccttgcatcccagggatgaagcccacttgatcatggtggataagctttttgatgtgctgctggattcagttggccagtattttgttgaggatttttgcatcaatgttcatcagggatattggtctaaaattctcttttttttgttgtgtctctgccgggctttggtatcaggataatgctggcctcataaaataagttagagatgattccctctttttctgttgattggaatagtttcagaaggaatggtaccagctcctccttgtacctctggtagaatttggctgtgaatccatctggttctggactttttttttggttgttaagctattaattattgcttcaatttcagagcctgttattggtctattcagagattcaacttcttcctggtttagtcttgggagggcgtatgtgtccaggaatttatacatttcttctagattttctagtttatttgcatagagttgtttgtagtattctctgatggtagtttgtatttctatgggatcggtggtgatatcccctttatcattttttattgcatctatttgattcttctctcttttcttttttattagtcctgctagcggtctatcaattttgttgattatttcaaaaaaccaactcctggattcattgattttttgaagggttttttgtgtctctattcccttcagttctgctctgatcttagttatttcttgccttctgctagcttttgaatgtgtttgctcttgcttctctagttcttttcattgtgattttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgtttggtttccatgtagttgagcggttttgagtaagtttcttaatcctgagttctagtttgattgcactgtggtctgagagacagtttgttatcatttctgtttttttacatttgctgaggagtgctttacttccaactatgtggtcaattttggaataggtgtggtgtggtgctgaaaagaatgtatattctgttgattttgggtggagagttctgtagatgtctattaagtctgcttggtgcagagctgagttcagtttctggatatccttgttaactttctgtctcgtttatctgtctaatgttgacagtggggtgttaaagtctcccattattattgtgtgggattctaagtctctttgtaggtctctaaggacttcctttacgagtctgggtgctcctgtattgggtgcatatatatttaggacagttagctcttcttgttgaattgatccctttcccattatgtaatggccttctttgtctcttttgatctttgttggtttaaagtctgtttaagcagagactaggattgcaacccctgcctttttttgttttccatttgcttggtggatcttcctccatccttttattttgagcctatttgtgtcgctgcacatgagatcagtttcctgaatacagcacactgatgggtcttgactctttatcgaatttgccagtctgtgccttttatttggagcatttagcccctttacatttaaggttagtattgttatgtgtgaatttgaacctgtcattatgatgttagctggttattttgctcattagttgatgcagtttcttcctagcctcaatggtctttacaatttggcatgtttttgcagtggctggtaccagttattcctttccatgtttagtgcttccttcaggagctcttttagggcaggcctggtggtgacaaaatctctcagcatttgctcgtctgtaaagtattttattcctccttcacttatgaagcttagtttggctggatatgaaagtctgggttgaaaattcttttctttaagaatgttgaatattggcccccactctcttctggcttgtagagtgtctgccgagagatcagctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctgggttggggaagttctcctggataatatcctgcagagtgttttccaacttggttccattctccccgtcactttcaggtacaccaattaaacatagatttggtcttttcacatagtcccatatttcttggaggctttgttcatttctttttattcttttttctctaaacttctcttcttgcttcatttcattcatttggtcttccatcactgataccctttcttccagttgatcgcattggctactgaggcttgtgcattcatcatgtagttctcgtgccgtggatttcagctccatcaggtcctttaaggacttctctgcactggttattctagttagccatttgtctaattttttttcaaggtttttaacttctttgccatgggtttacacttcctcctttagctcagagtatttgatcatctgaagccttcctctctcaactcgtcaaagtcattctctgtccagctttgttccattgctggtgaggagctgcgttcctttggaggaggagaggtgctctgatttttagagtttccagtttttctgctctgtttttttccccatctttgtggttttatctaccattggtctttgatgatggtgacgtacagatggggttttggtgtggatgtcctttctgtttgttagtttttcttctaacagtcaggaccctcagctgcaggtctgttggagtttgctggaggtccactccagaccctgtttgcctaggtatcagcagcggaggctgcagaacagcagatattggtgaacagcaaatgttgctgcctgatcgttcctctggaacttttgtttcagaggagtacccagccgtgtgaggtgtcagtctgccactactggggggtgcctcccagttaggctactcgggggtcagggacccacttgaggaggcagtctatctgttctcagatctccagctgcatgctgggagaacgactactctcttcaaagctgtcagacagggacatttaagtctgcagaggtttctgctgccttttgtctgtgccctgtccccagaggtggggtctacagaggcacacaggcctccttgagctacagtgggctccacgcagttcgaacttcctggccgctttgtttacctactcaagcctcggcaatggcgggcgcccctcccccagcctcactgccgccttgcagtttgacctcagactgctgtgctagcaatgagcaagactccgtgggcataggaccctctgagccaggcacaagatataatctcctggtgcgccgtttactaagaccattggaaaaatgcagtattagggtgggagtgacccaattttccaggtgccatctgtcacccctttctctgactaggaaagggaactccctgaccccttgtgcttcctgggtgaggcgatgcctcgccctgcttcagctcatgctcagtgcactgcactcactgtcctgcacccactgtccgacattccccagtgagatgaacccggtacctcagttggaaatgcagaaatcactcgtcttctgcgtcactcatgctcagagctgtagactggagctgttcctattcggccatcttggctccaccccacaaataatttttttaaacaacctaatgcaaaagtaatttaatattaagctacttctatctctaaagaggtggaattacaaaatattattttgtttttatttagaatgccatatttttttcaaaatatatatttattgcttatattactgtatttaaaaaaaatcactcttatcaagtgtgtcagatagattagggagaccagggcataaagccacttttattcttctcaacctgaaaatgtaaagatccatttcaagacaccaagtaattgatgttagagcttcaagggacaggacagagcttgtcaagggaaaattagagtggtaaagctgacacccatacatgcaaggcccttaatctttctttctttctttctttcttttttctccttccttccttccttcttcttttcttttctttcctttttttcttttcttttctggagtctcactctgttgcccaggctggagtgcagtggtgcgatctcagctcactgcaacctctgcctcctgggttcaaacaattctcctacctcagcctcccaagtagctaagaccacaggtgcacatcaccacgcctggctactttttgtatttttagtagagatggggtttcaccatgttggctaggctagtctcaaactcctggcctcaggtgatctacctgcctcggcctcccaaagtgctgggattacaggcatgggccaccatgcctggccgatttttctactgtcaacttgaaaataagcatacttaatgtcagcatggacctgatttagccatgtaacatttggctgctgaaaaagcatgatgatgtgttttttgctcctggtcatcttctgtcaatagttctttattttgtcctagtttcatgttgtaattaatggaattatatttgaagagctcaaaatgaaatgcttaattatattcagctgcaattacagtgattaattgatccaaacttattagcatgacacctaaaggaaaccagttatataaaaattgtaggaggcaatactttgagtatgacactcatgtgagctagctatctagattaattctattttattaaattgtctaagttttacagcttctggaattcatattggaaacccagggtctagactaaactgttatttcataaacaaggacaaaagaaccgaaaaaagtaaatgaaatattacagacaggagtagttctccctcaaatgagattatctcattattttgaaattatttatatgtttcccagtttggatacattgtcagctcctgattatccatgccaaagatagctttaaatctccaaaaagagattttatcaaatctatatgcatttcccaaatcccaagaaaattatgagtcatagtttagagcatagacatcctgtttcagttaatgctttgtagggtctaatcatcatgtatggatgtgttcaatccccttgctctggatgctttcactggactgggtattaaaaagcaaattcttcaaactctgtacttccaccatgcctgcccacctcatttctttaatatgccaacctccttctcatactaatgtattttgtacatttctgcctggaatttttctcgatccttaggcttttcttgtttaattcctaccatccttcatagctcagctgaaattatacttttttttttttttttgaaatggagtctcactctgtaacctaagcttgagtgcagtggcgtgatcttggctcacgcaaactccacctcctgggttcaagcagttctctgcctcagcctctcaagtagctggtattacaggcacccacaagcatgcctggctaatttttgtattttttagtagagatggggttttaccatcttggccaggctggtcttgaactcttgaccttttgatccacccaccttggccttccaaagtgctgggattacaggagtgagctaccgtgcccggcctgaaattatactttcctgtagaggaagtataattaggttatcatgtcaccctcttcttttccattataagtattctgcagtcgtagtgacacatttatttgtgactgactaatgcgtctgacttttcctttacaatggaagtgctacagtatcaagagctgcacattttcattgacactctacatccagaatccaacacagaacacagcacattgaaagtattttattaaatgttcttgaatgagtggaattttcatttttctaatatcttttagcagtatgtttgatcgatttttgtttgttgtttgtttgttgagatggagtcttgctcttgtctcccgggctggattgcagtggtgcaatctccgctcactgcaacctttgccttctgggttcaagtgattctcctgcctcagcctcctgagtagctgggattacaggtgcctaccagcacgccccgctaatttttgtatttttagtagagatgggggtttcaccatgttggcaaggctggtctcgaactcagcacctcaagtcatctgcccgcctcagcctcccacagtgctgagattacagacaggcgtgagccaccgcactgggcctcgacttctttttagatagagtgcccattgttgctccttttcatccatctagtagttctccttcttttgcaatttggttaaatgattataaccaaacttattaagctttattttatgtgtaaaattttgagagaatcatcttgactgtgtgtatgtgtgtgtatatatatatatatatatatatatgtatctgtgtatatatatatatataatctgtatatatatatatatatatatatatctgtgtgtgtgtatatatatatatgtcacctgagtgctttcttttgggggtaaagtatttgactgagacactaaagatttgaattgttgttctgcattttactattgaccatgggccttaaggaagtcatttagctcctgttagcatcagtttgctgatttgtaaaatggttaaacagtagtatttgccgtctacaagtcacaaagctattgtgaagatcaaatcacatatgacattcaaaaatgctttgcaaatgttagccctttactaatttcagtccatatcaaaaatccacattgtgtagaaaatttgtagatctttgaaattacataatcttaaaaatatttgtgaaatacgagatgtagatctgaatttctttaagacaaagttctttagtaatatggaaacaatgacatatccaagcagaagcatagatggcaatagaatttgttcagaacatggcttcagaaaacatactaatagttctgtttttttgtttgtcttgttttgctttgagatggagtctcactctgttgcccaggctggagtgcagtggtgcgatctcagctcactgcaacctccgcctcttgggttcaagtgattctcctgcctcagcctcccaagtagctcggactacaggcacgtgccaccacgcctggctaatttttgtaatttttagtacagatagggtttcaccatattgtccaggctggtctcgaactcctgacctcatgatccgcccaccttggcctcccaaagtgctgagattacaggcatgagccactgcgcctggccgagaaaacatactatagcttttcacagacaaattggcaacttctccatacataaaaattacattttaactgcaaatgaaaatatagacatactaagagtaggtaaaaaattgattattaatttaaaattaatcattttaactcaatgctttacatatattaaaaagtattcatttatatatgtcattttttatacgaataaaatatttaaatattataatctctattattttaatatagttcaattagattccttgtggaaattataaatgattctctaaaaaaataaagtcattattctgtcaagatgattaaatggacattttcctaatcttctagttgaaccattgagtcttccagtgatgtatacttaaaatcatgtaagttataaataaactttcatggtaggtgtaactaacttcatctgactcatgaagagagattagtatctcttttatcatttagacgttaatgaactttcagtcctacgcagcaaagttacccattcatctttttgaaaaaaagatgaattattgttgaactcacctcctaagtattgctatgttgtataatagtagaaataatagtagaataatagtagaaaccatactttttctattataaaaaaatagaggaaatagattggaaaatataatctgaatgaagtcaaagttagcattgagtgttaaataccattgtcagtgtcctttacatatgtaatggtaaagctttccaatgcatcttgggttgcgtgagctaaatacttttggcaaggaaaacatcagttatatgaacactgcagacccacataggcctggtgtacagctttgtctttccatggctctagtggttcatacctctgctgcacttgttcttgactgggcaccctctgccagtgctgtgtgagctccccaattccttgctgtccttatgtggttccgtaagctgacatttcatcattcagaccaagtagatagaaggtgttgcttactcttttaaaatgagttgtataggattacattgttttatttgataaccttttggtaaatacagcagaaatacaacttcagccagtttaaattaaaaagaggcttttgttttaaagctagtaagggtgacactgatcgaatgtgaaagaaggaagcagaggctaatattgggattcaggctcaatccagtcttttgtgtatctcatatctacacctcccacaaatatttgttgtccgccccctcttctctctctctctgttttggtctctccctagattgatcttcttatatatcttcttgtcatgcatcttacctagtgttccccaaatgaaaataactcaatgactattctacgtcaagtgcccatccattcaccagttcaccaagatatgtaaaaacttggcagtttggaaaagatctataaaataacaattcccaaaagaaggggatttctgtgaagatacacaatagttgtccaaaaaaatatgctatatatttgttttaaaaaattgatagcccaatggactttttcttttttcttttctttttctttttctttttttttttttttttgagacagagtcttgctctgtcaccagtctgtactgcagtggcacgatctcggctcactacaacctccgcctcccagattcaagccattctcttacctcagcctccagagtagctgggactatagccacccgccactactcccagctaatttttgcgtttttagtagagatggagtttcaccatgttggccaggaggctctcgatctcttgaccttgtgatccacccacctcggcctcccaaagtgctgggattacaggcatgagccaccgtgcccggcccaatggactctcaatacactatcttactttaccctcctgtccaaaagcactaggtggaaaagagatgttacatttatttttaaaagttgagatatagatcatatccaaaacctgctatagaaatatactacattgtcaatatgaataattaggtatagagaatggcacctgcttaaaatcctttaatctcactgatttggtgtgtgttgtttccccagtgggttacatgttaccgataacctgtcagaatttgaatatcgcagaggattttcaaagtcagaagaactgagtaataaggagatgaaagactttttcagaagacttttttttaaatggaaacttatttttaaatatagaggaatgtaagaacttgcaagtaagagtgaattggtttgcaaagtagattctgttttcccttcatgtgagctttattggtttatattctcttcaaattttcttcatgtcatttggaaacaactgctgttcaaaaactatatcttcatatgcaagcatttactataaaacttttctttaatgtgtttaaagcatttctttttcacttaaacatttttcctttattttaagctagtgataagacagaatggtgatatgtccatttgcttcatttgatatgcacatttgttctatgggaaaatgtggtctactcctaatttcattttcgtttcctaaataagaagacccattaaaaagcagacatctggtgtacaaagcacttaaagctgtagctcccaaggagtgctttcttccctctttaaatatgcatgaactgttgttttggtaatccacttcaccctgtcaaaatagaatcaaatagaatatatgtgtgacctcttccccttctatcctgggaaaatgagtttcaagatcactgaggtgtacagtattccgaagccttcactttccgttttattcaccctgaaagctcttacagttacagaagcttaaagtttagctgaaatctactttaataatagctacactgttttagttatgaagaatgactctatgaactttaaatatttgaatcataaagaatgaatgtagactttcaaaaaataggctttgaaaggagtttaagaatatctgtaccttcattgatttttttatatcagttagagctcaaggtttttaatacagttacctcaaaaattctgtgtgcaaaatagttacatttaacggatattgaaactaaatatggttaacttattttcctaggagaagagaacaactaaaacaggcgcaataaacatttttctttttcagttgatgcacatttaatgtcagtttgcttccttgaaatttagacccacattccccaagattgagtcctgtagaatattaactttccatattcacctactctgttccatgcaaaaggatgacatgatcaaatggtacataccttgctttctcctatagattcataattgaaatttggatattatactttctaacaatgcttttagtaaatatatctgtgctagcttggttcacccaatttgcctaagtatatttaacacctaaacattaaagaaaaatcacttttgaaatctgtgacctagattatgtttatgtgcagattatatcagaaaatagtacaaaactttatgaagacaagagaagtatctcattttttcttccttctggtttggattgtttattttaataaaattatatcagtctgatttggttagcttggaatattgttttgttattgttctataagtagctgcattatccataatagttcatatatatcttatttgtgtgtgtcatcctcaatactgttcaaatattttaagggagacaaatggatacttttgcttttagaatctatttacaagttttattcttctaaatttcagtaaatgagtctgtgccacttctatgttttaaggtatttttggatttagagtacttctaaccaatgatcatgaaagtagtagtctattaattttaaatcatattttctaacattgtctattaatgtgtttttgacaaatgtgatgcctatgagaagacagcttcttcactagaggaaagtaaaaggagtttttgaaccttgatccaaatctctgaatttatttaccatgttgtcccaatcgaaaggcattgaacatagtttttcacaagccacaaatgtttgagtatcagagctgaaagattgcctaactaagtaaaatacagtatttacaggatgcttggggaaaagatatctggctaatttaaaattatgccagtgatattctttgcttatccatttgtgacaaatccttatcagccttagaaaatgcacataataaagtacagagaacaacatttgcttattctttaaacttatagtcttgtaatgctgcagtgctatcacaacgggtattaatgatcgttgtatttattgtatatttgagttaaatccatattaatcctagggtttatcttaaaattgtgtgtgtttctttgtttgtttgtttgatttatttggaaggtgttttttgtttttgttttattttagaactaaactcctcaaatgactttatttactagcttgaggtgtctttctcctaaaacaacagaaaaagtcatgatgaagggctgggcagaagaatcttgatagtttgaatttcaaagctacacagattatagataagatatactttatgttattagacatttatttttccctagataagaccgctgatagtggatgataagactgatgaataatatttgattagtcaagtttccatcaaatataggaaaagttttaaattgtagctataggtttaacataaatagccaaatttatcattatatgatttttttacttttattgtgaaaatttttaaacatagagtattagaaaaaagtagcataatgattgatacataatcatgagctagatataatcataagtaatattttcccacaatttttatctatccctcctgttctttactgtgaagtacattaaagcattcatttcactgctatatacttcattgttcacaaaatatatacagacctcttcccacaaaattattaaaatttattgtaggcactttgttttttaagtgggagataaaaaataattggaattactatgctcatgttgtttcattgtactgaaagcaaaaatggatttttttcaaagatatttcctcccattttacttttattaatagattctaattccgtcaactttgcgtaatatagaatgatgaaaaagccccttttcattccttctgatagcttttggattccattgctcagagaaagcttgtcttcaacaatatgctggaattgtgtgaagtcttgttatttttttttctccctgttcttcaaagtacaatttcttgaatgtacctgcagccgtgcattatcaggcaacctattttataaattccataataaattaaataagcacctctgtgggtcatttttgattaacctgatttaaaataaaatgatttactaaagatttagagggaggaaatactatgtgcttctaaatcaattctatgcatattcactgtcaaacaattgcatgtaatagtgtattaaatacacttaatagtgtaaaaaaagactcactgcaattgaattaacacttgcaagcttataataatgtttaaaagccacaaacattgaagtaaaattcatttttatccagaaatagaatttgtacatatgacttcctgctatggagattttatcacaggaagatgttcaagatgtttaatttaggacagcatttcttctaagttcagattataaggaggagcattttaattagaatagtatcatgagactcatgtaagcatatgatattacacatcggtattttccctatagtctggaacattactggaatgaaaatttagagatgcatttttacttctccagcacatgcaagaaataatacaacatgaatccttttttattttaggaatgttatacccacaaaacattgaagtatgttttaagttaagcaaacaacaagttttgaccaagaaaattagaaaattaaggttttcttagaaaacaaacaaaattatggcaagaaattactgtcctagtaaaataagatgaccctatatggaccgttgtacgtgaatatttatgtccttttttttttcagtttcacgtatattctttaatgaacacgagaatacagttttagttttcatttgatggcagttttcttcactctccatttcttcaccacctcctcctattttcttccccttttttctgctattcctccactcttcattacacctacatggcttagagttgctggtagattttggtgcccatgctaaaatttgaacagaaggaacagtataaagatgagctgaagtaaatcttgaacacctactattttgccttcttatatcatctcaattgacaaagtcaagattgcagactgccttgacttatgatggggttatgtcctgataaactcaaggtaagctggaaatattgtaagtcaaaaaggcatttaatatacctaacctacccaacatcatagcttagtctatcttaaacatgctcagaacacttccattagcctgcagttgggcaaaatcatctcacacaaagcctacaataaagtgttaaatatctcataaaatttaccaaatactgtactggaaagtgaaaaccagaacggttgtacaggtgctcaaatacagttgctactgaatatgtattacttttgcaccattgtgaagtcaaaaaatcataagtcggtgactgtgctcggttaaaaagtagtggttgctgaccaacttcatttttctttaacagcttcaattgtgatgtcaaagtaaatgtaacttttttcaacaaatttttgtcctttaatacaacaaaaatgttgcatcttaaaagcattttttaatgaaaagaattttaggcttacaattttcttgtaacagtggaaaatataggctctgattttcttttttttgtagtgcacaaaggtaccttttcttagtagttaagttgttttaactacctcaaaatataagttaaaaaataaaagcaagaaacatgggctaaaaatgatattgcaggtggtcataaaccgcagttaaaacatatgtctttaaaatattcacataagattcagacatagcattatacaactttttcattttgccttttacctccaattccatttagaacaattaagaaaaataccttcaactatattatttttatggcataaatgaatttgaacaagatatttcaaaaggtaaatattgaaaaaactctactgcaatgcattttgactcctaaaataggattgtgataaaataattaaattttgatattttaatgcacttgaagaaacacccagcacagcccatttctaaggaaagaacaagttaaggataacataaaatgaagttgactttttgtaaaggtgatcttttcacttttaaaacagcactcaatgattctgccagagacagtgtctacaagtgaaaacttgtttgtatgtgatgggtttgactgacaggttggatcaagttgaggtggggaattggggtggacaaaggagaggaaacaggttatgctattcactcaagtcaatcaaataacctgattgttctttcaactgccttactctgtcattgactgtcaagtcagtcaaaatagtgaaactagttttcgcatgtatgcagagatttattttatgacgctattacctcacccttgtaaacacagacataacaaatatctaagtccacatgttgaaaattatacacaaatattgcagatgtttatgggtgcagaggtatgtagaagagaaaacatgctgaacttaaagccaacactgtaatttcctaatgtttgacttcctatttgacagagactgatataattgatcaagcatacactaagatgcttctttagagaaacattcagcagtatttttctgtattatagtatccaaactagtaatatttacaggaattttatttttatttttgtttctttttttgagacagaggtttgctgtatcacccaggctggagtgcagtggcatgatcacagcttaatgcagccttgaactcccgggctcaagggatcctcccacctcagcctctggagtagctgggactacaggcaaacacaaacacacagctaatttttctatttattacaggaatattacagagagtttgcattaaatagctcagaaaacaaacagatattgtattacatgcacaaacacacacacacacacacacaccctttttttttaatttcaaaaattactttgcccactttttgatgtggttgtttgtttttttcttgtaaatttgtttcagttccctgttgaacaatgagaacatatgggcagagggaggggaacatcacacactgggacctgtccacctgtcccagggttggggaaaggggaggggtagcattaggagaaatacctaatgtagatgacccgttgatgggtgcagcaaaccaacatggcacatgtatacctatgtaacaaacctgcacgttctgcacatgtatcccagaacttaagtataataataaaaaaaaaacttgcaagattaaaaagaaaatcttaacaaaatccaaaaacactaaagtgagtcaataagaagacccaattatgtctgatctcttgaagttactctgctgaaatgctcaagtccaggttaacctcatcaatctaaatggattagcttaattcatttaaacttagaaatagttgaactactcatttttaggtctcatgcaatttacctgtgtgactcaacatcaaatctgtctgctaggttcatttggcatgttttgtccctaagatatctgccaaaccaatgcaatcaacctctcagaagcttttttcatatttaagaactgcttttaatttctaagccttcgccatggtttctgtcatgtatttctcacaaatgacagctactgatatggcagcagctattggttattgggagggagatgggactcaatgttatatagctatgtatcgttttgagattattatatgtacattacctaattctctcttcagaaacatcccgagagtattattactactattactatactccccagagtagtattaatactatactattaataacagtgtactataatgctaatattattactatactatgaacagataaatcagtggaggcttaaggacattaaaggaatggaccacattgcgccaggtgtggtggctcatgcctgtaatcttagcactttgggaggccgaggcaggtggatcacctgaggataaaattattcttttattctactaaaaattaaaaaaaaatatagccaggtgtggtggtgggctcttgtaattccagccacttgggaggctgaggcaggaggatcgcttgaacccaggaggtagaggttgcagtgagctgagattgtgccactgcaccccagcccaggcaacagagtaagggtaagactgtctccaaaaaaaaaaaaagagagagaatggaccaaattggactagctcatcatggtgacagaataggaaggggagaccagtgcttgctgcagtctggggcaccgccattctctccctgtgctgccaatttttcttccttctaggtgatatttatttcaacccgttgaaatcaagaggttattatttttactgacaatttattattgagattccctccatgaagaaagatcaagtttttacttcaaagggatggtaaaaaaataaaaattgtttaaccatccttgtcttaggcttgatggtgaaagtataaattaaagtaaactactgttttatctggtgaataaaaagcttgagctttattaagtgattttctcttggtattgggaagtgtatcttttactctagggttgttacttgaatcacccatgctagacagtttttttttttgagacagaatctctctgtcacccaggctggagtgcagtggcataagctcatctcactgcagcctggatctcctatactcaagggatcctcccacttcagcctcctgaggagctgggactaaaggcatgcaccacctggctaattttgtttcctttttgtagagacagggtctcactatgttgcccagattgatctctaactccagagctcaagggatcctcctcccttggcctcctaaattgctgggattacagacgtgagccaccacacctggcttacatagctttttttaaatacaagagcaacaacaataatataaacgaaagttattcttcaaacgtaacattaacctagatttatttgaagctgaaagtgaatgcaattgggtgtgccaaaggcaatgtgggaaaaacaattaattcctttttgttagaattggacatatgtattcgcaccaaatggaaccattgttagggcatattacttttctattagtttacttttctattagaatcattcaagcaaatctcaaagtttttatctgaaaattgttttgtttcaaatttctttaatgaaaatactgtaaggttggcttccacattaactacacggaaactaaagttactagaaaagacaggttagttattaaattgagaaagacattgaacacttgatggtaaggaattatgcaaacaagatccgggttttcctaaaattagacttttttaatgcaaaattactcttttgcgatctttttatgaaaataattaacttagcctttagcgtatctagattttgattttatgcattatttttagcaagtttctaagatactaccttcataggcaaattgatttttagttaaaaaagaaaacaatttgtgtgattgaacatgtgcttggaagttagtaaaaagaaaaatattgctttatttagaactgggatctactttctcactagttaagaatccttctaggcccattgcggtagcttacacctgtaattccagcactttgggaggccgaggtgggcggatcatttgagtccaggagttcgagacccacctgacccatggtgaaacttcatctctacaaaaaatacaaaaattaaccagttgtggtggtgggcacctgtaattccagctactctggaggctgagacacaagaatcgcttgaacctgggaggaagaggctgcagtgagccaagatcacgccactgtactccagcctgggcagcagtgagtgagactccatccaaaaaaaaaaaaaaaaaaaaaagacactaagctaaaagacactaagctaaaataaaagcctcatattatcttaaaaagtggggaaggatacacacttaggacccctgatgaggtccccttatcctttattgggtgctttaattatatgccttactttattctttgagtttttaaaacctcacctcctactttactaagaaaatagaggtggccacgctggaatcttttttcacctgtaagttcttaatacattacattattattttttttccttaaaatctcaggacagacttgactctactgttttaccccgccgaaaatcccgaattggtgtttctatttctcatcctgtcagccttctctggagtgttattttgtcgtttttgactttgatacctctatttgttttctctccacggattctttgtctccactcacaatctttgatcagcaaaaagtagattattccagtcttttaaattttaagaatctggcctctatccttgaggctctactgaaaccactctctccaacgtcctttaatgttttacccagtccttgttttctgtagctttcaaattattgactatcctgtcatctttggatatttttctttctttgaattcagtaatattatacactctaggttctcttcctatcatcaactttgctgtattgtttcttcttgccgaaattccatttcttttcatcgctatttattacatacctgctatgagtcgagtacttttagtgaagctggggatacaaaagtgactaagaaaatgtcctgctattataaagttgcattctggtgaaagagaaataaagtcaattaggaaacataaataatataatttaagttggtggttaaattctatgggaaagtattataaattaatggagtaggtggccagggagagctatttagctggagtggtcaggaatttcctttcttggtgagtggcatttaaatggagacccttttggcctctcttagaggctgttctataaagtcctgagtagagaaactagtggaagaaaacagaaccagtggaaagagtgagagacaagaatggtgaatctgataaaaatggattctttgatttgtaggagaatggtttgaggacatgggaaatgaaaaggtggagaccatgagttaactgtttctaaaagcaggctctgatatgcttgagatatgcgatattaaaaatgcggatattgtgacacatttgtatgctacatggaattacccaggattgagggaggcattacctgtgcagaaagggatggtaattgttggagtgaactccagcaatgttggtgctcttggtattttgttggttgtttttgtcaataatgtgatggtgatggtctaacttgtactttggtaagttatatgtatgtctatgtctttcagtagattaaaattaaaatatttcttactcttctttgtcctgcccatgattgccttttctaacatctagtgcagtgctcaaaagtgtctgtagattttggttgcctcatcattttcaaaatgtttctgggtttaagcctaaaattatatatgatttcatttaatgtgaacaatggccttcaaattaccaataccagttgcatctgaggcatattgaagagctttaaatccaagttattgtgtatgaaactagtgcttacaatataagcaggtggaatacatttagtctacttatatggaaaagctaaaggggaaaaaagtccacaaccgagtcatataatagtttttaacctaacttcctggtcagttttcagctctgcatagctactctgattgattgttgccccatcaactaatatgtttgaaaattcaaagtgaataataccatgaacaattcagtaatatcaataaggtgaagcctgattgtattatttttggaatatgattaaaataatgcaaaagaaataatccttgcccccccctccactttttttatttttgtcttcagcagttctgtggtttacaggtagcacatctgaagctgttatgcactggtaaaaccaatgtggattacaagaatacactattaggccctggtgacaggagacaaaagcaacatctgcttcctaggctttctgtgttacagaagagaaggcctgcccatcactatatgtaaaatcactgtattatccagtgcctggaatactcatattaggatctagaagctagttgggatttaattgtatttcaaattttagtataatactagtataatacttttatatcagtatcccatgttaactgtatatgcactttattattttaatatttaataattgaaatcaagtcttatgtatttatgtaaatttttatatgttacattcatatactgatgtttatatcaatttagaaaagaaaatgtgagcaattaattcttattaattaccttatatctggttttcgctcaagaaaataatacttaaatgaaatgaaatttatttgcttctaatgtctacataaaagacaaaatatccactagtgaatccacacagcatacaaatatatatgttaaaatttgcacaacttaaaaatatgcatactgtatttgtgtttctgttttctaaaataaaaaccttgggatttataaatattcctgaagaaattccttgtatttcctagctgaattagttctgagtttggcatttgctctttacagcctaaccagggagtggaccattagttttcctggagctttgggactttgggtttttgcctttggaaattaaatatgtaatattgctttgtctgggctggcttaggacaggatcctcccttcattccagggcaacgtcaaaattcacagaagagcaacagttcatattgtctattgaaatcaaatctgattcttccccctcccatctcccacgcctgcccttgggattgtgacatcattaccatctcaagaacccctagggttgttttccctgttaaaatgaagtgagattagggttctaggagagagcagtcaaatatttgagcactaatcatgcctggatgtcttttactaattttcaggcagtggaattcttttggtttcaagattacaccacagtcgtttaatgtaaatgtggacagaaaagaatacaattaggtgaatcgcacagacaatctgcttttttttcagcaatccttgaaatgaaagatgcatatattagaaggttatctggcatatgaaagggacatttatcccccaaggagagaaggaaactacttaaaagaaataaggttttattaatatttttcaattaaatgttgcactttctttatccttttgtaattttcatgttgacctatgtaagtgctttgttcatgtagcattcactctttcttggcaagtcatcagatggagcaagtttattgaaaaagaaacagaattaaaaattcaatgacaaaaattcaaatagtgtctgtttagagcttatcttcttaatgttagggcttttatggttattggttggggacttttgggagtgtttcttaatgctcaggtgggtgatgccagtatcaagggaagcaatggcgttactttaattccaagggttttgatgattgcattatgtttaagcattgtgaagatatatatataattttagcgtacaaaagtgaagcagttttgtgattgaattatttaaattagaaaagacagaatagcacaatcatacaaaatgaaaggtgctttctttatatcttctcccaaaatatggttaatggaaaaacaattactttttattatattttggtcaattttgtaatctatggtgataaacaatattcgataacctttattaaaatacatatttgggagaatatcatacatagaattatgactaatcatgaaaggctgaacagcattcaatgctattgtttttaaatctataaaatgaagaattgctgcctgacctgcaagatttcatccagctctaaaatcttatgcattctataatatgagaggagaatatttttttttttttttgagacggagtttcgctctgtcgcccaggctggagtgcagtggcgcgatctcgactcactgcaagctctgcctcccgggttcacgccagagaggagaatattttaatgatgtcaacagaatttacctaaacataaaatatgaatgtgaacctattatacctttatacattcctttttaatgaattactcaaaattgtgatatcatatatcagcaaaataataaattcaactatatattaaagagaaagtctcagatatttcagaatacttatttaaaaatatttctaccatgctttctgccaaaaatgaaatgtaattcaaaagcatccattggaaaaattaaacctctttctgccagaataatctagtgttagcatttcatgccttcttaaaaacagattttatttttcaaatcagtttgaagtttacagtgaaattgagaaggtatagagatttcccatatcctcttccccctagacatacataggccccctcactatcaacatcccacactgacgtggtacatttgttacaactgatggacttacattgacaaatcattttcacccaaagtccacagctgatgttagggtgttgaccaaaagagtcaaactctgtaaaatatttgaagagatttattctgagccaaatatgagtgaccaatgacctgtgacacagccctcaggagaccctgagaacatgtgtccaaggtggtcagggcactgtctagttttatacattttagaaaaacatgagacattaatcaaatacctgtaagacgtacattggcagttctgtctggaaagtaggggcaacttaaacgttttctaattggcaactggctgaaagagctaagctattatctagagacctggaatcagttgaaagaaatgcctgggttaccatgataagataagagttgtagagaccaaagttttatcaggcagataaaccctctaggttgcaggcttcacagagaacagacggtaaatgttcatcggacttaaggtctgtgccagtgctaatgctggtcagcttttcctgaaatctgaaagagaggagggaatgatgacgcatgtccaactctcgcttcccatcatggcctgagccagtttttcagggtaacgttggaatgccctggccaagagaaggggtccaaccagatggttgggggtccttaaaattttatttttggtttacatgggtacactattggttggtaggcattctatggacttggataaatgcataatgatatttatttactcttctggtatcatacagaataattccactgtcctaaaaattctgttctccatctattatccatcctttccactaacccttgccccctgaaaaccactgatcttttttaactgtctccatagttttatcttttccacaatgtcagacagtatggaatcatatagggtagccttttcagattgacttcttcagtaatatacatttaagtttattccatatttcattgtggcttgataaccattcctttgagacaaggtattgctttgttgcctagattgcctaggctggagtgcagtggtgcagtcacagctcacagcagcctcaacctcctgggctcaagcaatcccccaactccagacactggagtagctaggactacaggcacatgccaccatgcccagtgctttttaaattttgtatagagtcactgtctcatcactttggccaggctcttctccaattcctgacctcaagcaattctcctgccttagactcccaaagtgctgggcttataggagtgaccatcatgcctggccacttgacctttcttttttttttttttttttcatttttcttttgtgtttttgagagtgtcttgctctgtcttccagggtggatggcagtggtgtgaccacagctcactgcagtctcaacttcccagcctcaagcaacctcccatctcagtcccccaagtagcagggaccatactgtacgccaccatacctagcttttcttttctttttttttctttttcctgtttttgttttgttttgttttgtgtgtgtgtgtgtgtgtgtgtgtgtgtgtgtggtggtgataaggtctcactatcttgcccaagctgatcttgaactcgtgatctccaatgatcctcccaccttgggctcccaaaatgttgagattataggcatgaaccactgcacctggtgatagctcctttttaagtgctgaataatattacattggatgtaacacaagtccatatagtgtatctatctattcacctattgacatgtcagttacttcgtagttttggcaacattatgaataaagctgctataaacatctgtgtgcagttttgttgttgttgttgcttttcagctcctttaggtaaatgccaaacagtggaatttctacattgcatcataaaagtatgtttagttttgaaaggaactgccagactgcctttccaagtggctgtaccattttatcttctccccaacagtgaatgacagttcctgttgatccacatccttgtcagcatttggtggtggtgttgttctgtattttgcccagtctaatagatgtgcaacggtatctcattgttttgatttgcatttacctgacgacatatgatatggagcatcttttcatatgcttatttgccatgtacacatcttctttgataagatgtttgtgaaagtctctgacacaatttctaatcagatttttttttgctgttgagattttagggttctttatatacttgcataacagtcctttatctagtagatcttttacaaatattttctctcagcccgtgtttgtctattcattcgctagacatctatcatgtagcatatagtttttattttaacaaagtccattttatcaattttttatttcctagatcttgcctttgatgccatatctaaaaagtcattgacaaatccaaattcatctagattttctcttgtgccgttttctggaagttttatatttttatgttttacatttaggtctgtaattaattttgaggtaacttttctgaaggaaatctggtgttagcattccatgcctttttgataccatttatccctgaaaataaagtctacatcattattattttccattttgccaatttgattgggaattcttatgatttaaaattttcttaatagctttctattaaaatagatttgaatgaaaaaatatttctatgaggaacatttacatttctaaatatttgttttaatataactccaagtatattttaaatctaattttcttttttagaaacagagttcatttagtaggctaaagctactttcctaatactatggtaatatttaatttttttataaatataatttgtatgagtttgggcctttttaggcaaacagaccaccttggtcctctacatatactttctcccagtgtatattcagtatccgctatgtacatggcatcatagtgacgtagatgtttacactggagcaattctgttttctcctctacttgcagatagaggaggtggcagatatcttgagcaattatcattcatttccttgtgtctctaaggatgcacaatcatcccttggttccaggaccgcccacctccccaagaataccaaaatctgcagatgctcaagtcctgcagtcagccctgtggaatccacagacacaaaaagtcagtcccccatgtccttgggatcctcatccctctgtgtctggaattggtgggttcttggtctcgctgacttcaagaatgaagccacggaccctcacggtgagtgttacagttcttaaaggtggtgtgtccgcagtttgttccttctgatggtaggacgtgttcggagtttcttccttctgttgggttcgtggtctcgctgacttcaggagtgaagctgcagacctttgccgtgagtgttgcagctcttaaggcagcgcgtctagagttgttcgttcctcccgtccagagttgttcattcctcccggtgggcttgtggtctccctggcctcaggagtgaagctgcagacctttgcagtgagtgttacaactcataaaggcagtgcggacccaaagggtgagcagcagcaagatttattgcaaagggtgaaagaacaaagcttccacactgtggaaagggaccccagcgccttcccactgctggctcaggcagcctacttttattcccttatctgaccccacccacatcttgctgactggcccattttacagagagctgattggtccattttgacagggtgccgattggtgcgtttacaatccctgagctagacacagagtgctgattggtgtatttacaatcctctagctagatgtaaaagttctccaagtccccactagattacctagacgcagagcactgattggtgcgtttacaaaccttgagctagacacagggtgctgactggtgtgtttacaaaccttgagctagacacagagtgctgattggtgcatttacaatcctttagctagatgtaaaagttctccaagtcctcaccagattagctagatacggagggctgattggtgcatccaggaatcccaagctagacacagagtgctgattggtgcatatacaatcctctagctagagataaaagttctccaagtccccacctgactcaggagcccagttggctttgcctagtggatcccatgccagggccataggcggagctgccagccagtcccatgctgcgctcctgcactcctcaacccttgggaggtcgatgggactgggggccatggagcatggggcggcgcccgtcggggaggctcgggccacgcaggagcccaccacagtggcactcgggcatggcaggctgcaggtcctgagccctgccccgcagggaggcagctgagacccggcaagaattcgagtgtggcgcgggtgggctggcagtgctgggggacccggcgctccctctgcagctgctggcccaggtgctaagcccctcactgcccggagccgtcagtgccagtcgcccgctccgagtgggcccgccgagcccacgcccacccggaactcacgctggcctgcgattgccgcacacagcccgggttcctgcccgcgcctctccctccacacctccctgcaagcagagggagccggctccagcctcggccagcccagagaggggctcccacactgcagcagcgggctgaagggctcctcaagcgtggccagagcggacaccgtggccgaggaggcactgagagtgagcaagggccaccagcacgttgtcacctctcacctcgaatactgtatttttgacccactgttagctgaatccagtgatgtggaacccatggatatggagagccaactgtatagttatttgattaaatttatacttctttactgcctttcagaaaagttgacatttctgctgaaaagaagctgctaatctttacccagatagaacagagaaaatcagagttgaagggacatgtttagggaaacttgtacaatctaactttataaagcagcccaagtgtcacatgaaagtgaaaacacacaatgaaaatgagcatcagcctccagtaattctaaattttatctacaagtgtattcacaacttactttttgttattttttctgatgattagccaaaggtcagggatgattggcaggtacaacagttcaaatagaagtagttcacaaactgcctgtaagcctttcttgataaacagttttgatgaattagtaaataaagtgttttattttatacagaaatctctgtactttttcatatttgatcatttgtgcgtccagtgacatattgtagacatatacattcactgaacttattactggttgccaagatagtaatagcaaaatctcaaaagctgcatgacaggaattattcaaatagttctatatactgataaatcaaggtttaactatacaacaccctctagtccaatgaaagtagaaattacctgtgaaaattacaatttattttgaatgttcacaaataatcttatctttttatttgtaagtttgactcaaactataaactacacaaataaaaaagtaaaataattatagtaagtagccaaattttattctagttttcttgtttcattcaaattcagtttgtgctccttaatgataacactattgtcaataaaactttacactttaagtgactttccacagttttcccatctgataagaatggtactgataaataaaaaacaacatgcactatccatcttactttcatagactagagataaatcattatgaaccccaattggcagaggagaaaattcgggtgcagacaagttaagtcaggtggcagattcacacaggaaataaatagtggctatgctcgtataaaaacatcaatcttctgacctctaattcagggcttttccagcactgcagtatgattaatcaataccaggaagcaaactaagtatcaagaaaagatcatccatttgtatcagtctttcctttatgtggttggaatctaaaacaccaagtgcataaaggaatcaaaagtcggaagctttgaccatttgtgaacaatcttttctgtattattaacaggtctgatgataaacacagacatttactaggcccaaattgtgaaaaactttgtagacattttgctaatatgcgggaaataagctctttcttttagcaacttactttgattttcttttatttttatgctgctaagaaagcactcagatgcatgctgaaatatgtattaccttatggattgcagctggcagggactattagtgttaaagattcacacatttgaagtaagattggatacatttatatttgtgtcaggaaaaaaataataatagaatttaagaatttaaaatgtaaccaaaaggcagaatcatggcttttggctgaagagattagcagcattcttctctgttccctttttttctgaagcttagttttctagctaagttttggcaaacaaaattcttttctgtggtatgtattctattttaacatcttccactgaaaagaaaagataatgatataaataaagcaatttaaatcaagtctaaggtataggaaggtatttaagaaagaagcaaacattctctagatgttgttatccaaaatatattctcttttgcagtttactgaaataatttcttcagtgtgtgggaatttcctttgcatccagctttactatagagatgacatcacaccaacagtgacacgacttgtttacaagagggtggtataaacagcaaatgttcttccttaaaacagatttcttgttgaacttcaacagaaaaagaagcgtaaatgtagaaggaagaacaggagatagtctttaacatgtagggtaaaatctaaggtagaggagagagcagctgataatgtttttatgtgtttgctactttattaggaagtctacttccttcttttccatatctagtagagtcttcaagttgtacattgtctttatattaatatataatggcctattgtactatgtcttaatagtttcatatcttccctggtttacatgaattaaatgagagcggtaacatcagaaaaggaaagagagagagagtgaatatgtgtgtgtgtgcatgtgtgcgtgcgtgtttgtgtatgtgtttctgtgtctatgagagagagagagaaaagacagacaatgaaaatgaaaataaatatcttctccaacctatcttagccaactttctgatctaggatgttaggacagtcactcactgaaggaattttagttatagcaaagcgtcatccatctttttcaactgtgttaactttaatttcccataaataataatagtttgcagaatacatctcagattgtacctgaccatattgcaaaataataatttgcttcttgtgtaagaatcattatttaagactaaataaaactaggtataagtaaaataaattaaattcagccctttgaataatcatttagatcatgactgctaactgtagtctagtactaattaaagacctacatggttatttttcttagaacgtgagaagtcttaggagcaactgtttgaacaccctgatctggagggaggagtccttaccaggagatttctggagctgggtgtggagggtagttcagtttccacacattagcccataagagaaaatcatctgggtaaaatagggtgactattctggacacggtcatggctttgctactatagtcccctccatttttcttgggagatgcattggtgcttcgcaaagctgtgcagtcattgaaggtgctcagcactggtttttgtcattaaaatacttgagcttgaaacccagcactgtcaatttagtgagcgcggccttacacaaagttatctaatttctctaagtttcagtgttatgatctatgacacaggttagtaatccctcctttataggaatgtttaacattaaataatgcattaaaagcactttagatactattaatctcaaggcaaatgtcatgttatgtggtatggggcatataagtttccctggcattctcaaaacctgaaccctacactccagctcaaagctccttatagacaaggaccatattatgaaattctgttgtgtttttcatagtataggatgtacacattgtgggatttcaaaattggattgcttcttggtatcaagtatccaaattgctcagagccatagtagtaaaacaatggagaaacagtagtgactgtatcattataatatacgtaagtgttcatgttagtttgcttaacatttattgaattcctgatacataaaaggcctcaggctaaattttgtcaattatataaaagtaccttttcctcaataaaggcaacttactggaagaatcatgttttagtgggggaaattaacatataggctttataaacaaatgaattaagtgctaaagagatgaacaagacacatattgtaagatatcagaaggagaaatgataggggaagacagtagttgtcaggaaaacatggtaaaaatacaactgttggacttaggaaggatttcagtagtttaagagacaaaaagataggaaaacgtttagcatgcgcaaagtcaaagtcagggatccataaatatcattgggtgtgtaatgaattgttagtagttggatgggggatgctaaaatataaagtgagagatccttcatatattttcgtttcctacccttagttccagatattgatagagatattttagaaaatcccaacttaaggccaggcgcggtggctcatgcctgtaatcccagcagtttgggaggccgaggtgggaggatcacaaggtcaggagatcgagaccatcctggccaatatggtgaaaccccatctctactaaaatacagaaaattagccagatgtggtggtgcgcacctgcagtcccagctactcgggaggctgaggcaggggaatcgcttgaacctgggaggcggagcttgcagtgagccgagatcctgccattgcactccagcctgggtgacagagtgaaacttagtctcaaaaaaaaaaaaaagaaaaaaagaaagaaaagaaaagaaaatcccaactgaagtatatgtgaacaaatgaacagctttttttttttatcaaaaaagcaaaggtctttgaaataattttattcagattttgctcacaaatattatatttccatttttatttaaaattatgaggatgatggctaaaagtaaaatgaaccaagttttgtgcatgctgcattttaacaagttgggtgtctcattggaatgcactgccttcttgttccacatttatttttggaatttaataaggcgcctgtcatatctgcctcaaggctaaaaaacatcatgggggagaaatccaaagtactgtcatgtttgagtgacatggagccaattttattttatttccttttcatggggggtggctcaaattagccaggctcacttctgaaaacgcattgctacatcatctgttctaaaggccttgtgctggttaacgggtaatgacattgcccagtgacatttgttaggtagatttgactcagaaaaccaggggaggattttcattaaaaaattaattctgtgcattttactgcaaagctcattctcatgatagattctggtacagtgccacatatctccagaattgggtctggttacgtgagaaactttggaaggtaataacttctttatttcttctttgtgctcccagagcacataattaacgtactgactcatttagctcaactctccaaaggatgaagctgtgtggatacaagggagattcagagaaactggcaaacaagtatggtttctgattctcattcgagtgagggaaaaactctgccattttcttcttctttcttttaagttgatgtttagtacaatgtgactgtgtttagcagaacataatatgttaggattacaatggaaccatcatatttttaggaagtttaagtgagacttgggatagatgtcacagaatgatgttgccatggctgagttagtcataaaattagaaatcacagtaagctgaaggatgtctgaggcataaaaataaaccatgtaccatgtaatgggtgtgttattgtaataactaagataagcatttcaaatgttttactgattaaatcagaattaagtcctgtgttttttagtagtgactatcaggaagtagattgtttaaataacatgaacttaaaacatgtaaacatagtaatttttatgttaaaaatatatagtgtagacaaaatcaataatttgtagctagaaagctctttctaccttcatttaggacttcctgcctcatgggtaaatggaaaaggaatagtaaatctaagcaactttttcatgagtttataccttcttaggcacaaagagaaatctgtgatctcttccctgtatcctagaagacctctgcgacaggagtgagaattgaatttggttacaaactactgagagtgtatgtgtatgtgtgtgtgtgtgtgtgtgtgtgtgtgtgtgttttgcatgttggctaagtatggaggaagggaatcattgtaggaaaatttaatcctgagattttgtggctacactcactttaaacccaaatatgtgggttggatcaatccttggttatatatgggagatcacttagtggtcaggccaggtctaaaccattaggtattgagccactatggagcaaacaaagagaaacatgagacttcaaaatgagcccacccccatgttaaacgtgctctacacttcagcatgctccagggactgtgaatcagaaaaagtcaactgcattttgaagtgtcggcacgtaacattttcttttcctttgttatggaattccaaaactatactgtacagattacctaatatattctgaaagctatcaagcaagcaatgtaacactttttttgtggacaatgattttaattaaataaatgccatttcttggagacaatttacctcttgagtatagctggtcttcatcttattttacacaagctatctcttgggggcataaatttccaggcaaggaaacaggaaaatttattggctatttgatttacatgtttattgggctctccaaaggctttactatttaactggtcattgaaagtagaacaggggtggggtggattatattcaatttaatggaagatttaggtaaagtcttttgaaggaaaaaatatgggtcaacttttaaaatatttcactttcagtaaacaattgtatctattattttagtggctatctaccaagagctgaatcattctgtacagactgaattctttagtccatgtctcgagttttaagttttccatgctaagaagtgctttaacttaaatgtgtcaataatgatgctgctgtggaattgtgtcatactattcccacgagcagcccagaatagctcccaggcttggagtctaatctttattcctggaggtggcaagagtaggttgtcatggagctagtggagaaatcagcagactctatttatgtggcgagggagaggatacagtctttcttctgtaaaattttagaatgaggctgttccgcaaggacattagtctgagtgctttaaaaaaagagcgtgtactctacacgtggaggctcaataaagtttgtttacagtgctgagagtgattccatattcacatcccaaatataaggccagttgccatccttcaattattctctcacaaatacagtggctcctcctctcttcagtaagagtaattgtatcagttagagaatatttcctttactaccaggaattctgagaattagaatcctcttccttgacggaaaggcactagattgacaattttgcaaatgcacgtgctctctttttgctttaggttatcattcttgcggaccatttcccttagtatctcgaagcgtctgactgacagggtttgaatcccagatctgccacttacttactaatcctttgaaactaagcaagtaaaagaatgttattaaattcataatactgataggaacaggatgcagggagatcctgggcagaagacagtgggtctctggcgagggccccaccctcaagctgaaaagcctggaaccatggccaaaagtaagagcttgcatccctgttttcctgctcgaatgttgcctttccacccacagccccaccccacccccgtcctgtgcctgtaaaaaccccagagctcagccagcagagaggagaagcagctgaatgtcagagactgggatggatgttggagagaagtggtttgacttcagagggacagcttaacggtgtagcttcggagaggagtccggtggggatggcccgactctagaggaagatcaccttcttgctccatcccctcttcacctcccctttctgctgagagccactttcactggcaatgaaatcccctgcatttaccatctccagttagttcatgcaacctcattccttctggatgccagataagaactcgggtgccacgagtgtgggtgcaaaaactgtcacactgaccctccgctgagctgttaacactgaaaaactgtcacactgaccctccactgagctgttaacactgaaaaactgtcacactgaccctccgctgagctgctaacactgaagccatctgcagatggcaaagctcaaagggttttgtcatactccgtctggggcttcaggggtcgcgagcacccccctggaggctgtcgcggggcccacatggagttttgctcctgccagcacccaaaggtgctcaccccagctcctgcgctcgctcacctgcgccccctcccttgaggagtggaagtgagaccaaccgagtgagtccagcgcgaaagcagccagcgaggtccagggcctgtgaggtccagggcctgtgcgctccagttcccgcccacgaagggggcaggaaatagctgcttcaacatcacttgctcttttttttttttttttttgaaggaagaattcgtaaaataagtttggagatcacttgaacataaatattttggaatatgagcccactcataaatgtgaaagtcattacttttattttttaagacagggtgtcagtctgttacccaggctggagtgcagtggctcagtctcagctcactgcaacctccaccgcccgggttcaagcgatcctcctgcctcagcctcccgagtagctgggactaacttctgtgtttttagtagagaaggggtttctccatgttggccaggctggtctcaaactcccgacctcaggtgatccaccagcctctgctcccaaagttctgggattacaggcgtgagccaccgcccctgcccacatttttgttttaatttgggtttttgtcacagtgagaactggaaaaaaacaaaaacaacaaaacaaaacagaaaaacctctgctgaattacctgtaaacgaccttatgataaaatattctgttttgtcttctctgtatatatattttttacaattgctttagtttcagataatattctgtacaatttgtaatttagagataaataatcaaatattcatacatatatgaagcattaaagaaaaatttcaaaaactctgaaacgtcatggcatccagtaagaacaaagtttctgtaggaatttgcatagaaaaaggcagctggacttaacatagcatctcacggcacctttaagaggtccttagctatagcagccagccctatcttcatattgcaagagataattagtttcagctgaatactcccatccatcactttaaaatgagatattgactcaaattttagaagttacaactttttttttatttaaaaatgttatagttgcccaagtacttaaacatacaaaacttaaacctagttatatatttgctaacttaatttacatttaagtaatgtaaaacaaatatcagtcagaaatcagagtgtttcttttaaaacaattgtcttacaccaatcaaatttgaatatagctactatattttattattattattattatataggacccatatgcataaatactgaaaactaagacctggctataaagttactaagtgttagatttaatgggttttttttttcctgattttccatatgtataaaagttttacttgaagaactctgcatttaaggaagcatccaaagtaatttttttctataaaaacacagaaaaactgtgttatagcataccagtaatgcacaaggagaaagtcatattacagaattaaaatattgctattacataaaaaatgctataagattactttaaaacctcctacctagattgcttcaactgcaattcagaataacatattaatttaaatctagaaaggcctagaactgaattctgtctcagcttttgattgattcagttttcattcttggtcaagttatttaatattgctgaattttagctctcctcatctgtaaaatggagaccctaaggctacctggtaagatcattttgaggattccgtctggtattgtgaaagatgcctggtctgtgctattccatactgggcctccaacagatgtttagcctttttcccattgtctccatagtttcataaatggaaatgccttttcccttcccctttaatatccagcctccttcacaccttctcctgctggcgagacgttgttaggttccatatatccagccagtcaaagtctgtgtgtgccatgactgagttgtacacataaaatagcagctgaggcagacacggtctttttttccccggaatcacacatccatgtgttaactgactgtcttagtctcttgtgttttgctaaagcagaatacctgagactaagtaatttacaatgaagagaaattgatttggctcgcagttctggagtttggaaagaggagatgcatctggtgttggccttcttgctgcagcattccctggcaaaaaggtgggagggcaaacaagctcacatgagagatggagggtaagggggctgaactcatctttttatcaggaactgactcccactataactaagtcactccatcataatagcattaatccattcatgagggcggagtcttcatgacttaatctcttctgaaagatcctacttcccaacagtgttgtagtggagattaagtttctataacataaactttgggggtcattcaaacatttcacccctggctctccagggttgcagtctcatgtctgcagctttctcaggctgcagttgcaatctagtggccctgcagttccaggagctcaggggctgctccactctcaaggcttcactaggcattgccttagtagggaatctctgtgatgaacccacccctgtggcaagtctctgcctgggcccccaggctgtctgatacgtccttggaaatcttagtggagattgtggccattaaaccgtggccccacagctcttccattttagggacctgcagatttaatatgatgtggacatcgccaaggttttcagcttgtatcttctagagccatgggtcaagccacacacacctggactcgcttgaattacaagtgtggtggccaaagggtgctgttttggaattcagggagcagagttctagggcagtgcagggcagtgaatgctgtggtcttgcaggcacctctctcaaaacgttgctctcaacgccctagcttgcttagaagatctcagaattgcctgataagatacggtcattatctctttatcctgatgaagagaatctggctttcttctgtccatgttaattactttaggaaagggttgcttagccacacccttagtgatatggatttgttgcgtcccgacccgaatctcaccttgaattgtagctcccataattgttgttaggagggacctagggggagatgattgaatcacgggggcggtctcccccatactgttcttgtgttagtgaataagtctcacgagatctgatggttttacaaggggtttccactttcacttgactctctgtctgtctgccaccatgtaagatgtgctttcgccgtccaccctgattgtgcgggctccccagctgagtggaactgcgagtccgttaaacctttttctttatgaattacccagtctcaggtatgtcttcatcagtagcacgaaaatggactgacagacttttttattatttacatggccagcctggaaaatttcaaaatctatccattttgcttccaattataaattttatctttaaattattttttcttccctaattttattgtaagcagtcaaaagaagccatgtagcactttgaacactgtgctacttagatatttcctcagccagatatcctagtacattgctcatcagttttgcctttcagtcttacgacgtgaacattattctgtcaaatttttgcaactgtataataaggatttcctttactccattctccaacactttcttcctcatttttgtctgagatctcatcagaatggccttgaatattcatatttccagcaacattctgatcataaccacttaagtaatcccttacaaaatttaggctttccctatatctcttatcttcttatgagaagagaccactcttttttaaataaacaaacaaaaacaattactgactcagcaacaagatgtgtgcatagcttattcatgaatcaattcattccttttaaatgacacttgatgcatttgaaagagcattttatatatcattattaaattagaaatagaaccaggcgcagtggctcacacctgtaatcccagcactttgggaggccgaggcgggcagatcatgaggtcaggagatggagaccatcctggctaacacggtgaaaccccatctctactaaaaatacaaaaaaattagctgggcgtggtggcgggcgcctgtagtcccagctactccggaggctgaggcaggagaatggcgtgaatccgggaggcagagcttgcagtgagccgagatcgcgcccctgcactccagcctgggcagcagagcaagactccatctcaaaaaaaaaaaaaaaaaaaaaaaaatatatatatatatatatatgaaaaataaacagacggttttaataaatgaattccaacctgtttagaaagagtactctatttgataaaataatattaaattaatttgtatggctagctgtactaatttcaaattatgctcttttggaaaaaaatatggatgtcccaaagttaacattacaggtatttgtggggcattttaagatctaagttaaagagaactaggaagtgttctaagtaaatttctgagacaccacagggtaagggttctcagctagcatgtctcgtgttacttcagatggctgtcagatgctcatatctgattctgtaaaaagtggattatctctgaagtcatggtttcaacgtgcaaattttgattttactgagaatatttaaaagataattgtggttcctaagagacttttaaaaaatggatttagaaattaactgtaaaagttcaaggaagccaagcaagcatttctatgagttgaattatgtatttaaatatacttgtgtggaaggggtatgtaaagtcagatcagctagagaaaaatgacttctcaagaagttattcacataaagacctatgtgacataacctgcaaagtttaatattcactaaaagctctattccaaaaataatattaaattttatcatcttttaaaaaaattaaatctggtattcttaatctattatgaggtgtctgtcccaatgtgaaacaaagttttccctaggtgggaggactctacatctgcttgggcaatggaaatcatatgatttgagtgatgggcctggatgagtttaaaatcatgaaaagcacaattattttcttctttgtcaatgagaaataccaataaatgtcatcagagaggcaatggcatattcttgtgttctaaatatttgggtcatttccataaaaaggctgcagttttcagagacaaatgtgaatcctgaactctagaaccagatcatattcataccactagaaatagaggtaaagaaatgacctagaattatgaatataaactgatattatttacgaacctctaatctgtaatatttgaaatattttgttcaaaataataaagaaaaagggtatatcttggacataatttttcttatgctattctgtttttatactttgcttgagcactgtaaggagactttggcaaagtagtcagcatttaattcatttgaaaaggtaatgaaaatatttttgtttttcctttaaagatatatagcctgggcaacttagcgagaccctatctctacaaaaataaataaatatgtaaattagccaggtatggtggtgcacctgtggtcttagctactcgctgaggtctgacaatggcttgagcccaggagcagttagaggctgcagtgaactgtgattgccactccactagagcctgagtgacagagaccctatctcaaaaagaaagaaaaaatagttttctgctcttctagtgaatagtgatttccacattaagtcaatgtattcattttttaattgaatcaatacaaagcctaatttgtctaatgcagtagatattttccagagagtaaacagaggaagcagctttacaatatattaagcaattaaaatacttctttttttttttttactttttgagagaatgatgattttggacccctctcctatggtggaaacttaacatctgaaaactgaagtacaaaatattctttttttagggtcttacatgatgttgaagttgaatacctttcggaactattagagaggtggagaaaattgttccactttttaaaatttggttttattataagttgtgtttattcttaataatctttagtttgttgtcaaacaagattgagaagttaaagcgattctgatatcacatttgttaaaggcccactctgttctaggcacttatttcacttacttttatttaaccattatttccatattgaaccagcattttctcttgacataaggggaaactgagagtcaaaggggttaagtgtcttgctccgagtcacccatcaaaaagtggcagaataaaaacaaggtcagatcttctgacacaaggtctaatgacttttccattcaacttcaattgccagttttgtgtgtaataggggcaggttcctctatctgtcttttctgagagggaaacgtattccgaaatgtaaagtttaaactgtgctgttaaaaggaagaactagagaaggtgagactttccactaagattccaaagatataggaaagtaaattttagattaacactggggagactggattttcttttggtaaagggacagagaaatgtaaggttacccagtgaaatatgaactcagaggaacaaaaatctatttggaggttttgaaatcaaattaagttacatgagtccaaaatgttgagcaagcctttcttaaaggcacctgtaaatgtaaagaaaaaagttggtaaagtgaaaatgataagaattcataaaatcagcattctgtaaagtgcgtgaagttttaaaaccaattcaactatgagtagatgtcatgtaggcagggaatatagtaaagccccattctttggagttgctaaccatgtgaccacaaatctccactgccaccttgtggtggtatgtatatttcagagacaggctctgaagaaaattgacctctgaagtgctgagaggtaaaataaaaggtgtctggtggtaaccaacctcccactttctgaactcaggaaccagacagatttggggaacacaggatccctcttttggagttactatccaaattcctaccatagcaatttaggagataccatagatttggagagcagggctattatacagacatcacaagggtgaaaaccttgagcaagagtaggaactgaattttctttcagattcttttgtgttcatggtggaggaagatattctattttcaagaggatcctaaatatccaatgcagttttcatctagaaaaaattttaatctattctgtataaagcaatgaggtaacattctcgtcaaaggaaatcctatgggtatgtgagaatggaaggcttccagtcacttctttacatttagttgcattcataaacgtgaccaatggtgtttctgtctagagcttaatgggttacttccgcttatacaccagttgtgctttcaactctgagcatgacatcaggaaatgtgtttgattccaaaatgatcaattacagaagcatgtgatagctaatgtgcctgtaaactcattaaccgaatgaagccacctaattgtcaacagttcaacagaattttgtctgcaggttatttgtttttaggtgtcagtggtattcctgttttaatttcgccagcagaagtgggattaatagatcaaaatagtattacagcacatgacaatagatgacaagcaaagacaaatctaaaattattctgattgatcattctataaatgtaataaaacatcagtacttaagtgtagtcatcatttattttattttttatagtgctcaaaaatatttataatgtatctgtgctaaaaacaagtctctaccaactgcataacatgtaatttgagcaaattatttaacctcttcccttttatgcacaatgaagataacattaacatcattaagaataaatgggtaataaaagtaaatcatgggacattctcaataactgtgtgtgtgtatgtgtgcatgtgaaaactataaacaaaaaaaaatctcttttattcagcagaaacatcttgacatcttatatcttaataaacctgcaagttaaataagaggagggcttaagcattagtacaaaaaactattatacagtgctttatttgtggagaatattgatggagaaaggaggaaagaggaaaagcctattcccaagagaggcttctgcgaagagcagagcatgaaaccaaggctctcgaggaacaccaaaacaaacaaactctggcagtgtctgagtaagccagccgtctttctctcaataatttttattgtgcacccagtgatttctcaggcaatttttagagccttttggaaagtggtctccaaattatgcactaatacaacactgctaatgaaagccctcattgcaactcattagctctcacttttttttgctaatccacaaattctgtcctatgtggtggacacctggcagtacacccctcagccccatatctcagcagagatgtaattgccaaggcctggagcgaggtttcatattacctagacgtgtggcttatgcaagctcttccatgagactgtctgttgtcaataattaagagctatcaaaacacttggctaatttacacttgataatctgaaatgagggcccctgtgatcaccagcttctgtcttattatttaaatacacatagtataaaaaaagcagaatggggccaaagcaagccgtatcagggaaaagaccggctttccagcaaacaagatatagcccagtggttgtaagcaagtacagcacaaggctgaacaaacatggcccagtgagtgctttttatggctgagaagcttcacagagcaggtgggattgtagaggatcttttgaacactgagatgtggggacctggcaaagtttaattggcaagctgttgtagtcaaatgcagagaccatgaaaatgggcatgcgttatggacatgagtagggagctcgcatggtatttcaaaaagagtgattgctagaaataataggaaataactatgtatgaacagaaaagaaataaaaccattaatttttaggaagtgcaaatagtcaaaataaagaagggcagtgcagtctgtatgtaaacagtgaaaaaccctttgcacagttgtacttgggttttcagcaacattagcttagcataggaatgactgcgtaactaatctcattatttgttcagaattcagggcatttctgattttctaattccaacttacaagataagagataagtggcgtaattgaagatgttgttaccagtatttttggttcgtattatgggttaaattcagcaatacatactgagaaaaaataatgtgtaataacaaggaacaaaaccttttgataataatatgtcaggatatgtcattttaacctatctgataaggaaagtgctttgttataatgccatttaaaccttttttagctaaaatgtcttgactagaatttggggaaaaataacttacattaaactctgctatactggaagtgtatgaaaaagagtattgattttataacctgttggtgagacacatttccttgtgaatgaaaatacagtgggctgtaaagtttgaagtaaagtgtcaacgtgtcagagtaagggccacatgccgtgaaaaatgtgtataagagatttgaaaggcgcatgtagttcagattcacttgtataaagttcgagtgaaagtgtagctggaaattttaggtcaacactcaagttaaaagcaagattactgctggcttaagttataaccaaaataatgagaaaatatactaaataacctgtgagagagggaaatatgagtgctataaaagtttaagtctgttactttttacctaattgtatattcctccccaatatttttaagtttagaaattgagaaattatactcatttttgtcagaggaagagatagttttaaaagtccaggtaagattagctggccatggtggtacacacctgtaatcccagctgctcaggaggctgaggaacaagaatcgtttgaacccgggaggttaagacttcagtgagccgagatcgcaccactgcactccagcctgggtgacagacggagactttgtcttaaaaaaaaaaaaaaggaagaaaaaaaaagtccaattaagaatttcatgcctttcaacacttccttttgctgatcctcttcttttaaattccacctcatcttcaaagtctagcatcaaggcctccttaatgaccttctagctatgaataagctaaatatctcttctcaacttccaaataccattctttgggaatttatctatgtacaagaaggttgtcttggggacaaaatttcttttaattcatggatgctttgcaaggagtttccttacatacaaatccttcttgattggatggtgctggattctgtctttgcttctttctatattctcccacttcacattccagctctgctgaacagttgactgatctctgcacagtcagttctcttttcctggattgtcttttcctgcacgtctccttggctaatttcttctaagccttcagctttcatttaagatctcacttcctgatactctcctcgtattcacatccaatttaacgactctgcgctctgttctcagaaaattaccttctgctattaagattagtatttcacacacctgttattgcctgctttcttgtctgtctccttgaacagaatttcttctctctctgagatgagaatcataagattcatggtcagtgctaaaaaaaattaagaatgcatgtaagaattagcgttcatagaatgtaagcaccatagaagttgcgaatttgttttgcgtgtctctatatctctggtgcttggaaccatgcctggcccacagtatatcttcaataaaatagtggttgaatgaatcagtgaataaagaaataaaaatattatgtattttaaaaagaaaacaataggttactaagaggttgtgttataaataatgattacagctgaacgaaagtactaaaaatgtaaatgatgacaaaatgatagatgagagtaaatagaacttagtatttggaagtaaaataaagagcaggaacaaaaaaggatgattgcttactagctgctgttcttagacaaataaacccttattctctgaaagtttaccttagcatttcagcagctgacaataataaaaaggagtaagaggtatgaaaaattacatgtcgttttacaatcacttccgtgctttgtctgtttgctccattgtgatggttcagatggttccatttgaccccaacctctagctgttccaacctcagaaccaatatttattgccacatatgggctgcgcatggcagctgcaaaatccagatgccaagctttggaatgtatttttacggcagcaccatctggggctctggccagccttctttattgtctcttgaatgtttacactaatagctttgctgggctgtggcactacctgtgggacacgctgagggtcaggccgtttatgagctcatcttgtcattctagttagaatttccctttaaatgtctctcacctgctatcaacttattccttttaatgtatctacaatgtctgatgaaagtaataaaacaggtggtcatcgagactaggaaagaaaaggactgttttcacagcggtgggtccatgttattcatgggttctcagcagcccatttgtgagttttggggggaaataaaatactttttcaatttactgaatatattattttgcttatatttcattgaaatagaagatatacattattatagcccttaacccaacttactggagtagcatattgatctctaagggaggtgataatactccacagcacaaatgaacagtattttaattcctagggaaacttaaaaaaatagtttatttttagcaatcaatgagttgagttatttgaagattcacctgcaacttaggatggataaatgactatttgtgatccttagaaccatgatttagggaattcctcaaaggtgattcaagcagattcatggttttgaattgtgaggaacccgtcattctaaaggaactaatgcaacacgaagattcagctcaagtaataatttagcgtgttatatccagcaaagggaatcagctctgagagtttaaatgacttatccaaggtcccacaagcggtagatccagagtcaaagtgaagatgaagtttgtccaattattcgatgacagtaggacttgtcaggagagtcaatcctgatcatcgagcccccgaaatgatgaaatgacctgaatgattgtgcgacgtccctatttgctttcacggccccgacactcgttctgccccagtgggtaacctcaccttttgggggtggctttgtgggtggaggctgtggagcaggactgcagtcagacaaggaacatgaaggaaactgcgtttgtgtgacctcttggaagcctcctcctggtagctgggcttcctgggattgtcacagagagactgccatctcagaagtagtgacaaaattaggcattcccaggctcacggtttctaatcaatcagcctgtcacgtatctgaggagatatttcagagtgaagatagcgtatgggaaagcaatttccttggacttctgcctctgagttctatgtctggagtagaaatgaggtgcttagtgttaaacaaagccaagtagggagacagtgatgtgactcttatgcatgcctggaccaaaatggcaaatgtgtgcctggggaagccacaggaggctcccagaagcagccttccaggttctgcagacacttaagaaaacagccacaattaggtccaagggaagggtgatattctctccaaagacactttaaataagaaagagctgttaaagctttcctgtaggctgaggatagaccttttaaaatgatatttagtctcaggaaaaaagaagacatattgttataatgtgttgtcagttctctaaggaaatggcataaaaaggagattttattgtggcttaatcctttgttctggagaatctgcgcttttatatacagtatatattttaatgaaaaccatgacaagattactattcataaatcagcagtgaaatactaaggacatagatgctcacagctgcatgcatgtgtgcaggaggtgaggggggtggtgcatgtattttttcaaatgggttcattaccacaattggaagaaaatcaatgcaactatggcaaaacctcattgctttgttgccaaaggatttctgatttcatttttttttttttttttgtaagacagggtcttgctgtcactcaggctggagttcagtggcataatcatacctcactgcagcctcaaacccctgggctcaagcaatcttcccaccttggcctcccaaaacattgggattacaggcatgagccaccatacctggcttgatttcattctttgtgtgaaggagataggagaagggctttcagcactctgaagtatccttaaattgattgatgtattctcaaactctctgaaaaatagtggcttcaagttgcccgcctcataatttttgccacttcaaatttgtacattctatttctggttggaaaataaatacttcacaaaactattatagttggacacaaatatatcaacaactccatcatttcatacaatagctggaggatatctttgagatgaaggtcaagcaaacattctcaagtaaagccataggttatatgtggtgggtaatgtccagtgattggaaacacatcagaggagctactattttgtctttgtttggaaatctgttttgcagattgaaaaatgacagcatcgtgatacataaattactagagacttacaaggaattaagaaagtaagtagtaagataaatgatcaattggaacccaatttttcttgcatgaagtactcacaaatgagtacttgtgctgataggtgtactgggagttgtgtattcacaatgagaaagcataagtgtctttggatgggccttagctatacatccttgtaagtaatatattacaactgaagaaatccctgaggtacatctggcagggccccagcttcaagttgaacctgaagtagagagtgagcttacaactcttgcgcatgagtgcacacacacactcgcactccaaaaatatatgccaaaaaaagcttcccagaaaaaaataatttaaaaaaatccctgaaagctactggaaagtcatacatatgttaaatttggtcatttagcatcataaattgaagttggaatatcatgaaataggcagatctgatcctcccacattccccagcatttacaggaagtctgagacagcagaggttggatggcgatgatggtgatgatggtgatgagtatgatgaatgtgatgatgaaggtgacagctaacctttattgagttttgctataaactaaatgccactctaaatactttaattcataaaattctcacaacagtttattttacatctgagaacactgagacacaatgcttagattgtctgagtaacacagtaactaaatgcaagattctgttttctacgttgtagtgaaataccatcgatctcagtggaacaagttgcaaagtaatttgtagaaccattaagtcaattagggaatttaaaattctgaactatggtggtagaaaaaaagccacatttcaaatagacatgacttcagagaggcaaagctaaaatttaagccatttacttgccagtttttatttttattttaatatttttaagttttattttaagttcagggaaaatgtgcaggtttgttacataggtaaacttgtgtcatgagagtttgttgtacagattatttcatcacccaaatattaggcctagtacccattagtaatttttcctgatcctcttcttcctcccaccgtccattatctgataggcctcagtgtgtgttcttcccctccatgtgtccatgggtccatatcatttagctcccacttaggagtgagaacatgtggtatttggttttctgttcctgtgttagtttgctaatgataagagcctccagctccatccatgtccctacaaaggatataatcgcgttcttttatggctgcatagtattccatggtgtatatgcaccccattttctttatctagtctatcactgatgggcatttatgtggattccatgtctttgctgttgtgaattgagttgcagtgaacatgagtgaatgtgtctttataatagaataatttatattcctttgggtgtatacccagtaatgggattgctggtcaaatgttatttctgtctttaaagttagaatttcttaactttactatgaaccactcaaaatacttgaatttgcacatgtgcatgcacacacacacacatagttagtgttacttaatctaagcattgtgtcttggtgttctcagatgtaaaataaactgttgtgagaatttaatgaattaattatttagagtggcacttggttcatagcgaaactcaataaaggttagctatcaccttcatcatcacattcatcatattcaccaccatcatcatcaccatcatcgttatcaagttaccaacctcatctgccaatttttaaccccactgccatagatgccactctaaatactttgtaatttttaaattcagtgcttttaacaaatggaaaaaacagccgtgattttcttctaaaagatttttaaacaaaaattatataagtagttataaaaacaggagattgttcataaatcttgatctaggtaaaaacttaaaaagacccagagaaatttcacttttcacctttgttggtcttatttttttaacaactcctgactttgttcattgttcgccgaatccatctcggcttctttgatttcacaccacactggttttgtgcgattgccatttcacatgaacatctggattttttttctcctgtgcttgtgcacatttggagaaagatagtaattttcatccaaatttattctactttactcagccatcagaggaatgttaactgtacatgttcataatgtttttttttaattctaaaaaagatctatgtctgccaggaagagaaatatcctttagtttgtcaactggatccttctagaggagtcaatagtatttttgtttttgatatgatcttccatcaccattcacagacttctagaatcacagcttcatatgctggttaattctaccatatagatacatatatagtaagatggaggcatttctctcgagttcctttaacactctctgtttctttgatattcttcttagtcattgctgcacttctgacaagtctgaatagagagttgtctttttgttaattgttgaatagatgaagagtatagttaagatattatatttcaacatttttaaaagctataatgcggcctgttcctttaggtgtatcactatagaaaaatctctttattcttgttcctttagaaataccttgaacaattagaaaatttcctggattgatgattgcccattttgctacttaaacactaaatttggtcacatgatctgatggaattggaatatggtatcattaaatatctgttgcaactcagaaaccaatttcttctaatgtgctcctccaagggcttcatttacattgcctgattcatccttacatccctatgacataaaagaagggcaggtatcacattatccccattttccaattgaggcatctgcgaccagaaaatggaggcacttgcctatagttacacactatgtcagaggcaggagtaggcaaagatactacttttgttcactgccaatccacccttcttttcattagtcactagcctccttatttcgtaaggtgtaggccattagaagattgatcttgtggggaaaataacatctgttttaaaactcaatgccttttacaagtttatatgccttgatataattttaataggtgcatcattgcctgcttttctttatgagagatgatataaatatgaaaaaatacacttgcagaaatgaaatgaaaataataaataaagccctcttccatttccattattctaagtcatgctccttgagacttcaatctcaatatgatgttaatagaaccattagatatgattcatatcatacataagacattcctattgacaatttcatcttgaccaagggtcaatggatccattacaatgcaaatcttactgtatactttccatctaaatcaaaagaatttggtcttgtgtccattctaatatgtttcatgaagtagaatccaatctcagacatgaagtacacatctgtttctcatactaaatcatgcctgttcctatttgctctcaatttaaaagataattaattacgttttacatcaatagactactttggagtatttaaagaaatgcatagggtttatgggaatccaagtttgcctgtttaatacataccaacctgcaagaaaaattccttcatggatgtgcatctcttaattttggggggtgcatgtaaagctattctacgtatttggtaagatatgcagaatcaggacatgttccaaaagattacctaacccagtcttgtaaagtacaagaacacactgaggtttcaatcagtttttcagataagctgaagaatgtctcactaggcacaggattttttttaaaaaactttcgcttttccccatgctatttatttctactttttttttttttaatcttcatctcttattcctgcactcttgggcatctttcagaatccttctctattcagtgctctaagtagcttataaattgcaatctaaccttgatatggacaatcattgagcccatttctggccacctttaagtttcagggctctcctgatcacctgttatctcttccctttccttgtccgtattattttccttctagaactgtactactgcttctctctatttgtgcaccacaacagaaagacctgctgctgatgagggcttcctgttacagatgaggttaaagtagctgaggaatagctgaacaagaccttacgtaaaggccttttctcccctagggttccatgacattgcatccatactctggtctcaccatgctcctccatcttcctttcttctttcttggaacgttgggtagtgatgaactttggaccaggaagacttctgtataaatccctgatctactaattcttgcggtgtgatcttgggcaaatcctttaatcttgtctaatccttagttttgtcatccataaaataatgataataattatccacattggaagattgttgtgagaaggaaattaagtgatttatgtaagggtcacaatgcctgactcaaagtaggtatttaagcatgttgttgccttgctccctctttactctctctttttttcccatttctctccaaaatattcgattttgtgaaacaaaaaatgttgattttttcaagctttccattatccaattacatagctaccaactgatgagctgttccaatatttatttcttttcaaagcgctttacttcttgtgggttatcgacagctagacatattttttcctctttcagttatgaaagatattctcagactcacaaagctttaaattttattcaagacattgaaacataaaagttcagggattattcaatgatgttaactattgaatgtacacaaaaatgatcttacttgcaatctagtttgtatgctgtttcaaacatgcccaggactcccaagttcaaaggttctctctacacgtaagcggtagtcaaaaatattagttgttttattgcggacagccttaatttatataaatggaaaacatctaaaactgcaaagtacaatagtccagaaagttttcattagcaatccagttcttggacatcacagggaaactcggcagaaagaaatgataagttaattgttgaaatgtttcatattcccaggttcagtttcttacaggtattcgcacctgcctcacctgcacctctgttactctctgtgacatgttccaccaccctggacaagacaaatgtatatttgaaagaataagggtgcttgttagtgggtaggtgtgattatgggaggcaattctagtgaggaaaagatgggttggcgtatggggcagcagtgaagaaaaataaataaaacagtttatttgtagtgggactgatccctcttgctcatgcattagtgcttggctacaggagagtagtaatttattgatgcagatggctatgtaaagtgcatgcaatttgtgagggggcttgacccttgactgatgggccatatgttgtaaagccctaggggcgtcatttgcctccgctctcttcctctctctgtctctgcacctatggtccttattcaatcaccacatattgaactatagacttaccaactcccccaataaatctccaactaatggctcacaaaggccataacttaaccctttctacacaacagagcacattattttgcatcatgatcacactcagtgaaataaaagataaatattatatgacctgcctagaatagaaagcaaattgttgtaaaatgctgttccctgctgggtattcactgcatttggatgtagtagggttgctttgagcttgctgaattctatcgttatattctgccatgttataattacagcttactgttataacataattcttaaacactgttaatacaccacactagagaaacatttaatgttttttaattagcttcttttgtctgagtcttcttttttccctagtaaaatatggaacatatgctcaatgaaaaaatgcatatatttttattctcatgtagaagcaagtttttataaaatatattagggcatttgtatggaataacagaaaaaaagtacagtgtacgttttaaatactcactgtgctctgaattttctataggacccattccagcagaaagacttaatgaaattattcattctccactgaagcactgggatttccttataatgtgggctgtctgagtcctaaatgccacctgaaaaagagtttaggacaccaagactagaaaaaagtcattgctgcttatctattaacttcattttttcccatccaatagtaaaactgaataaatgatactaatcagtaatgtgcacatcagtacaatttctctaatattaggaataccagtcagttgccttatgcttattcccatcacttggataagggagcagaaggtgtcttccttggaatcttgagacaacatcactgcaagcaagaagcagacatctattgctaaactaaagttgaatttttgtatctactccttttccccttttctgggcatggctcttggtagatttagcagcaatttagagagcctgggggagtgtaggaagaccacaggtttcaccagtgcatagcccatctgtagaaatagttgtcagagctgagtatctctagttatattctatgtttgtaataattagcttcccagaaaacaatttgtcttttagatagcttgctagtacagtgttcacagcttgtgtgtgatatgttttatataatatctctgagcatcttaattcagtaggaatataatgtttgatttctaccagatcaggtttcatatcctgtgttggtataaaaaataggtttcataatttttttttcctaatgcataatttccttacactatagtgaaaatccagctttctgaaccaattaaaagaaagatgaaatttcatgtacacatatgctgtgtcaaaatgttcatttatgagtcactagtcttatcaacatggataactgatgtagaaaaaatattcaaatatacagaaaagaagaagtcattgtcttctgtcctaaacccagtagacctaacacatacaatgcaggcagaaaggaaatcagcataaataaaccatgcattcccaattgaatctcaataatttaaacataaatcctttaggctttggtaccttttttccacatgggcttttcttttggatttggcgttcctagcatcatttagaattcatctgcgagccacaagtaaatagagtttccataaaccttgaataaacaatcccctttgaggttatattccataatttaaggaattccaatgaaaacatggttggtaaggagttttccaagatgtgtgtgtatcaatatatttgcctataaaaaggaaccaacatgttaaagcataaattaccaactttcccgcatataccatatgcacaagggagggacatctataatatatgtatttctgagattgacaacaagaaaggatgaattgctaatattctgcttaccatgtattcaaaaagtctccatagttttcagaaaatgtggtgagaaaaacttttctctcttctgatgtattttctctctaattataatttggcatctagaatgtgttgtttcttttaaaaataaactaaactgcatagcaaactatattgattttaaaagccctctaattaaaatagcaacttaacagcaaatgaccatgaagtatttaaaataaaaaatgatgatgtaaattgaatgtgtcaactaaagttggtacaaatgaagattaagagaatagttaccttcatttactctatgtttcatattatgccttatcccagttcttcagttagttaatatagctataatgagttcatactccttagaagcagccaacagagaagcttttctttaagaacattctaaatggttcaaatcaataccatttcctaaataaaaactttcttggctcagatttaaaacacctatggctgttggcttattctttatgctagcccaacaaaatgccacgtaatcttgtaagtaagactctgccacattctgatatcaacattgtcaatgagaaaactctgtgtatatacattcagaaacattcaattataattcgcctcttaaagtcatataactatctggtattacattgagttatcactgaacatattaattaaaatgcctcagtattgaactcagtggttcaaactgtttgtgtaacccaaaaacccttaatcattgacatttgaagattgctgttggtttttttaactaataggacaaaatttatttttagtacaaaaataagatataagaatagttacttaggattgaaatggcatgttaaatactaaaggaaaattggaatttgttttgttttttagaatggtttctggccaggtgcagtagctcacacctgtaatcccagcactttgggaggccaaggtgggcagatcatgagctcaggagttcgagaccagcctggccaacatggtgaaaccccgtctctactaaaaacacaaaaagtagctgtgcatggtggcttgcgcctgtagtcccagctactcgggaggctgaggcagcagaatcacttgaacctggaaggcggagcttgcagtgagccaagtctgtgccattgtgcttcagcctgggcgacagagcaatactctgtctttttaaaaaaaaaaaaaaacggtttctatgtcattgttgaaagtgataataatttttatgtatatgattttatgagaaataatattttaccaatgcacatatagggtacatttttatattttttattcatgaggatttccacattttttgtgcaaacactatatgttatcattattttgtatcttctatgtaatatatacaataaatcaacaaatatttattgaacacctactccgtgctaggtgttagaatgataacattgaataatattatctcctctgccttgaagaactttcagtgtaagctaccataatatttacctgaggatttttcatgtttttctaacagtttataaaattcctatatttggaggctctccagaaacagacggaaagggactagtgaaattatagttgaaaggtacagtgtattttgggggacaaatatttatgttattgtatttgttttctatgatatttttaaaacatggcactattcccctgacagaagtgaatttgccaagcattagcctagggtgtttagaagtaacagctgaaggattaaggaaacatcagcattgagtgggaggaattcagcataaagtgtgattagagcctccacagtctgctattcttagctattcattccctgcaaaatcacatcagtaattttcagtgacatttttaattgtccctgtacaaaagataataaagtagaagaaaataaaatcaaaagtgagaaaattcaagtactactaagatgtaccctggtgtttgttggttgtgggtgccctaaattacgtattaacagagaactgccttgtagtaaaatttgatgcccccatgggccctgactttacctttatcatgtagtttcatcatttcaaggatctttccttatggttaaccccttttcatcttctgaacaggttcttacagccagagggttcgcgtgctatttttagcgtgcttctttgagtggtggatagtggttgggaatttctttgcctgctgcatgaatacacttccctgcagagtgtacaaagaagcacttaatttcgagcttttcattttggttagtgacactgcaaacatagcacaggtggctataattttacaccatgtgagtaaaaatactatttttctttccccgtcaaccttcttgtctgatcgtcttaaacccataagatggggaattacagaaactgatattttaaattgatgaactagtttaagatactctttgaaaaggaatccaaacttgctatgtaatctgtattagtctgttctcacactgctataaagaaatacctgagattgggtaattcataaagaaaagaggtttaactgtctcacagttccacaagctgtagaggcagcatggctgaggaggcctcaggaaacttacagtcgtggcagaaggtgaaggggaagcagacatgtcttacatggcaggagcaggaggaagagaagggcgggggggaggtgtcacacccttttaaccaaccagatttcatgaggactcactatcacaagaacagcaagggggaaatacgcccccatgttgcaatcacctcccaccaggccccacctcaaacacaaacactggggattacaatttatcatgagatttgagtgggaacacaaatccaaaccatatcataagcaaaatgtaaaattgttaaggatggggaaagatttataaatgtagggttcaagttagtgtaaaagcgatagcattgtccaccagtgactgttactgggcctgtatctttatcatagtggatcatagttccattattgtaattatgccatagttttgtaaaaacctttatctgttatttgagatataaaatgttgctatctggcaatttttaggttgtagtctcatcttttaggttagaaagtatccttattttataaaaaatctctctctatatatatttagattaatcttctattaaggactagatattcatgttcaaacattaggttttcctgataatccactttttagataatctcagtttttattttagatttaggggcacacattacaggtttgttacaggggtttactgcatgacaatgaagtttgggtatgaatgatcccattactcaggtagtgagcatagtacccaatacgtagtttttcagaccgtttcccttcctttttcccccgtctagtagcccccactgtccattgttcttatttttgtttccatgtgtgcacaatatttactttccacgtataagaaaatgtggcacatatacactatgggatatgtgcagctgtagaaaaagaacaaaatgcatatatgcagcaacatagatgtgctgcaggccattaccctaagcaaattgaggcaggaacagaaaactaaatgccacatgttctcacttagaaggtatctttgaatggcgttgtcagacaaactcaagcatggatccttgctgaagtaccagaatcttgactggttatggttcaaaaacaactgaatagtattcacggatctgagtcttagatacaaaaaatgaaagtaatctagccgttttatttagctggtactgaagtgtagatgatgtattgcataaaattatagcaagtcatacaatttcccttggctagttggtcattccctttctctttatggtttctattcttgtacagatttctaactagtgatacagaacaataacttggatgacttaaaaacattatgctaaataaaagaagacagactcaaatgactatatgcttaatggtttgcttcatataaactttttgaagaggtaaaactggattgttggaaagttgatcagtgctttgcaggggccagggttggggagggaattaactgcaaagaccagagggaactttttggtgtggtgacgatggtctgcatcaccatcgtgtcatgaatgtcaagactcatccaatcttttctaaactttattaattttttgcctgaaaattatatccaacaaaagatgttagaattccactttggtgtgaatctaacctagacaagttgatactttttcctgtttttttttcccataagttaaagctatactgagtttattaatgaagttattaataaaattatttataaccctaatatattcctggttctagctgactttacctgtagttactaggtatttgaatagagtcaattgaagtataaattttaaaccaaaactaaacacttttttcccaagaaacattcgtcacacaggtgcatataaaatacatgcttacatctgaatttgcatataaagtgttgtaggaaaattagaaagcatatggtcttttcttctttttcattgtctaagaagcactaaagccaaataacttggcatgattcttccagttttactctttttaaatagctttattgtcaggcagatggggagtgctagccacttattaaaattacacttgtacatatcgtaagaatgttttatatttattcatgaatataaaatttttagaattggcatttaaaaccaaaaaaaacctgtcatagagttgagtaacaactttatttgtcactttgaaaccactttgaaatatcttgcagcatggacggttgcctaattaatattccaagattcaggttctctttaatgatgtttttaaaagctctccatcttaggaagccaaagataatcatagagtagagattgaattacatggaaagaatgaactttaagatgtggcatctcttccaagttgtattaggaaaatatatatgggaaaacattatcgtatactttgtaataggtactttcccgccctctgtgaagagtttaaaaatcagtacttacactggatagttttcaagcatcattttgtgagtgaataatctgagccaaagagatgtaacatagtccatgaacaccagacagttaaaagattcttctactttagaggttttttaaagactgatttaaaattaaaaaacagatatctatttattcatcacaattttgtgctacaaatttgaagaagtagaggataacattcttttgggtacttaatgaatatttttcaaataaatatctgaattactaatacatctcttagattcatattgcagctagagaaataactgcatcatttgctgaagaacatttgaaaatgtagaatttcttatttgacacatgaaaatatattacataatttaatatatcaatgaagacaggtaaatacatagataactacatatatagatacaaaccagaatatgcaggtaattgactttgaaaatttgtcctgaagacaaaacttttagacagttttgaggagatactatgtgataaggcaaattttataaaactgaagtcaaaactaaaccttctgtcattcaaaactatcatatgtcaaaacgtttttaggtagaactttaatagaactttagcatcttataatgtcatatccctgataaacttgagtgtatgcagagaatctgccaaaatttaatgagcacatgtctgaacaaccattactttgtggctaaagatatttctttccaatttctctccccagtatggttactctgcctctttaatttatccttttaatatgtgcagcaagtgaagaaatagaaagcttgggggaaaatgaactgctataaaaatgcaagtatctccagggtttttctacattctcttttctttatccctctttatttctgttttatcaaataaaatctttttctcctcatagttgcagtatccaaattgtgttttttaacacgtgtatcaaatggataaagtttaatagtataaattgccaaacaaaattggcataagagtttctccaggaccacagtttggtgtacaatatgataccaaatatatcctaaaaattattttctcttaatttagttatagatgaaatgccaggtgttgtattgcaagggtgattaaaatcaacttagctccttggaatctttacctttgtctacataaagctgttaaaggaaactggaacccgctttttctcagtgatgacatccaattgttttcccttatatatagggctatgaaagtatgctatgagtttagcaaacctatctttgcaatgtgtatgtgttatgtagcttggatttgtttcaaaatctgtagagaggctgcaaaatttgtaaccaccttatagaaaagtcaggtgtactcccttccactgcccttcacattttcattgtatccatgctttcctttgcatgttcctctaagataagagttaataagttgtaaaaacaaacaaacaaaaaaaaaaaacaaaagaaaaaatgtctctgataccttagcatagtgtttctgaaccactttccattactgccccttaaaggagtcttttcaacaatttttcctaattgctattcccttgaaatgttactactacagataaactgtacatctgtttatatactgtatttgtgttttaatacataaaatacttgatttttggctcactcccctgaatctatttttgcccccttaaggttagcattgcctcccttgagaatgcaggctgtggcagtattagattgtccactctagtcaggtaggacacattgtcatgtgctgttctgtatgttccctcttttgacttccccttagaaatgctttaataattacattattcaaaggcatagccagccatggtggcactcacctttggttccagctactcgggaggcttaggcagggggatcacttgggctcaggagttcaagaccagcctgggcaactggagtctgttctcacgtggctaataaaaacatacccaagattgggtaatgtataaaggaaagaggtttaatggacccacagttccacatggctggggagacctcacaatcatggcagaagtcgaatgaggagcaaagtcacatattacatggtggcaggcaagagatcttgtgcaggggaacttgtatttataaaaccatcagatctcataagacgcatttactaccaccagaatagtatggggaaaactgccctcgtgattgaattatcttcacctggccctgcccttgactcatggggattattgcaattcaaggtgagatatgggtgcggacacagtcaaaccatatcagcaacatagtgaaaaccttgtattttaaaaagaaaaagagagagagagagaaataaaaatgcacccttccttccttcctttcttccttctttccttctttccttctttctttctttctttctttctttctttctttctttctttctttctttctttcttctttctttctttcttgtctttctttctttctttctttcttgtctttctgtctttcttttagagttcattgcattttttgtcttcaactattattttaagttcaggtgtacatgtgcaggatgtgcaggtttgttccataggtaaatgtgtgccatggtggtttgctgcacagatccacccatcacctaggtattaagcccagcagtcattagctattcttccagatgatgtcactcccaccaccctcccaactacaggccccagtgtgtgttgtttccccactatgtgtccatgtgttctcatcgttcatctctcacttataagtgagaacgtgtagtgtttggttttctgttcctgtgttagtttgctgaggataacaacttccagctccatttatgtccctgcaaaggacatgatcttgttcctttttatggctgcatagtattccatggtgtatatgtaccacattttctttatccggtctgtcactgtggacatttgggttgattccatgtctctgctgttgtgaatagtgctgcaatgagcatacatgtacatatatctttttgctagaatgatttatattcctttgggtatatacccagtaatgggattgccgggtcaaacaggattgtctttctggttctagatccctgaggaattgccacaccatcttccacaatgctggaaataatttacgttaccaccaacagtgtaaaaacatttctttttctctgcaaactcaccagcatctgttgtttcttaactttttaataatcaccattctgactggcatgagatagtatctcattgtggttttgatttgcaaggaaatgcagttttctttgtctatttcagaaagagcacaggggatgggaaaagatgagaataagctagccccctcctctctaaagagagaatttatattttggttcttatagatgacattcttagaattaatatatattccatgaatgagaagccatgtaaatctacttaaacagccatgctaaaggattaaggttgtttgccattatcatctccagtagctcccatagacttccactatgttaatgacaaataatatgtgtatcctccattcaatctctactctggccttcctgataacactgtaactcatatctttccaaaccctataaatagatgcatatttaggggttatgtcctggactgaggtacagtgttgctagaaaataaatataacacaaaacacataaaccaattttatgaattaggctaatttatgcaagatgatgatatgtgaatgatgagaaattatgaattattattacatatattaaatgcttattagaatccaggtacagtgttaaaaactttccatagattttctaatttttatcctcacaataaacctatagatacttttgttatttttactttatagataagaaaaataatatccaaagtgcattttaaatactggtttaaatagctaattttattgatggttataatgcgagaagagattataaaaatcagagttgactaatttttgcttcacttttttatggtggctttctgtcttgccagttgtggagatagtagcaataagtacaaaaataaaatagccaccaggaggaaaaaagacaaacaaaaatatgacttaaattcaaactcagactctaaaattggctgttttgaaactaacaattgttctaatcgtaatcatggtaacagctggcattagttaaccgcttactaaatcatcatcaccttcacagcagcattttcattttactgaagaggagacaaagggttagagatgctaatcatattccttagattctagacctcgatattttattagtgatggtctggattatttgttgttgtgagatgtgttaagggtaattaaatagccttctaagaaaactgaaaacgtctctttttttcacgtaaacaattatcacaatataaaatgagtagaatgtgccatttttttaaacgcctaaatttttagaatcgtatatattttctgaatataattgcccatgaccataaatttttttaactcttttgagtttaatacagtgtaccttttcttttgaaaattttcagtaacttaatgacggcattgcttatacgggaaacattatgcaaatgactcacaatgaagtctgtgagtttagttaagcttgagaaaaagtttgtaattaacaaattagcatttgaaaaagacatttgaatatgcatagtagaaaattccacttaacttgtggggtgtgttcataatgattatttcagaattcatgcatatgcatcttttaacatgcaaatattttaaaccttagtggactagtccagatctggctcatttctgttgtggttgttgttttagttaaatgttgaaaattgtaaataaggcatcatgaatacacatactaacatgtggagtcctctttacttctctttgatatagtctttttaattattaaagacacaatattaaatactttctatttattattacttcactgtggataaaaataacattaagaaaaaaaaatcttggtatctgacttttcctaccaaagtgtataatgtgtactagaatgctatagtcaggacttcatttacctttatgttcaattgtgctgttagaaattagagtttgatgtctcacatacacacacagacattacattattcataaaaagtggcaagaataccttgtgattacttttaaacctctcttatataatatattggcttcattgtaaagtatattttcttaacaattttttaggtaggtcataaccctcctctgtttaaaaaactctaccagttcttgattaattatcagatatgatctcagacctttagttcagcattgaggactgttctccaatacaaagcacctctctcacctacatctcttcacatgttccattctaatctggcctcgattctaattcttatgctttctataaatgcatgatcgctaacccatctaaatgtttagacaaaccgcttttctgccgttataccttactcaccttacttaggctacatgatattttcccttgatgaattcctacagtatttatagttcaactattatgttccctgcaaaatggttatgtggaaagttatagctaatttaaatctagggttgataaatatgtgaattctttgcctttctagatagagaaattatgtcttgttttggtttggccaacctcctaaaatccaataggcaactgaggacagaagattgggcttgacttggcttacacagaggatgggcatctgtttctaatgaactcgtaatttatgccccatcttgtagccaaaaggaattaatagacctacagacataaaaaatgaataaactattttttccacactagtttgtccataacacgacactagaaaataaggtcattacatggtctcatgaaacccctgccaatcctatgacttgatgtattttaggttctttcactttgctttatgtatttgttgtgactctttgacaatatctgatgtttaactttgccttcagaaatttgccatggttcaacttcctttcagtgctcctgccttccttttcagtttattgatagtttcccttgccctagacactcatgtggacactgattacacaaaaccaatcaaaatcgacattggaaaagcaaaataattaagaattaaaatcagccagttcctgacactagctccaaggactagacaggtgacacctgaacagagtggaaaatagttgttgggaagtattccaggcacaaggaacagaatatgcaagggcattcaataatcaatgtctctgaggacatcaagtggaatataaaactagctgtattatcagatatcagaaaggccttatgagccacgcttacactttgcaacatactagaaaaaaagtcattcaaaggttgtataatcaatcctagctgaagatgcttgcaattgttcattttcctataaacatgtatggacagtggataaatcccaaatttttactctgaagcttgtgttgtccagattagatttgctgtttaccttagttttatttcctgaccaattttcaatccttctttcgttacctcccagacacttgctttttaaaaaactatatttttacaaaaacaaaaggacaaaaggtttttctagacagtgttagtgcattcaatacagaaagtttccagttagacaagaattttactgtctctatatgaagacttcactttgcactaaatataagaaaaaatataaggaagaagaaatgtaagaaaaaaaaaaaccaccagaaatagtcttagaaatgcgtatgtttgtacattcatccctcagtatctgtgaggaatttgttccaggacctcccatggatgctcaagtctctgatataaaataacatattatttgcctatcacctatgtgcatccttctatatactttaaatcagatgtccccaacattttaggcaccagggactggttgtgtggaagatgatatttccatggatggtgcaggggaaggaaggatggtttcaggatgaaactgtttcacctcggtcatcaggtgttcaagcagtagattctcataaggagcaggcaacctagattcctcacatacgcagttcacaatagggtaagcacttctatgagaatctaatgccgctgctgatctgacaggaggcggagctcaggcggtaatgctcgctccctcctgctgtgcagcccgtttcctaccaggccacagaccagtatgagtccctggccccggggctgtggacccctgcttgaaatcatctctggattacttttaatatttactacaatgtaaatgctatgtaaatagttaatactgtattgcttagggaatcatgacaaggaaaaaatgtctctacatgttcagtgcagacataatcaaccatttttttctaaatacttttgatgcagtttgcagatatggagggttaatttaattttgcaagctcttataatcaactattgggattcatcattattttcagggtttttctcctccttttatgactgaatttatttttttaaataactgaattactgcataaaatataattattttcataacttataaggatgtatagactgtaattaggctgttgtatggtagctgacaggtactgctgatgaaattttactaagtgaccagaataataaaatttattacacaggttacttcctttagaggttctactttttggtcttcaatatctaacatgctttctttattattaatataaatataaaatagatcttaatggtagggacagatttctctctgtaaatagaagtacaaattttgtatgaaaagttgaagagaaataaatataatattcccaaatctatccacaaccattcatacttgataaaatgtaagtttactgtaaaatgaatgaattattgatgtacttagcaaaacattatatctgcacaaagtcataaattaaacaaactctaatacattttatgataagcataatttgacctgagtccttgttagcctcaaagcataatataatgatcagaaaaattgggggtctaatcaattaatttgaaaatctgcaatgagattattatttatctagagtgaacgctttactagcatacaaataaagtttttataaatgaaatagaataaatatctaattattggaacttttccattaaataactgatggcataaagaggcttctgcttttaaaaaaaaaaaaaatatttgctgatataaacctgagaatttaaatgtcaattatggcaaaaatattttctgtacaactttgttgttttttaaaacattattaatgtaacagctactacatcttattattttcatccattctgcaaatctggtgaatctatttagtctacatctagaacaactagaaaaatatgtataatatatgtatctaaaagggaaatgaagatgcatgaaaatatctaattgtgtaaatactgttaagctagagaattaaagatgataaccccttttcaccattcagccaagcgtgaaggagcaaaagagattcaaaacttcattaattgctctcacacaacgttacaggccacctgcacttcaaagaatttacattggagcagatggattgctgaatgcgatatcaaagaatttcagaatgtttgttttaaaaataacctggattctaaggcaagcaccagcaaagcatacaatttacaaagatgacaaagcttttcttattaaaacttctaaaacgtataagtgaaggcacatttttatctctaaaataagagtatacataccaactactctttaaaatgatcaaagttacatatttaaatatataaatgaaatatattcatgcattatttgaggcttttgaacatacctaactggtttcctttagtaactcctagatcagtgaaatctagctttttcccagtataagttttcacatctctctgattattcaatcttttgaataaagatggtccatatggaaaatgagatttttaaaaaagtttaagagtaactttttttgcagaaactcctttcacttgtcatttgattctgacttgagctcggtactttgattgataggtcctactcgcaatgcactgacagaatccacattggaatagctagttaagatgaatcagagctaatctaaatgcatcttggatcagattatgctttacttttggaacatattgtaatttttgtattttacagaagtttctatagctttacccacaaattaagttttacttggaatttgcatcacaatattttcattctttaaatattgatgtatcaggggtcagaaaacaacaacagctagagggctgaatctgaccttgtacctgtttttgggaaataagattttattttagcacagtcatacccattcaattacttattgtctgtggctgcttttgtgctacaacaatagagctgagtagtcacaatagacagtatggcttaccaagccctaagtgagatatttactatttgcctcttcacaggagaaatttactaaccctgatgtgctagcacatgttataaccttgggtaagttttcttaagctctctgagcattaggttcctcatctgtaatataaagacaccgatggtgtctacccagatgtccctgcgtgtggtaataataatggtacctagccgtgatgattaaatgggataatataagctgttaggaaaaggcctcgttcacaataggtctgatacaaatgtcacccaacatcaacatcactgtcattttctcaggaataatgctaggtcatggagactgagaagagggtttcaaactacattactgtagtctgttcatcttcactagtcaaacaataaagtgggtagcatggttttgtattatgatcatagaatttgaaggtggaagccctgggtatgatgacaatttgccttcttctttgctgtttaataagacctgcagtgagtaatgtaaacactctaatcctctctttcttacctgtaaaattataataatattattaataataatatcatcccccaataggctgtatattgtaaagggccaattaaattagaaatatgaagtagggtaacttgtaaggttgcaatacaaatcaaaggtttcactgcctcattaaccgtacctcacttccatgctttgaactttggggtaatgaatatgtgtaattatttagctaagagggctcaagattaacgcttttgtgtcgagtgttgccacacacatcaacatggatgatcttacaggctaatgagggaaagaagccagaagccgaaggccacagacagtattatcccctttatataaagttctacacctagaaaattaatctttggtgatagaaaagagaatcagttacctttcagggtgtgtggaaggggcatagggtattaatggtagagattgtaggaggcaggtgatgttaccggtcttcttgtgggtataggttacagggctatgttcactttctacgacttcattggccagaacacttatgatttgtacatttcactgtaggtgtaaaatgcttacaagaagaacgaaatattaaaacaaaaaaagagaaaatgaaagaaaacaacaaaagtgttaagtccatccactgatcctgctttcagagccataaaaaaaccgtctgctatacaatctatttacctcgtcctctcacttacaccaatctttctttccacagcaccataaaatctacctacatacatgtaagaaaatgggactctcctttagccagccttgtctcctataccaccttgaatacgtgatgtttgacagaaatgacgttttatttttctctttatataaatcctatgatctccacttttacccaaagccttttttaaactaaagcattatgaccttaatgagactcatagatcacgttcactctctatcttacatgtatcattgcgctattctccaaagttctgtttgaattttattttatatcactccttttcctaaactatgcacatgctcatgaagacaaggcaaaacaaaaagaaaaaataaacaaatgaacaaacaaaaaatccacaggtcttaatagagagataggtttgagtagcaagaaaatatagtttagaaaataaatgttatttatttttgaaaagataatgccctatataataccaaatgccctatataaataccaatgccctatataaaaccaaaaagtataaaagctatgaagagaaaatcaagtctctattttaccctaacctttaggaaacccattcccttctcagaggtaacacatgttgctgttattttgtgcaaactttcattatatctgtgaataatctgcgcatatgcatatagcagtgtgttttacaaaaatggaagcttgttgtagacattaccttatactctatttccataagtgaatcatgtatcttgaacatcttccatgttaataaatattgagtttaaaatacccccaaaagtaatggaagcctagaaacacaaaattatggagctttttttttttttttttttgagcttgagtctcgctctatcaccaggctggagtatattggcgtgatctctgctcactgcaacctccacctcccaagttcgaacgattcttttgcctcagccttccgagtagctgggactacaggcacatgccaccatgcccagctaatttttgtatttttagtaggatggggtttcaccatgttggccaggctggtctcgaattcctgacctcaagtgatccgaccgccttggcctcccaaactgctgggattacaggcgtgagtcactgcaccaggcctatggagcagttttttaaaagaactttgcaaatattataaaattgccttctttacatcatccatgtagaatattccttataaccacttttgtcagtctgagagcgctttttgttttatctatgtctgttaaaccatatgctgaaactgttttctgctttcttcatgaggctttcccttatccttcacagaactatattgaataaatatttagtctattactcttgaagtctacactgaaaaatacttgaaacattactacttttccttatttgtttgtggcattctggccacgagtttgtataaattatgtttcagaactttgggctttgccagatgttgagtaatacgctgctaagatgtaagtacaaatggtttcactcctgactcctttgtacaagtgaaagacaacttggaattctaaacagattagaaatggaggttgccattcgtttgagctctcttagaaaagaaggctctctttgacaaatccctctgcttattagacaaagtgcaaaaagcattacatctggagttcataagccattgttttatggaattgatccatcatacaatcccttacgctcttgaaataaacccatgagaatttaagatgctatatgcacacttactaacacattcactcatacatacacacccctctatgcacacatgctaccattagagacttgtgcccttgcaaaaaaatcttatagcgtagaattgcaacatgctttttaaattgatagttatttttttttaacatcgtttatctttcaaaagacttctgaattcagctacaggaattattcttattcctcgaaacttataaccccctattctttgtactcaaaatgttttgtaatacaacattttttttccattaaaaagagcaaaagtaaagctacaattatttttgaaacacaccatccccagatacttctgaatttattttccttcctcaaatcttgaagcacgtattatttctttcacatctttagaccgttaaaactcaattgttcattctgtgagaagaaaacttaaggaaacattcagcaagtagctttatatgtgggagatggatttttagaggattttaggtgtttgagaagagtttctcatagattctgttgctttcagaattcctcaggatgccattctaaaggatgactgcaattcagatcagcgaagtgctttgatgtcttattttttcttttgcagattgtactccacatgttcagaaagcctttccctagagtataatttaatgtaattgacagtcattgttcctcgaaagtttgaattaaattaacctgagcctgaatgaaactggtaaaataaccacgtacagatttcattttattttcctttaggatcagtgacaatattatgtataaaattggcagttggctattagatcttcattgaatcaccctagatttgattaaaagtagatatttcagtgtacagtaatttaggttcatgaaaaactcttaggtttctcatttagttattgggtttattgaggaacagggtattttatgtgtgtaatgatgaattttgttctttctctttttccactgagatcaaatacagactgcaaaattgaccgagcatgaaattgtttttagaaattgtgggagctagtttcgatggcaagaatcagaggaaccgttgttagtgaaaatgtgtttggaaaggatgatggtagtgggtaggagagaatagaggtagagaggtgttaacataaggcaaaaacattaaactgacaaacacttctctgtagagtagttgatgtgttaagccagcacacttaaaagcatacaagtttttggatagaaaagtcttcattgttctgactgtttttctggacatgtagctggaaaggagactcaaatcttcatatggattttgtgtcttatggtcactgacactgcaaagcaattagccttcatgatggctgtgcttatgcaatactaattaacatgcctgttgtgctgttttccctgtttgaccatgtgacagcccacaggtctgacactctctgtgaaccaacagctgaggaaatttccaacatggcagattttttttacaaaacacacccaaacaaaaatggaatcacacttttcctgaacaactgcattaacagaatgtgttacaacggatctacaattagaggattgcattcatatgtactggggaaaaaaaaggagacgagaccctactcaagcatacggatacaaattgattatacctgggtccagaatttcaaagtgtgataacactgtattatagtatcatggagaatataatttaccagtacaatcacatctagtaaaattatcattgaaagttagaagtaaagttgtcaatatatttacggcaccatgtgagacctctatattgaagggctaatttagtaaatttgtatgtgttatgactttaagagtttgggcattggtgagttttgtttctgtgtgtttgttcctgttgtgagtgggactggaatactatgattaacaaaatcatatacaggcacttgatatgtggattgtacagtctagtgggtgaagttggttgaagtttatttataggctctacaaataaatataaaattagcactgatgtgaggggaggtgcttgatactctgagattgttaatagcagtttttagccagattgtaaattgaggtaagttcctttggaagtgacaattgagaaagacataaagtaaaattgacggttaaatgggtaagctgaggctagagcaccaaagacataaagtaaaattgacggttaaacgggtaagctgagactagatcaccccagacataaagtaaaattgacgtttaaacggggacactgaggctagatcaccccagaaattaagtaaaattgatggttaaatgggaagttgaggctagagcactaaagatataaagtaaaattgacggttcaatgggtaagctgaggctagatcaccccagacataaagtaaaattgacagttaaacgggtaagctgaggctagatcaccaaagacataaagtaaaattgacggttaaacgggtaagctgaggctagatcaccaaagacataaagtaaaattaatggttaaatgggaagttgaggctagaacactaaagacataaagtaaaattgacggttaaacgggtaagctgaggctagatcactgaagacataaagtaaaattgatggttaaatgggtaagctgaggctagatcaccaaagacataaagtaaaattgacagttaaacaggtaagctgaggctaggtcaccaaagacataaagtaaaattaatggtaaaacgggaagttgagcctagatccctaaagacataaagtaaaattgatggttaaacgggtaagctgaggctagatcaccccagacattaagtaaaattgatggttaaacgggtaaactgaggctagatccctaaagacataaagtaaaattgacgattaaatgggtaagctgaggctagatcaccaaagacataaagtaaaattgacggttaaacggataagctgaggctagatcaccaaagacataaagtaaaattgatggttaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaatctgaggctagatcaccccagacatgaagtaaaattgatggttaaacgagtaagctgaggctagatcaccccagacgtaaagtaaaattgacgggtaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaagctgaggctagatcaccccagacatgaagtaaaattgatggttaaacgagtaagctgaggctagatcaccccagacgtaaagtaaaattgacgggtaaacgggtaagctgaggctagatcaccccagacataaagtaaaactgatggttaaacgggaagttgaggctagaacagtaaagacataaagtaaaattgatggttaaatgggtaagctgaggctagagcactaaagacataaagtaaaattgacggttaaacgggtaagctgaggctagatcaccccagacataaagcaaaattgacggttaaccgggaaggctgaggctagatcaccccagacgtaaagtaaaattgacggttaaatgggtaagctgaggctacatcaccccagacataaagtaaaattgatagttaaacgggtaagctgaggctagatcaccccagacatgaagtaaaattgatggttaaacgggtaggctgaggctagatcaccccagacataaagtaaaattgatggttaaaagggtaggctgaggctagatcaccccagacataaagtaaaattgatggttaaacgggaaggtgaggctagagcagtaaagacataaagtaaaattgacggttaaatgggtaagctgaggctagatcaccccagacataaagtaaaattgatggttaaatgggtaagctgaggctagatcactaaagacataaagtaaaattgacagttaaacgggtaagctgaggctagatcacccagacataaagtaaaattgaagattaaacgggaagttgaggctagaacagtaaaggcataaagtaaaattgatggttaaacgggtaagctgaggctagatcaccccagacataaagtaaaattgatggataaacgggtaagctgaggctagatcaccccagacgtgaagtaaaattgacggctaaaagtgtaagctgagactagatcaccccagacataaagtaaaattgatggttaaacgggtaagctgaggctagatcaccccagaaataaagtaaaattgacggcttaacgggtaagctgagactagttcaccccagacataaagtaaaattgacggttaaacgggtaagctgaggctagatcaccccagacataaagtaaaattgatggttaaacgggtaagctgaggctagatcacgccagacataaagtaaaattgatggttaaacgggtaagctgaggctagatcaccccagatgtaaagcaaaattgacggccaaacgggtaagctgaggctagatcacccagacataaagtaaaattgatggttaaataggaagttgaggctggaacagtaaagacataaagtaaaattgacggttaaatgggtaagctgaggctagatcaccaaagacataaagtaaaattgacggttaaacggataagctgaggctagatcaccaaagacataaagaaaaattgatgcttaaacgggtaaactgaggctagagcactaaagacataaagtaaaattgatggttaaatgggtaagctgaggctagatcacccaagacataaagtaaaattgatggttaaatgggtaagctgaggccagatcaccccagacataaagtaaaattgatggttaaacaggaagttgaggctagaacagtaaagacataaagtaaaattgacggttaaacgggtaagctgaggctagatcaccccagacataaagtaaaattgatggttaaacgggaagttgaggctagagcactaaagacataaagtaaatttgacggttaaacaggtaagctgaggctagatcaccccagatataaagtaaaactgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggttaaacgggtaagctgaggctagatcaccaaagacataaagtaaaattgatggttaaatgggtaagctgaggctagagcactaaagacataaagtaaaattggcggttaaacgggtaagctgaggctagatcaccccagacataaagtaaaattgatggttaaatgggaagttgaggctagaacagtaaagacataaagtaaaattgacggttaaacgggtaagctgaggctagatcaccccagacataaagtaaaattgacggttatacaggtaagctgaggctagatcaccaaagacataaagtaaaattgatggttaaacgggaagttgaggctagaacagtaaagacataaagtaaaattgacgattaaacgggtaagctgaggctagatcaccccagacataaagtaaaattgatggttaaacgggtaagctgaggctagatcactaaagacataaagtaaaattgacggttaaatgggtaagctgaggctagatcaccccagacataaagtagaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccagacataaagtaaaattgatggttaaatgggaagttgaggctagaacagtaaagacataaagtaaaattgatggttaaacgggtaagctgaggctagatcaccccagacataaagtaaaattgatggttaaacgggaagttgaggctagaacagtaaagacataaagtagaattgatggttaaacgggtaggctgaggctagatcaccccagatgtaaagtaaaattgacggctaaacgagtaagctgcagctagatcaccccagacataaagtaaaattgatggttaaacgggtaagctgaggctagatcaccccagacataaagtaaaattgacggttaaacgggtacactgaggctagatcacccagacataaagtaaaattgaagattaaatgggaagttgaggctagaacagtaaagacataaagtaaaattgatggttaaacgggtaagctgaggctagatcaccccagacataaagtaaaattgatggttaaacgggtaagctgaggctagatcaccccagatgtgaagtaaaattgacggctaaaagggtaagctgagactagatcaccccggacataaagtaaaattgatggttaaacgggaagttgaggctagagcactaaagacataaagtaaaattgacggttaaacgggtaagctgaggctagatcaccaaagacataaagtaaaattgatggttaaacgggtaagctgaggctaggtcaccaaagacataaagtaaaattaatggtaaaacgggaagttgagcctagatccctaaagacataaagtaaaattgacgggtaaacgggtaagctgaggctagatcaccccagacattaagtaaaattgatggttaaacgggtaaactgaggctagatccctaaagacataaagtaaaattgacggttaaacaggtaagctgaggctagatcatcaaagacataaagtaaaattgacggttaaacgggtaagctgaggctagatcaccccagacataaagtaaaattgatggttaaacgggtaagctgaggctagatcaccaaagacatgaagtaaaattgatggttaaacgggtaagctgaggctagatcaccccagacacaaagtaaaattgacggttaaacgggtaagctgaggctagatcaccccagacataaagtaaaattaatggttaaacgggaagttgaggctagaacagtaaagacataaagtaaaattgacagttaaacaggtaagctgaggctagatcaccccagacataaagtaaaattgatggttaaacgagtaagctgaggctagatcaccaaagacataaagtaaaattgacggttaaacggataagctgaggctagatcaccaaagacttaaagaaaaattgatgcttaaacgggtaaactgaggctagagcactaaagacataaagtaaatttgacggttaaaaaggtaagctgaggctaggtcaccccagatataaagtaaaattgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggctaaacgggtaagctgaggctagatcaccaaagacataaagtaaaattgatggttaaatgggtaagctgaggctagagcactaaagacataaagtaaaattgatggttaaatgggaagttgaggctagaacagtaaagacataaagtaaaattgacggttaaatgggtaagctgaggctagatcaccccagacataaagtaaattgacggttaaatgggtaagctgaggctagatcaccaaagtcataaagtaaaattgactgttaaacgggtaagctgaggctagatcaccccacacataaagtaaaattgacggttaaacgggtaagctgaggctagatcaccccagacataaagtaaaattgatggttaaacgggaagttgaggctagatcactaaagacataaagtgaaattgacggttaaacgggtaagctgaggctagatcaccccagacataaagtaaaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccaggcataaagtaaaattgatggttaaacgggtaagctgaggctagatcactccaggcataaagtaaaattgatggttaaacgggaagttgaggctagaacagtaaagacataaagtagaattgatggttaaacgggtaagctgaggctagatcaccccagatatgaagtaaaattgatggttaaacgggtaggctgagtctagatcaccccagatgtaaagtaaaattgacggctaaacgagtaagctgaggctagatcaccccagacataaagtaaaattgatggttaaacgggaagttgaggctagaacagtaaagacataaagtagaattgatggttaaacgggtaagctgaggctagatcaccccagacataaagtaaaattgatggttaaacgggcaagctgaggctagatcaccccagacataaagtaaaattgacggttaaacgggtacactgaggctagatcaccaaagacataaagtaaaattgacggctaaaccgtcaaactgaggctagggcacgaagtcacacactgctgcacattggacttgcctcagatgttggttttttgtttgtcttgttttcttttgttttgcttctgttctctttttttcctaaattactgatacccgagtcccatgtctagagtctaatttaattgttcagtgtattccctggacattgagacctttagagtatccccaggtgattgtgatgcatagcaatgtttgagaacaattgctcagaatattctaggccgatggaaaaggccttgtggtaagatgaatcatggcaaaatcttaagaaggctgaaaggttacttgctgctcctgcaggacaaaagaggagggacctgggagagaggcgtgtgcaacatgagactgaatagctggccaagaagaagcttctaggccattataccggtttggtgctttgctgattagcagcaagaagccattcaagtctttcagtggacatgtctttccaccacctcgtgtgaaaaatatggaagtgttgactgcttttctcgcatactttgacttattcgtctgtatgtacctttaaatggacaggattttttgaaattaagttgttcatggagaaactaaaaattttttttttttagtctggagttatcacaaagttggaaaatgtattttaaaaatctacgatggtccatagtcattagatcagtcttcaattctgggtcttccagccaccacaggtggatctgagatgagttgtactgcagtgggctttcaacttgggctacatgtgacagtgacctagggacatttttacaactactgatgttcaggctcaagttagtcaatttacgagtgatagttaagcataatttttgaggttccttaggtggttctaacatttagccagagttaataacaactcacctgctggataaatctttttggatttaattaaatttgggcatattgatcttagacatgaactagagtctcttgatttttgaaaacgaggggaagttaaaatgaacaccttgaggtatttgcttaagtgcactcccttcacagaatagagatgagtcctttacaggcagatctggttaaaggaaactccctccggaatgctgggtgatggacgaaatgagggaaaccttgcctcctctggaagcttgccattggctacatcagattttacatgttgcgttttcaaaagtcagtctctcggatctaactttaaagatatgtacttctaacagttggttctgattatttccccacagttgtgtcaagtccacacagttgtatcaatgcttctgcttttctagacgctagttaacactcagaggttttacatttaacggaagaagaaattgacaaacaaaggaagtaaaggaagtttatgtggaatagaaagggaaggaaacagaccttgaacatgtgtagaaaggaggaaacagactttgtccgggatagaaggcccattgacatgaggaggcatgctaacagaggtcagaaagagtagaaagagtcgttggacatgggccaagaaggttcaacaccaggtagcagctgaatgagtccatcagtggatgggctacctaagcgggtagggcattgtgcttgtgggttattctgcaaatcctcctcagccaacaatgagtgtcattggatccatcaaaggattcagtgaaaatgaagcttttttgggtgaagaattccaaggaaattctgaaggttgtgacttagatgaagaaaaattctcagcatgaattgaataatattcacacgaagtctgaaagttaaaacttagaataagtactgaaaccacaccaactaacaccaggaaacgcagagggccatttactaataactcttaggagttcaagcatggaaaatgattttctaaaggtcaaacttagaagattatgcctttcacctccatgaagtttcatagctggaaaggaactccaatcccaacccctcatttaacaaatgagaaaattgaagtgaaatgatttgccaaactaaggaattcttgagagcaatgcctagagtccagactctctcactcatgagtcttttgtattcttagtctgtcatgctgccttcagaccagggcaaaatatgagactgaactgaagtgggagaaggtttacttcagtcatgggaaaccaccattaagggttatttgttgctgggaaagtacactgttgtaatagctgcactgtaacaatcacagctgactaacagcaagttatcctcagcagagccgtgaacagaaaactttggttgggcttcaggagatgagtttaaattattctctgttacagacaaatttgttattcattccttcattcatctgtgcctcctgtgtgcatgggagtgtgcttggcactgtagaatagataaagcaatagaccctgccctgaaagttcttatagtcagtatggaagataagatatacgtgtacagaattataataaaacactgactgacaaaagtgtcgtgagatctggaacaaatcagtagccaggacatttcagaagatagaggggctatttttatcttctagggcaaacagaattgccagagtcaagattatttcatgaaaaaggtagaatttaaattagacattgaatgataagtaagatgtgcatgatgaggaacaggaagaaagcattttagaaagagggaaaaagagaagcatgaatgaaaaaaattagtgctttttaacaggatgtgaaacattttttaaaatataagttgagatggcaagttggaattagattctaaaatattagtctacatatgtttaaactgacatttaaattgaggacagaagaatggaatagataggtgtggtatcaggatgtgttttggtaaaagcaacttaagagagagcgaagactagtctggagataagaaggactgaaagcctagagatatattagtttgttctcacgctgctatgaagaaatacctgagactgggtaacttataaaggaaagaggtttaattgactcacagttgaacggggctggagaggcttcaggaaacttacaatcgtgatggaaggagaagcaaacacgtccttcttcacgtggcagcaggaaggaaaagtgctgagcaaaggggaaaaagccccttataaaaccatcagattccctgagaactcactcactatcatgagaacagcataggagtaactgcccccatgattccattacctcccactggttctcttccatgatacgtggggattatgggaactataattcaacatgagatttgggtgggggacacatcaggagacttcttagattatgattgcaaaatctcaggtcagactaattgaaaataggaatcagaggaacaacgataataatacagattacaacagagagggacgatagagtggtgagtggcaggcaatgtctgccaactggataaaagtaagagaatggaaatggagaccccaagttggtttcaaagattctaagcctgggtaacaggagggaagacagagtcatgaaaatcaatatgggattcaaatgtttccgtgtcactcatcatattctcatagtttggaaaaaaatacctcactctttctcccaaaaatatttaaatctgccatacatattatatattgtatatgtacaacaggtccataaatgcaaattttgtaactttaatcacttttgcaggttagcatagatttacagcaaaagggaaattgacatagaattaaataaattgtgcagtagggaaatgaatttttttttttttttttttactgctctttctcaaactctagactctgcctagagttttaccatttgctatgctgcctcacatattccaaaaattattctaagaaagagttatttggagagttgatttagtttatagagcagctactcagaattgaaaataatcaatagtaccttaagattcaggctctaactggatatttaggcaagaacccaaacagacagttactcctataacgacattgagtaaaatgtagagagcatgaatgtagcagcccaacccatctgttctttttttctaattttgaagaggttatttttatatcagtctttggaatttttagttctgtctctgctatgctacataaatactgatgctaacagactaaatttaaaaaaaaaataaattgttgataagaggaagaggaaattgcgagatataaacctagccattttcccatttaggtggtatttccttactttttaaataaactctatgacttttactttctcactatctcctctctgcatcagttttcttattaaagtctcaacatttctgataatgaatgtctctagaatttctttacaggagacatttaggggcagctacctaaaacaggagagttggggggcttattttaaacctaaactgaaataatagactatttatttatttatttatttatttatttatttatttatttatttggcagagtctcactctgtcacccaggctggagtgcagtggcatgatcttggccactaacatccacctcttgggttcaagcaattctcctgcctcagcctcccgagtagctgggattacaggcatacaccactatgtccagctaacttttgtatttttagtagagacagggtttcaccatgttggccaggctggtctcgaactcccgacctcagttgatccacccaccttggtctctcgaagtgctgggattacaggcatgaaccactgtgtccggcctaatagacatatttttaaattgaaaatatatattactgattttaaaaaataaagatttctaagatgattttattcaggctttacataagatttttaaagagtccaatttcctaatattattactaatattattatcagaataattattctgggggagactggtgttaaaacagttcccaccatagctgataatataataaattgcattggctaagtgtaatttatgaaacaatgtacagtggaggctcctaactacttatatgaagactccaatcacttctgaaattgcatatgcatgtattacaccaaaattatagaataatataaatatacagcagtctatatatttattcaattatcaattcattcacttatcaaatatttaaaatgttcctatcatacatataggtgtggatatctaaattcgcacatgagcaaagcaaaattaaatggcctatgccattcatctgaaaagttaggcataaacactccactgaaaaatccctttttctaagccctctttgttctcatcatagttaaaatgataccttctttttactttagaaactaacgttcaaatattgtaactcttttactaaattcacggtgtagtggttaaatgtatcactctggggttaagctccccaattttgttacatacttgctgtgtgtcctcagagaaattacttgaccttgctgagcttcaatttcctttttttttttcttttttaagttatttctttcttttttaagaaacagggtcttactctgtcacccagagtggagtgcagtggcacagtcatggctcactgcagccttgacctcctgggctcaagcaatcctcctgcctcagcctcccaagtagctgggactactggtgtgcatcaccacacctgactaactaaagaactttttttttccatagaaactaagtaaagacatttttttttttccatagaaatagcatctagccatgttgcccaggctggtctcaaactactggccttaaatgatcctcctgccttggcctcccaaagtgctgggattacaggtttgagccaccaaacctgacctgagtctgttttctcaataataaaaaaaaagatattaatcgtacctatctcatagggtggttgtaaagattgaactaatgaatacatataaactacttagaacagtgtcttgtttgtggtgcgcccttaatgcaagtttagtattcttctgactgaagccttatttgtcttcattaggtcttccacaggcttactttccttgtctcccataatcacccctaaacaattatgggccatactagctcagcaaataagatcattaaaccaataattgtacctgtgtgtatttctgtataattaatatgcgttcttggctagaaattcttaaaggttatactgatgtggacaccaaatctaagtgataatgccaaatttccagatttcttatttaacatgttccagctcactcgattattataagaggttttaaagtcaactgtaatttcaggtatctattggaaaatacaataaatatcctctaaatgataaaaagatagaataatgcattaatatagctgaaatatagacttggaaggcaacaacagcagctggctatgacctttttattgagaaagtgacccagaaaatggccgaggaaatttcatcatttatttcccacttctgaaccaaagtctcagatgcctttaaatccccataggataaagttggctttaggttgtatataaaatacaaattgagtaagggaatattttttctttactgctcagatgttttatcagctttgaatagaaaaacacactaatatttatttccttaatatgtgcacatcagctttaattataatcaatccttccatagacggatttcatgggatttaatgtgctaccaaatgcaaagatagaacttgctaattctctacaattacacatttatttctgggcatgtgggtataaccgcacctccatgccatgttctttctatattgctacaaagcactatggattaaattgtaggtatggagtaccatattaatttggaagtttgaatgtctagaatattttatatttaagtacagatcacacagagtggacactccctagttaagttgttgaatggttgaaacaggtcaagataaatgaagccgtacgataaactatggaagacaaaaataacctgtctgtaaatttgattttggggctaaggtaggtttcttttgatatcacatttattcctgtgtgaaatataagtattctgtgttcataacagagtgaaaatgtatacatttattcaaatgactaatattaagagcatctactgtgtggacttatgaaataatatatatttattgcattcacaatgcttatatttgagtagagaataaagacaaggcaattaaaatataggggtatcttataactgagtttgtacactttgaccatattttgtacataatgggtggtggtggttgtgttaattaatccaattgtattcatcattacacaatgtgtgtgtatatatatacataaaaataaaatcatcatgttgtacatcttgaatatattcaatctttatttgacaatgaaatattttatatacatatatatacatatatatatgcaagtgctagggataagcagaaatgtatctggggacatggaaggtggctctgtaggattactaaacattttgagaaaaatcacatttcaacttcacctttgtaagaggttgtgctgggcttcctttccaaatgaaatgcggtgtgacagaaaatagactcatgtagctctctttagtgggatagctttctttctcaacatcaactaacacatctcctaggtgtccttaaagtttcaacctataaatattctacctcattaagcataaggaccagccatggacatatgccgctagtgtccactttccttcagagatttagggtgatgagaagataaagggtctgcttaccagatggagcttgtcagattagcaattggagcagagtaaatatcgctgtcatattgttgttttgaagcacaaagaaccccttttgtataacgcatgtgcatatttaatagtttaaaacaaaaaaagctcagcagaaggttggctggtcgttgtacctctagcagagtggccattgcctgaaggcacggtgctgttttcctcataatagggaacattagcaaccagtggcttgagaaaggcagagtcaaatatgtctcttggggcccagtcggccacatgaagtgagagccgttagacgcagcaatgagattactgctccagaaagggtttgccacatatattactgcagaggcttttcagggctgccagcgcactcaacttacaaatgtcaaacatgatttaaaaggttattatactatcaagagggaaggagaatgattttccatcactgaaatttctatttcattctgtggcacataccgcatctcacgaaggccaatattgctaaataacctgcttttatctttaataagtgttttatggaccttaaattggaagaaccatttccactttatttgtattagaaaatttgatcttttctggttgaataacagcatgagagatacagtgtgtgtatctgtgtattgtgcttagcagattgttctttgaggggagtaaatttgtctgtgacgtgtcagttagggagagcgtacatacgtaagctgtagttttgataaatgcatttgtaagtctgcagtattttaagctaaaaatgaccaggtgcagttctctgtactgcattacttatttctctttgggctttattgtgactggtatttaaaacaacctgctttcaacctctctgacccctttgggaatatttatttgctcaataaggactctatttgttggcctcaatgagttaatttaagtacaattgtatttgaaaagttgctcaataaaagcagaagacgatttttcttttattttagggagattttcactcttgttttgtaacatttgaaaaataaataatcttcaagtgtggctgttaaaatgtgcaataaacaccttattgtcaatgtggaatttttaaacattgcctttgcagtcataaaagaggccaaaacaagggatttcaactgcccttttggtagcattcttcactctatttcctagcaaatcactgatggctttttctgagggtgagactgtaaaactgaaggttgcctacatttccaggtcccagaatgtgccatgcacagcaatacatcagcaatctaagctgacacatttgaggatggtgttctcaggtgggatgtaaaaaggacagaaggatacagtctatggtgttgagatattgtctgttccccctttatctgagactctgaagcattaaattaaaatctgtgaattcgcccatgttcacatgggcattgtcaaaattaaattaaagcttatggaaggaaaccttctcagcctgaagagtagcacctttcctccaagttctgcaccgattttgtcatttgccaaagtgcaagtcacaacaaaaggaaaagaaaacaaaccaaaaaaatctttgaattttgaaaaataatcagacttctttcatgggacaatagcactaaaaatttaaatttattcgacgttctccagatggagtatgaaattagctttctaacatttgaacaagagtgaacctgaatatctacataaggattaatatgtatgtctgtctgtgcccttttattcttttgaagactttctgtaatatatactgatttcaggtagcttctttattgttatataaacaaaaataacaaatctagagacacaaaaatatttccagtttaggaaataattagaacattctatttttcccccttcttttaaaaagtaacaatagaaagaaaaatcacttaaatattgaatgataataaatatgttttatcttagttttgaaatttgatgaaatagtaaattcattataataatgtattcatatattcagtaaccaatgacatatttatgtaagtcttgaatgttttaataatcctatttaaaaattttgaaacattattttttctaattggattaaaaactcccttttacaaatctctcacatggtttcttgtaattgaaaactcttatagtacatatgaaatacaattctattaataaaatatgcattcatatacacctttttaaagcattcaattatttgggcaaagcaacgcaaatgtataaactcaaagatataaactatgatggttaatttgatgaaatatatctcacattaaactgtaaaatgaaacaaaagtgtttcttctatagtaaaatcttagcttctcttaaaataaacacacatttttaaaaatcctgtgtgaccctgtcttaaagaggtaagttcactaatagaccagtgaactattttctagaaaccaaattcaattttgaattaaaatcatggtctaaaaagatggagacatataccacatagcataagtttctaaaacttatgtcagtccatatatgggagaaagttatctttctactatgattctacaataaaaatattcatttatatctcacaacttagtaaataaatcagaggaatgtttaatcttagaatggctgcagtgaactggacaatcattcaccccaacatttttttctagaattcttaaattgaaaattaaatgtcatgctaatagtgtttcgcttcctttagaaacaaaatcattgtttacaaaaggcactctctttgcatctgacaatacgcaatttcatttttcattctagttatccttaaaaaatttaataatgcattcttgccacctctttcccaatgccaaaatagataccttgtcaccttaaaatatttcacagaacaattacagcctttaacatgcagaacatagctgtctgagaaatagggcactttctggtgcttgtgatatataaacttcattggataagaaatcaagtgcctcctacatgcatcctggcctcgttaatttatgttgatggctggtatgaaaaagatagggaggtggcaaactggtgagttgtctctgaccaaaaagaattatttattttgttggaacaatgtaacctaacactaatattactttttatttaatattggaaaattatacattagataatgttttctagaaattaagctagctattttaaagtagagtttaccatcttggctaagggattgcaaacataaaagcatacaggggtgaagtgaatcaagtcaaagtgaatggctgcagtgaactggacaatctaagctatcaccaaggacatgtttctttcaacagtctactgacagccttccccagggctcccattgctggcttcttcacgaaggcctgccattctttatactacttatcaggctttttgaaaaagcaggggtgggggcaaggtgcggtagctcacacctgtaatcccagcactttgggaggctgaggctggtggatcaattgaggtcaggagttcaataccagcctggccaacatagcaaaacaccatctctactgaaaatagaaaaattagctgagcatggtggcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgggctgagatcgcaccactgcactccagcctgagcaacagaatgaaacttgtctcaaaaaaagaaaaaaaaagtaggagtagggatgtttttgtcaaatctaggaaatgtgaaatttcttctagaaaccacctgaattatattaaaaatattgacaatatatgagtttttaccttgatgaaaggagatatttctttttttttttttttactaaattgcttttatacaaagtctacaaattaaatctgcatataaggagagttaaatttaaatattaattttaagatttttggaaaatgcggcaatcgttcttttcatgtgagagataacaagtctaagccagatatttagtcatgttctatgtaggcaggaagatctcatctggattccctggccttcttggcattctgactcacaatgtcttcatcagttttctagtgatagatgaataaaagcataataaaagataaaccaagggcatcgtcaggtgttcaggggagcctaggcattagtctaggtgggagaaagaacctagacttcctaagtggcctgggactcccaacgttgtgtcagtgacgctggatatatccaaatagactgataggagagccctggcaggagaaacagaggagcatggatgctggatactagacatcaatactaaaatatatgttgaaaaatttaaatagtaccagttctgaacattcttgtggtttcataactttatagagctatgatatatactaaagataatcgccacttatcatcttcagtgaaacgagtggggccagggattttcatagctttccaaaatctaaaatgcctctattgtgcacagaatttgtaggttacttggacatactgtatttctctcagattctaactaattcttagagaattgtatttctctcagattctaacttgtacttagagaagttaaataactgactatatagatacatgtatagaaaatggttgatctgggatttaatccaaggtcaagattaagacttaaccaagattcagtcttgatccaaaacttttagtccaatattttctcgaccataaatcaagaggttaaatgaacattggattctaattctgactctactaatgatgggcataggtacccatattatagggctgagattcggctatttattgtttttttttttttttgctttattttgttttgttttaatcccaagtaatttcaatttatagctaggattgagaaccactggcttaaaatctaagaaaacttaatttattttccttttcctttactttcatatatattctaataaatgccagttgttactaagctttacatatatatactcacaatacataaatacgtaaatacataattcacagaaataagtttatgtgcttaattatccatctcaaaagcagatttagaggatttaggagaaatgcagcatgtgataccaattacaagaagaaatgggaaatattcttttgtagttggttgttcctaaattctggtgttttcatctggagggactgaagagaacttctatccattgattatctatgatgtgccttcatgcttatggagagatttattcattcagattctcctggaagaagccactgtgtgataatgaaagtctcataattagggttgccaagtttagtacataaaaatacttgtattaaatgtgtttatctggtaacactactactaagagcttggctctcaaattcatctctggtccaggtttttagctctcttcccagatgagtcatggcaactgccctgtctgcaaaggcaaaacatcatccttctcttctttagagacactgacctagctgaaatgtttctctggacaatccaagaggaatcaaacatttacatcagcaagaaccacatttgtgtctgtgatactgttgaagggtccatagagagataactgatttttaaagcagtggtacttgtaaaacagcaacagtaaggcttaaaataaattaatgccaaaagtgatttccttcattccttaatgtaaaatcttcctgcatgtaattcatagtaactgaaaatggaaagtaagtggtagttagacagtagctcttttttccattaaaaaagtttaaaagcttcaagtttgttttctatgtacggtctaacatggccatgcagatattcttcattcaaagttagatcccctcctagggtttcagtgactgaaagaggaaaatttcctcttattttacgtttcctttaatggatcacgtatcaaattttatgtacacataaactcaaattaagagcccgtttattgcgaaattgtccttaaaaagctaaatctaacattggtaaaatttagtccctatttgtagcctgatggtatctaaaaaaaagttttgggtaaaagtaaatctctacaccttcaaattgaatgttgcagccaattgagaacctatgagaaattaaattgagaaagatgtttttgaagacccatttcgggagaaatgaattcctgtgtcttgagaactctaaagcagataagaaagcaaggcaatggatctaattctgtttggagcataaaattcctgaaattgaggatatataagaaaagattgatcttgtgtctatttgtcttgaagttcagttcaaatctggttctggagaaaaagaaagatattaatttccagacagagcaattgtgtctttcagaaaaattgtgcatttcttcccaattgagatgtctcaaaattaaatggtatggtgcaaagcttcattatcttgtttctcttaagattcaagccttttttttcagaacagttatccaatatcctaatagatgaaacataatttagaacaaccctgtattataagacccagatttaccaatacaatatctatttaaatatagaattactatttaatatagaattcagtgtggatagtagttttgagctttaagtgaaaaaaaaaaaataaaagaacagaaactccataatggattaggtctaatacagccttttggtcatgagtgaagaggctaatgtaatatgagcactcatgagtaatcagatgtcttctgatgagtgaattgaaatgtcatagcagaagtaatccactatacattttattatgaatttttgtgggtaggtttaaatttattttctggctcatttaatttatttaatcaaaacaaaatctaagatgcatggaaaaatcaattttggtaataagagatttaccccaatatatttattcatttctaatgttttctttttctcattagttgactgggttataatttttgcttgtcattctttatagctttgtttctggtttttgctaaaggccacaaaactacatacatcaggtatttccaataatattgtactattgtatgtgcaccggaaatatcccggtgctttcggtagctccaatcaaatatgtcttatacatgatttgtcagattccacagataaactgtatatttgcaaaactggattttagaagatttagtcaattagaaatatatgtggctatgtaattggcttctattgttttgctcttaactcatctaagatctaatgctaagttcatcatatcatcatgatctttggtgagaatgtaattgctgaaaatgttttgaaaccactgggtcagtgattaagaacgaaagggattcagcgttaaatcaaagttcccatacgacagtcatcttgattcacaggaaatggggattgaactgggttcacttgaaaagtactgaacctcttaacttctcagggttcttgttgtatgttagtaggatatgctttaatgtggatcactaatctctttttcataatcatttgtttctaataaacaactgtctcattctttcgtcttttcatacatcactcaaaacaaatgactcagggccgggcgcagtgggtcacgcctgtaatcccaacactttgagaggccgaggtgggcagatcacttgaggtcaggagttggagactagacagaccaacaagatgaaaccccgtctctactaaaaatataaagatagctggatgtgacggtgcatacctgtaatcccagctactggggaggctgaggcaggagaactgcttgaacctgggaggcggaggttgcagtgagctgagatcaccccattgcactccagcctcggcgacacagcgagattacatctcaaaaaagaaaaaaaaatgattcagaaaattttaaaattttttaagtttttatccttcttgagcatatatatgtgacagccaggggaattccagatgtttttcagcttatttttatgtctgacaccagatactacataaataaaaacagttagaagttttgtttattgagtatttttgtgattacatatctagacaactttcaaaacaaccagtcagtggtttcaagtatgctttcatctccatcttgtatcatatcattcatatattgttggcaaatgatgagttttacctgtattatttggaagcattttatgaagccagttttagaagttcatttaaagaaacagaaaagctcatatgcctgtctctaaccaaggacacaagagcaagtgaatgagggtgttttaatttttattttttgtcttacttttcaattcacacataaaccaatatggaagtagtactatctaatgtggaagatagaaacctatatatttttaaatatttttgagtgagtgtgactagacaagtcagatagtttatcattttcattcttaggccataaagatccctctggcaaactgaagagtttaatgactacatattttcttaaactttaactgtcttgagtgaagggtacacatagtttgcactattggtgagtgaaaatgtctaccttaagcaaagagaaaacagtcctcctctgccatgagagtgaatagagacatacatgtcagaattcaatatggcagctactcatggaaattattcagcacacacattttaaaaactcagaaatcttaattatcaccaaatctaaaaaatctgtgtcctttatttaccttttctgttggcttttagactcatgcttaatttcatagctgacagtgcaaagcttatcttcatttcttaaaatttctaattggaacccagcagttgcatccataaaagaaaatatttcttatgtggaaatggtgtagcctactccactttccatcagataaagattaggttaaacattaaaggaacaagataaagcataggtgtgcatttgctatttcaagtaccaatttctattttatcactcaggatgggttagagattctgtgttaataaacagtcccaaaagttcagtggtttttccatttaattttttaattgatacataacaattgtacatatttgtgaggtatataatgatgttttgatacatataatatgcagtaatcatatcagggtaattagcatatctatcatttcaaacattaatcatttctttgtgttgggaatattccgtatggtccttctaactatctgaaattatatattatattattgttaactatagtcatcttgtagtggtatagaatactagaacttattcctcatgtctagctgtaattctgtattctttcacaaatctcttcctatccctgctttccccaaccattcccagtctctagatcagtattttttttgttttgctttgttttgtgttttttggtttgtttgtttttaagatggagtttcgctcttgttgcccaggctggagtgcatggcgtgatctcggctcactgcaacctccgcctcttcgtttcaagcaattctcctacctcaacctcccgagtagttaggattacaggcatgcgccaccacgcccagctaattttgtatttttagtagagatggggtttctccacattgatcacgctggtctcgaactcccgacctcaggtgatctgcctacctcggcctcccaaagtgctgggattacaggtgtgagccaccgcccctggccaggatcagtgtttttaaaagcaatttatttttaaaaaaggtctaaggtctaccagtccttgggctacatgcctatttcatgttggctggggccttgctctggcataagtattgactttccttcagtatccagggtgaaggaatgttgacactctggtgatagtggctgagggaaaggagagttctggaagcttttgtatcaacataaatccctcagcccgtagtaatgcatgccatattctgttacaactcataggccacaacaagtcacatgccacacataaccacaaagaagtcagaaggcaatctagctatgtttctggaaggaggggaccaccacaaacattcggcaagcaccaataatgattatccatatactacctgcaaatctaaaaccccaatttaggttccattgctaccaatcttacttagtctacatgctgacttaactccatattttaagtattgactttttaaagaattgcatccagcatttggccttattctttaagcagagttatcttttatgtgttattgatgtgtttttcttttaaggtgttttgtcttaagtcaaaacaaactctagtgaatatgtcattagttactaagcctaataattataacattgattcaacaggattaaaatttatgcatgagattctgctatcaggtttttcagggagatgttctgtgactccaagacttacagtttctgtgttttgcatgtcattttacaaatataccagagaatagactgtgagtcatagaattctaacatcatagggttgacagggaagtgttaaaaaatatatcatctatttcttatattttgacaagattgtacacaaggcattatatatcaagccattgaggatgggagggcagacagagaaaattatttcccaaaattgtttcattcaattcatcatagagcaaggttgtcccatataactgctgtagggaatgtgggtagggtttgtcttgtgaaaaataaacttatttttggccttctttttgcttaaatttcagtagcatgttttctctttacaacaattttcaaatgaatctacttggaagtttcgtatttatctcattagcaaaattagtattgtgtaagttcataaatattctgaataataataaaaatgaaaataaaacaatgtggtatagggagaagaaagctggatcacattactgtgatccctgaagtgccttaatgtcttcaaagcctcagtttccttctccgtacaatggaggaaacaaaataaaccttttgcaaattaataatatgaacttggaactacacaaaggtcttatttgcagaacagtcttagaataactacataaatagaagcatggtaagtgtaactgtacataaacaagcacacaattttaaatggaaattaaattttattattcagaccacattgattttatctgatcaatctactctcacatatttgagttacaaggtctgagggtgaatggtattgtgtgatgaattccaacaagtctgggctttacttaatcaaattttacagcattggaccaaacagtaaatgctggtgaagttgattcctttgtctctccttaactttgagacacttaatcaaataaaatcataaaatttaaaagctagaagtgactttgaattcatatcctctaatcctttcactcacattttttaaaactgggctgttatcagttaggaattttattcaactgctagtgaaagatttttgaaagttaatgctgtatacaaattataaatatatacctccaatgtttttgcaagtttcttggccttccctacgtaattggctacatggatggcaaggtttgcacagcgtcttatttttagaataataagagtgacattcaacaaagaaagctgatttaaaaaagaaagaaaagaatgataaaaggcaaaagggtaagtggctgataagtttgtctcgtcttaaaaagagccagggttttttgcttgtaacttattgcccagcattttttttttgaggtttcaatattttattcaagtttctgtaagtgatgttaattacagcatttgaaggggaggatataattccacacaaaatggaagactttaaaatgtacccattaaactgctaaaaaacaaattgagtgatgagaatacaaaagaagtccaatttagattctgagtgttgtcaccatgtgattacaatcacgcagactcttccaagcttatagctggagctcctggaagctatttcttactctggtgcaaggacaaaaaaacacaatacaggaaggaataagtcctgaattattggcttcatcacatccaccttctccaccccaaaatggcacggaagaaacagtgaccacaccctgcagaccatttggtgtaaaagaggtgacgacgatgaactgcggtgggaacaggtcatgaagatctgtataaaaaagtctcattcagatgagtttgtaacactgtcaagcagtgagcctctcatcagttagggttaggaaaccaaggttcgattctcaggaaatcacagtttcattaatttactcaatatgaatttacaaagtgcctacatattaccagctaccacttgaaggcatttctagataaaaaagaaacttggcatctcacaggggctaccgagttccccccaagtctactactgaaaggatcttttttggaaatgggtttcttctgtacctctgaaagggtaacatcttaaagcagaatcatctttaaccttgaggtctaacatatttagcaatacttgcatcccagtcatacaatattaaaaggtacactaaattctgaaggtagctatgctgcaaaatagtttaaattaaacaattgtatggtattcattcatgcttgaaatttcagtcctagaccaagcttgtggccaccagccttgacgttcttgccatccaggagagctgacagtgtcagtttgatacctggctgcagggtctgagtgtatcctaaacctatcaggctggagttgttcactttagtggagaagcaggcatgagggtcagtctgatacttggctgctgttccgaagcgcgtgttactgtttcctgctgtccagacgagattgacagcggtctccaacttcttgttcaccttctggtaaatggagccgccaaactctgtcccgtcattcacagtagtgtgaagctggaattcatcagtcctgtagccaactgcaaagttgctctgggtcactcaggaaggactttgcagtctcaaaacgcatctggtacccagccagccagccctgtaacccggcactagagcaccccggatggaaggcccagcagtgtggaaatccacgtcacagcccaggttaatgtgctcccacttgcaccctgtcttgattttagcattttttttttcccagtgttaggtgacgaggatgaatgcaaggtcagcctcaggccacgtgcaagctgaccgtccacgctcatctcggtgcctagtgtattgtcggggttccatttctccgtagacctcgagccatagtcagtccatcggtacctggtttccagactgcccgtcactttggtggtctcagtgttggctgagcctgagcttgtaaactccgatccatcctcagatttcgttttcaaatcaagctttattaagccaatccatagcccttggtgaagacatccctagcagatttgccaagatcggcatacgtgggtggcacagccgtcttctgctcaaaggtggcggcgggctctgcgggggctgctggttgctgctggggggctgctgggggggctgctggggggctactagggggctgctaggggtgctgctggggggctgctaggggggctgctgggggggctgctggggggctgctggggggctgctaggggcgctgctggggggctgctaggggggctgctgggggggctgctggggggctgctggggggctgctagggggctgctggggggctgctgggggggctgctggggggctgctggggggctgctaggggcgctgctggggggctgctaggggggctgcggcgccaaggcagggagttgcccaacattttaatataaggctccacattgcgaagaaggtggggtgatttattttattttatgttatttatttattttattttatttcattttattttaattttattatttttttgagacagggtcttgctctgtcgcccaggctggagtatagtggcatagtctcggctcactgcaacctccgcctcccgagttcaagcgattatcgtgtctcagtctcctgagtagctagaatcacaggcacctgctatttttgtatttttagtagagatggggtttcgccatgttggcccggctggtcttgaactgctgacctcgggcgatccgcccacctcagtctcccaaagtactgggattacaggcgtgagccaccacgcccagctagtaatgtagttttatgactgatcaccttatgtactcttccaattctcaacttctattaataaaaaataaaagaatatagataatgcattagaaacatctgctgcagggaactgttttaccattacagataacgttatgaatacaagtatttctgttatttatatttgccattatgtctgttctggaatattatcaaaccagaattataactagcaagagactatataaattaaaatcacacattttaaagtaaaactgaagttggttcaaactaggactccaccacttgagcaaactacttagcacaaattacttaaacctcgatgttctcatctataaaataaggggtttacaaggtcaactactaaattagataatacatgtaaagtgaaatgcctaaatacaatgcctaggatacagtaattgccctgtaagttgtaagtgctaccatgaaccagccaatgatctctactacatactatgattgagaaattaaagatggttgaaattttatataaatcgatgtcaaggtaatattatttatgaagttattgtacttcaggtcatcatgattgctttagtgcatttgagactcttttcttagatgacaatggttctaatccatcttctatcaaagtctctatttctccatttaaatctggcagatccgtcttctagagacatgaccaagtcaatgattttgattagtctgtgctccttacccaatattacaatacctggaaagtaattatgtttctatttttcattttaatctgctcttaccatattgacaatatgggcaatggctaagtccattatgagtttaattgctttatgtgccaggtgttcggaagttcattctttgaatctaatgaaagtaaaagataaagtcacagaactctggttcattttatgcatacattattctaactttggataaagaattaatcattcttttacatcctgtattgtttaatgtctcccttgcccagaaataaggatttttatcacagtgacttcagtcactgatgaggcatacatacagaaatctcctgttaagtaagattagaatttgtctttgggcctttttaaagtttctgcaaactgataacccaattgctcatgctgattgacagaacaacattgaatatctaagtagtctaggcctttgtctggtcattagaatttgtccttttgaggaccattggctggaaactttatactacaattgagtgtgctatgagtaagacagcttcaattgaagcctctgaagaggaaaggaaaataacaaagaagacgcttttgtatctttttccattatcaataacgtcaatatagaacatgccttttttcatatgaaacttcaatatgaacttattcaaatgacactctggctatgtcataatgtctgcattctccaggtatatatgaaacagattttaatggatgttgggtggcttccattcaccctttcatatttgaaaatgcacttagaaactctgttgagaaagttgcttatgctattggtcctccttttctgttgttgttcagtctgcccccaagtggtagagagcctaaaaacccaaaaagataacaacgtggtcaatccatgacttatcagctgcaattgtatgcctgattgatttttgttgctatacaacagctgaacaattcgaaatttatcacatggaatatgaattcacctgttcaaatcatggtagtataataattcttgaaattgcagctgcatattttaattcattacaccaagtaaataaacttcaagacattcagccaccattcatgaaatagatttctaaaggcttatgtggggatcattttctttctcttaccctctaccctcttgttttaaaactcctctccccaccatggccttatactggaagacatttttactcttgatttctagcaattgctggctggtattgttgagttttaatatttcagtgtgattcagagctctgaccattttcaagttcttaggagccctctcttgtctcatttttaaacatggcctttggggaatgacagtgattgtgacagatggtaaaggaataagattgcactttggcgctgcttctgtctttgcctcttgatcttttcccactttctcaaggcaaattatagatttccttttgcctctagagggacgcaaattgcagttgccagttatatggttctttgtttctctttctagctcttaaaaaaaaaaagaagggctcttatttaattaaacattgtcattacatttattgttgatgaaaggtactgatttgtatgttggccaaatatctgaccagacaagggagaggacttgttgaactacaggcaaaaaaagaaaaagaaaaaagaaaaaaaacttttgttgcgtttgaaggtagcttccctctagtggcaaaaactggtacttcacttgtagactacaagcgatttaaaaaaatatattttttgttatctctttttaaaacattatctgatatgtgtaatgtacatatcacacattttaatgaatgtggcttgcaactaaaatcgagtttcctaaaaagtttagaaatcttttcagttaccaaattcataatcttaggtatgcaaagtaggcaaggtactttactgtccattttgttcttcagtaatcccacacatacaacacacaattccagatgaaaggattctagttgactaagaagatagttaataaaggggttttagatttttttcataatttattgggtcggagttaactcaagcggttacctcctcatgccggactttctatctgtccataatttatcaaaggagtgtgaaggaattataaagtatcgcataaatttgggtggtgggcatattgctgtacttctctgtgtattagaaatattttaggctgggcacagtggctcatgcctttaaacccagcactttaagaggtcaaggtgggaggattacttgagcctgggagttcaagatccgcctgggcaacacagggagaccccatctccacaaaatattaagaaattagccgagcatgatggcacacacctgtggttccagctgcttgggcggttgagataggaagatcacttgagcccaggagttcgaagctgcagtgagctgtgattatgccacttcactctccagcctgagtgacagagagagagaccctgtctcaaaagaagaaaaaaagaaaaaagaaaagtttgatactggaaaaattttagagagaggcgatagaatcactagatagttaaaatttaagtattagaatttaaagggcactagagattagttgagtgttacagttttaacttgaacttattcgttcacattcatgtaaccactacaaaaggatttaagcaatgccaagaatgagctataatttagacaatgtgcaggaaatacaaggacaactaagacgggcaagcggcaagtgaaccgagaactgtgcaaagagatgagtactaatggaaatatgtacaacaaactaagagagtacaccaaggacaaagtggccctttgtttgagacggatgaaaggacagttaagtacagaagataagtgtaaatgatcaagagtttgggcacagtgcacgggtattttccatgcacatagcaccatgggaagtggttctgagcaatcaggagataacagggcttcaagtatggaaggcttaaatggagagagctgagggagacttgttgttaataactttgctagagcaagtcctaagcaggcactgttttataccataataaataatcaaatgagagaatatgaggtttggttccccaggctccacacgtgactatgaataatcttataaataatagacttattcacaaaacacaagatagtctagaataaccgaatgaaatgatgtttttgtgcttctttgacttcctaccaaacatagtgttccttggaaggaattatgtttgacactgtattgtatgactggaaaaaaatctataatgaagaggtgctcacatatgaagtagcactgagaaagttcgcttcaacagaggtctggtgatgggagaattaagcataatcaaaagttctagttgcattctgaagtcaatttcaagttgtcagtcctaattgggagtggggtttgtctaacataatgcttaagacattttttggtggcaaaatttctcaatttaaaggaacatgatacaagctcagaaaaaatgcagcaaattgatgactaagacctaggtaatctgtaagtaaggaaatgggatgtcaggagagaaattgacatttgtttagataatatccacacttggttggatggactatattttatagatattttcattcttgaatattttagtttctaagatctttattatgaaacaagaacataggtctaatatatatgttatatgtttatttatatataatatattatattatacatatgtattataatatattatgtaatatattatattatacatatgtattataatatattatgtaatatattatattatacatatgtattataatatattatgtaatatattatattatacatatattatgtattataatatattatatattatggataatataatatattatattatattatggataatataatatattatattatattatggataatataatatattatattatattatggataatataatatattatattatattatggataatataatatattatattatattatggataatataatatattatgtatgttaatactatgtaacatatatattacaattataaaaaaagtgtatgtaattacttgtatcaaatagtgttttatctgactccctccatgtccataaacatatttcccacactgactatcacccatgttccctcctacctttacatactcaaggatttccaactgcccaggactatgaccttcatgtcccaagcacattaaccctcctttggcaatactcacctgctgttgacttttcatacttgctctcctgagttgagacttaattgtatctctcaagaccctgatatcaggtataagatgagatcaagtttataatctaagaagctcctccatgctaatagaataacacatttgcattttgacctgttctttcttccaaaattaatcaagaaaaagagcttttctgtagaacatgggctatttgagaaaatgtgtatcaaatgagtttgtcatcatttaatcacaccaagtgcatgcctttggactctatttgtgtatagagctaaaccaatatttgataaatgtttgcaatactgataacaaatttcttagataaatgggcaatgttattcttgtcttttaaagatgaaactcctgaaaatgattacaaagcccattgcttcatcacacacagacacatccacacaaacacaccatacacacacacacaattttcaagctttgaaaggctcatgtgtaagacaaagggtattttcagtaggcttggaaatcacttggcatttttgagatttgccaaacagcttgagatatttaaaaatatttttgttcaaccaaattccaaacatgtttttctgagtactttttttaggtcaatttttataaccatgtgtaatttcaagaaaatttaacccatatgtttgtttctgttagtgtatattcagattgatttataacacagatgtaagtatttctcttaacactggtatatgaagagggtgagagggtctcccaatttgctgcttgggacagtccacagtgagactttagattaatggtcacagactataacccagttctaatctcaacacagtctccatgataaaagtcacaggggactggctataagtgtcagcaaaagatcagatccagttactgcagtatgttgatgaatatgtgtgttcctagcatggactcaaaagatggaactctgactgatgactgtacagcactgtgagaatgaagcccttaagtgctactaaaaggtctttaccaactgtgatgaaaaactgcatctgtgagtaatgctacttactggcaaaataggactgtgacctgccaacatattccattattttttgtggcatcgagtataaaagtagacccgttgtccagttgtagggaaagtagaaacacaagtcaaaatactaccatacttcataggccgggcgccgtggctcacgcctgtaatcccagcactttgggaggccgaggcgggcggatcacgaggtcaggagatcgagactatcctggctaacacggtgaaaccccatctctactaaaaatacaaaaaaattagccgggtgcagtggtgagcgcctgtagtcccccagctactcgggaggctgaggcaggagaatggcgtgaacctgggaggcggagcttgcagtgagccgagatcgcgccactgcactccagcctaggcgacagagagagactccgtctcaaaaagaaaaaaaaaaaaaaaaagctaccatactttacagggatagcaaaaatgaatttttaaactagcgcgtgtttcctgtaattcttaaaattaaacagaaatagaaaaactctaacaagaacctcagattcagccaatgtgccaccttagaagtgatattctctccatagccaagatgctgtaggtaggaatgaataataacaggatgtcagagtaagtgccaagtggaaggaaattaaagtatagttatgatgtaagggggcagacataggtaattttaaaaacaacaatattttagaaataagaaatgattcataagtattgcttgtgaatgcaaaccaaaagtcagataccacatgcataatgaagtgtgactctatccaaatacttacaacattttcagggaaaaaaatatattctctgatcctgaatgttgtgcctacagaggaaagaaaatgaacctgtttactagagggagaaatctcagtgactgaagaagtcaaacaactttttgaactctgagagccaccttagctgttctgcttcagggttttgggcaacataacatctttatgaatgttaccttatagaacgttagttataccagagcagacgcaactggggatttgacaactctgccacactttgactggactgacatttccttagcagtaacaagctgctgctgtctggtgccatgggggccctgggcttgatttagtagcactgacattgactgcttgttatttcatatcttagagctgtcaggaggcaactgatgtcagcataaaattatttgatagctctgcatcttgggcaaaatgtgaatctattgatgttataaaatggccatcaaattcttggaattagggggtggagataatggagaaagaaaactcacctggtttattgttaagtaatcttttgtttaaaatttggttcacataaatatgaactgtaactatctattaggcacatactggttgtactcattaaactacatgctcatccaattctaacagtttcagaggataaatagtattattttgatcctcatttgacagtacagattatactcctggaagatggaaaagctgggacgcaaatgcaaacaatctggttccaagatccgtgctttcaccttgagttacatggtttttcccatggaattgaagatcctagattcatagaattctttccttgagctgccattgatttttttctttagttttaattttagaaaacatttgctcattttattgagggaaaatagcaattagcaccttgtgtgatctgataaatactcactgaatgaaaaatggaactttttatcatcctcatagcttttctggagtaaccgtgtatccaatggaatgattccagtcgtaaatggagttggtcaaagactaattctctcattacaatacttactttaacacagtatttgagaacactttgaaaatgtgaggagtagtgagtaaatgtggggaattttgtgattaataatctcagtagtaaagactattagaagctcagaagctctcacaaaatatgcaagaaatacttatcaaatttatgaattgtatctcagtttaccactctgttgatcaaatcacttatttttaaacatagtgatcttcaaatatagccatttctaaggaatgcatttgcttctttctgaaaatcacctgacaaccccaaatcatttccatttatattttgtatatccattgatcttgttttgtgttgtttaaaagtataatcttttatgttttttgattaacttgaacaatgacagatcacaatttaatttctagaatgtgtctttgtatgtgaatgcgtttctttttttcaaacaaatcacaaaggtctgggggaattgtgattctctaattcgagctcagtatataccagttgaaagcatttagttgtgattaaaacagattgaaggagataatccctctgagaaagcagcttcaaatagcttagcagcgcttcttcagggataagaactaacacaacacaagctaattcctccaaagtctccctggtggagctgtggacgtacctttcatttgttgtttttcttccttactgcgttctatttgaattcctcttaaatatgaattctgctttaataacactttactcattttgttttccaagaaccaacatttaaccttttgtgttaactgatacagggagatacacttcatataatattaataaatgaagagtgtgcaggcagttctcaatttacaattgaatgatattataaaagttcataggtaagtcatagacaatttagaactcgggatagaatttatcatagaaatgttgttctatataaaatttggtttcttggttaacccttcaaagcctattgaactctcaatgtagccgaatataccttatgtaactagtacaagttctgcatagcggcagttctatgagaatacttctaaccaatgttctggattcaatatcgggaagaaaaaacgccttttccttgggagtgccttcaaatttatttcgttcacagtgtatgtcatttcgagggtcggagaaactgacaggtctgtatcttctgggagtagtgtgctggagatgggagaaagagaaagaactagataaataacaaattgtagggtgagattttcttcattttcctattcgcttggatatgctgtaactccattttacaatttaagaccatgcccttgaaaaccggacccattattggagaagggatgagtaaagtgcatatatggaccccaactattaaaggctaagaaaagaaaaatggaagcaaatgcccaatgacaataggcaaagaagttatgactccttcagccaagcccaactgaagatagaagtggtacagatctcatgttcctggatattagacacatatggagcaatgaaatttcaaaaactatgttgacccttaactatctgtattaaaaaacattgaagatttaatggccaggtgtcgtggctcatgcctgtaatcccagcactttgggaggccgaggtgggtcgatcacctgaggtcaggagtttgagactagcctggacaacaatggcgaaaccccgtctctactaaaaatacaaaaaatagccaggcatggtgatatgcacctgtaattccagctacttgggaggctgaggcatgagaatcgcttgaacctgggagacggagacagaggcagaggttgcagtgagtggagatcgcaccactgccttccagcctgggtgacagtgtgagaccgtatctcaaaaaaaaaaaaaaaaaagaaaagaaaaaaaaaggaacattagaaatgttcctgtttactcacccgcttttccttccccacttcccccacacccctctgcccccatcacttcctcttccctcccaaaattgctttaaggattttcctttctgctgcgcccatgatgcagtgatggtgagccacacagtacattactgtaagtccctgttgagttgaggaattaaccaaatgctaccacagagtttattaataaagtttaggccaaattgtgaacggaattatattttaagacacagaacacagtttgctatgtaaagttttgtaagctggagcaacaatgcagaaactaatattctgtgaagagttcctagcaagccagaattaattgactaccagcgtctaaccaaacctaaagttctaatctagcttttatatacagatcacctgccagcacttcatcattttgtatatgctgtttgctatgctattatttggtgattgatctgctgtttaacttatagtaatgatgatggcctggcgttaacaataatggcatatgttaaaaatgtaagagagcatctcagcaataaaagagatagatatagttcagaaccttttcacattgcattgcccctgttaatgtttcacaacactttatactctgaaaaaataaaaataaaaaaaggaagtggcataaaaatagcatgtaaagtgttattcccacatgctgttcttggtctttggcatgcctgttatccccacattctccaaaaatgacaagaatgcatcccatctgatacatcctgtgaaaaatttaagagcatatttgaaaacacaaaatactgttttcataaactgctgaaatctgtgatagtttggcagtaatcacaggaacaatgctggaacacaacttttaattttttcttttccttgcgttctcttgtcaaactcagtgaacttccctgttctgtattgctttctgatgtgttgatccaagtctccctaaaacccacatgctaattcctgaacagagtttaacacttgacttttccccattaattaatagtccagtgttgatatcgatgtagtctttcttttgtggataaaaagaagcaatctgaagctaatttagcattgggaaaagtagtaacacagcttttaagaaaaagaggaatgaagcaatgggcaaaaccagctgtaagatcttctagacggatacgtgtggctacagttctatcaaggcaagaattggcagaactttggaaacttctgtttctatttttattcttttatactccttcagaatttaagagtcactccttgtctccatgacaaaacataacaaatgctgtttgttctagtgtttaggctaatgacataacgtgttaacccttggttacacagaataaccttcacattaagagtaatcctgcaccatttatgaaacataagcatcacacctggcagctttttgtcaataagcatatttaaaagaaattccaaaacaaagagttcagtgtagtgacagtgatactatagtgacttcttcagccatgttttgctggataattaattctccttaattctgattctctcctgccctgtgcctcacattgggtctatacttcccacagtgcttaggagatgtgcattcatccaatttgtacagtcagtctaaggattcaggcagactacataattcgttagaatacactgactgtgttgaccagattataacctgtctctgcttttggtgttatgtgagggcggcacaatgacagaaacaatggtagctaatacctatgtatgcttactgtatttggcacagattatctcatttagttctcacagtcccaagcttggagttataaaggaagaattcttggagatgatggaagctcaataaagccaaaaaacatgaacttcaccattagacagactcaaactaagttagtaatatttctacttttcctttttttcttttttaatataaattaaaccatttactcctctcctctaccctaaagtccaaatgtaatatatattaagggatatgatttgtcctgatttggtgtccatacaaattctctgtgtcagagaataacctagaacttggtatgctttatgattaataatctttcaatatgttgttaaagattttatttatacttgtggctgggcacagtagctcatgcctgtaatcccagcactttgggaggctgaagcaggtggatcacttgaggccaggaatttgagaccagtctggccaacatggcaaaaccttgtttctactaaaaatacaaaaattagtctggtgtggtggcacatgccggtaatcttagctactcaggaggctgacgcaggaggattgcttgaatctgggaggtggaggttgctttcagctaagatcacaccactgcactccagcctgggcaacagagtgatttatttaatctttattttctccaaaaagaaaataaagattatacttatacttgagtagcagtcagttataaatgagctgagagggtgaagtaaagaagcctgtatagacaaatgaacagagacagacttttgtgatgcgtctttaagggattattagaagatcattttggagtggacaactcaagaaagaaaactttggtgggaggttttacaaggtcttcaaggcaggcaaagaaatgtgggttttgatctgaccacattatatgcactttgcttatttatcgttgaggtatattactgaacactgtcttatcctatttcagtaataatctttgtttatttggtaaagtattatttttttaagggttagcaattctaagttccaccatgaagcagtcaagtgaaattgtttctcagtatttgattgacttgattcatccattttcaaagaaaaggtaaatcatatagtattctgtatgatgtagactgtgtcactcagagtgaaaaagttacctttgtcttctaccatttgagaatgtgctgttgaatttgcgaagaaaagagccctgaggcattaatcatacacattctccaatctagatttcaaaatgttcagtagatgtttagggtatgacagaagaatattaagcccgttaatacggtaattacagtgtttcttgcttccttgtaccctgaactgattaatacataaacaggactcaaaatataaactttatgtttagtgaaagtgccaatatctatgtctgaattcatcaatgccatcttaggaaccaggcaatatctgttcactgcctagtgccttagggagactgtttaatgaggagatgtgaagccttttacagtttattgttgatgacattttgaggacacttgcagtggggtagactgaaaaacaataaagctgggtattttcttggatatggtttatgtgccccagagtgttgtatcagattttatcagtaatcaaatttctacttgatagcaaaaacaaaaacaaaacctttttagaaacttaatttcatatattgaaggcaaagaaaaaaatacttgcaaatctgatatctgaattttcttaagattcaaagaatttcaatttttctacttattcagttgaattaaaggttactaccactgtttttacaagcttgaaaggcctatttatttacttatttatttatttatttatatattttgagatggagtctccctctgtcacctaggctggagtgcagtggcgcgatatgtcggctcactgcaacctccatcatccaggttcaagcgattctcctgcctcagcctcccgagtagctgggattacaggcacgtgccaccacgcccagctaatttttgtatttttagtagagacggggtttcaccatgttggtcaggctggtctcaaactcctgacctcaggtgacccacctgcctcggcctcccaaagtgctgggattacaggcgtgagccaacgcccccggcctgaaatgcctattttttaggttagatatggtagtgttataactgttgatatcctttgtagtctgtacttaaaaactctgaaatggcttgaggcagttccacagcaaaaattccatatgaatgtctattcagataacgattcttatattgtgtactatattaatatacgtaatgtatttttatgtctattgcctaatactttcaaaatgaaaagaaatggaacaatatatttttctcttgcctttgttttcattggaaccttttgtgaccaccttgtacttattaacatctgagactatggcacaacgctgtggtgaaatgtgagccatcagtccaggtgggctggtgttcgtgtgtcttcatgatcgggtctggtcctcagctctgtaggtacattttacagaggtagtattatggggtgtgtggttaaaagctctggaaatgcactttgtagacttgaatccgaccccatcaatttcttagtgtgtatagttatgtaactcatagttatgtatgtaatctcagtatgttgcataacttagtgtgacgcagttatataagttatgcacataacatagcataaataactacataacatacatacttgatataacatacataactgttatgtacataatgtatatttagtacataaaagttacataatagacatatttgtgtaattaggcattaattccaaaagatgtagtacatgtttgtacctgcttgggttatcattataataaaaacagataatgtttgtaaatactttagctctaatgtataacacaaaattaatagccagtattagttgctgctgttaatattaatgttagtactgtgtaatcatctgaaaagtgcttgctcaataccaggttaaaaacagagagcgctagagcgacttattacaaatttacccaggtaatagaaaacccggatgcgcttcctcactctaagcagaaaatgtgtctgtgatgatttgcccttctggaaccatttccagttggtattaagtgaaatctactaaattttgtatcctgggtttctcttctctatactttgtgcagatacctctgtctccctaaaaagaattatttgaccagatacaatgcatatgattatggttattctagcttaagccagtttattataatagatttagttgaagcttggttatattctggcgtcagtagttttattaaccatgaagaggttatagctttagatttgttgattcaaccatgcattcttaagatgatgtcgcagacaccttaattaaacctgggtgttcctaaatttcctcagacattactttcaccatatttctaacattacacttagaagggaagctttctgcttctatgtagtcgaaatggtaaagaatcctagattttcgttttattagattgattagaacagaatgcaagtatagaagcttttaagtgaaaagatctatgtgaataaaaatatatgcctatatttttgttacaaaccagtgatttaaattttaatgcatatgtttatgtagagaagtatgtttgctattataataaacaataaaaagccattgctcatgtgactcatgaaagcaaacctggcaatgactttttctcatatgtctgcagcctaccatcacatatgcctaaatttttacgaatgtgtgtccagtatattgttataaccatctgcaatcaaatgtgttatgcaaaacaaatacttaattggtataactaattctttgattcaataatgaagatcatcacattatgttatttagagtaattacttatagcttaggttgggatggacacttttcaggaagaaaatgtatactttgtttctcttttttctgaaatagggatggaaagggtattaactagcattaaaaagggcgaagcaacaagcttccctgattggagtgtaggtcccaagcattttactgataaattcattcagattgagtaagctctttaagctctttctttctttcttttttaagttaaagtcatactctaacacctattctcctgcccacaactatacctttgagtaaatgttcttaaaactaacaggtacttctctcctaatgcctaaatgaactcaaccaccatggagaagtgatagttttgattggtagatacaaagtgatcatttcagcattgtattaagctgtacgtggattaggtagtagccaaagaaacagggtggccagagattttgagggaacaaaggcagaacagaaagtgagaagaggccaaaacaatacatcagtcgtgtaaatctgccttgggcactgctgacctatataaagctgaatatcatcttcagtgacatcttcggtgtacctgtcctggattgcctgtgcttggcttcgggcactaattttctttcctcatacaatccaatccattaaacgtctgctatagtttttctggcctgaagagaaattttgtttgtttgcttgtttgtttcggcctagttccaggcccaggataagatgaagcaaacactgctttcattcattcatacatcacatatatgcttctcttcaaccttctcttccttgctctctgacatacacaggtacttctaaagctctgggatatcccttaccatatagcaaacttcctggcaggagcagaggcaatagctctctagtagtgcttggggtagtgacagatactttcaagactgacagaaaaaagaaaacacaagctctttttcaggaactgtatatatatatatagtgggtcttagtgagatacaaatctgccactaaggtaccacttattaggccttataattgagatttacttgtggacctgaaaactctgcacagtccataagagaatttcctgtattccctgcatagtaggagcaagacgattatctattgtaaggttatctatattattccatttgacatttttaagtctattgaagtaagtgagaaatgtggacctttgcaaagatactgattgcccaaactaaaagaagttaaaacttgaagtggtaatttagtgttctcttcaaaggttgtttaagtacacacattattaatatacacttagtttatgcttttgacatagcagatcagactttacacctggaaaaattgtaaagacaaaggttaagtttgggcatggtggctcacccctgtaatcccggcacttagggagattctttgaggacaggagtccgagaccagcctgatcaacatggtgaaaccttgtctctactaaaaatacagaaattagccgggcacgctgatgcatacttgtaatcccagctactccggaggctgaggcacgagaatcgcttgaacccgggaggtggaggttgcagtgaaccaatatcacatcaccgcactccagcctgggtgacagagggaaactccgtctcaaaacacgaacaaacaaaaaaagcagagatcaaaaaatatctgtatgttcatctatagccatagctgtacctatgttctttaacttaattatacaacaaacatgatagtatttagtttgccaaaatgtaaatattttccacttctattcactcacctaggctggcttctttacaatagaccccaagcccattcataattgacctatcccctacttgggtctgcatatgatcataaataacagctctcgctacgagtcattattaaacaggaagcattccaagtgttaggttattctctgattcggagtagccatcaagaaaaaggaagaaacatagaaaataatttatagtgatttatggaatggcaactgagcctaactgtatgttagataaggcaactttgattttaaagagctgacactacgatagaagagagagatatccaccaaagataagcaatgcaaccttgttaactgctaactgagtcagttaatgatgtcctaatggtttgatggggagaaaaacctcagaaattaaatgttgaaattgtcataatggaggtatatgcaaggtactgtaagaacaaaagagaagccttatgaacagccttttaaaagtagaatggactataaagttccagtaactctgtctgagaaagtcaagaatggcctcatagtgctggctttggagataggataatcaatgggcagaaatatgcctggtgaagaaaaaaggagataaaccaagggttctacttgcacaaatgcagtttttggagggcccctttggactttgtaggtgaataaagagccaggcttttgggtgcatggtgtacagagtatcacatcatggaaggtgagactgaatagtcagacagaaggcagagtgaaaaggacctctcaggttcagcaaaagattgtaacatttatccaacaagcaacacgaagtcaagaggggcctgtttgtctactagccttctttgtacctccctctccttccctttggaacttccttatttcatttttctgttcatcttccttttttctcctcctccttctgctcctcctcttcttccttttaacccatctctttctcctcttcctctttctttttttttttcttttgcttataaatgaaggatgatcctttcaatagtagtgtggtggatggactaggattgggaaagatgattagtgtattgaataattagaaattttagtaatacattatgagggaactaatgagggccttccataagaaagtagctgataaaagcagatacaaccttgtatggcaaagacaggcaaaatctctggttccctgcctaagcctggtgtaccacaccaacgcctgacaccaaacaggcagactgtgaagttttattatttgcaaacaaacacttgtgaataatgcgtagcttctattttgtgatgctgaatgaattggtgatgcctttcccaaggccaaaaacaaagcttgtgtaaaatagtagtgaggaaaaaaggaagacaagttccacttttgttttgctaaattcggtatatgtctccaggataaaataatgtctgtattcaacaaatatctggaaataaatacgagttctagaataagggaaagaaggaaaaaccatctacaagagatgaagtttcattgcaatttttataggacagatgatgtaaagggttggttttctgttaggaagaaattaattgttcactttctgaatgaacatcggcaatttctagctgttagaaagtgaagtcatatttctaaagaggcactgtcacagagatacatttggaagccttcaaatatctttttgttcttttaaaattagcattttggcttttccattcataaggcagccagtgatcagaaagtaatttctttcttctttggaaagaaaacctttgccctaagaaaaatggcatctcttcctcaagattagcccccaaaatattaaacttggggtaaagcagccaattctgttcatggttatgaccaaaaaagaaaatggagagtttattttcttaaaggctgctcaagttcaaaaatttgtgtttgatccctcaaaattcatttcatgttgaatatgttacctgaacttaagttgagtttacaatatttttcaaaaaatactataacaacaaaacatttattttgatataaaattatgtttcttatattgttactttattttatttgaacctaatagttaactcgcaaattgcatatcttgctcaaaaataagctatttctttaggcctacataaaacattaaatgagaacacgacaaaactaactgattctgggattacataaacatcccctaatcttaatattaaattcatttcttttaggaatacattgcaaaaattagggaagaaaggttttgaattactttccagtatgaaatagtaaggtcttttaaatgtatggataatcagtaaaatcattttattagtcatgtttctgcttccttggcagaaaacattccagcttgactccacaaaccagcataaccaagtttgttatagtaaataattaatctgtacgtattggttgatgtttcatttcagcatccttgaaacattccatggaactttcatatttccaataaacaacttcaatcagtaataatatgcttgggtaaaacaaagaaaatgtggttatttctttccaattataaagctaagttttagaaaacagacatcagagaaggggtaccacagatctatttttaatattcaatacaagttagagctcatattttattttggtccaggattaagaaaaaaatttgtttggagatagtattttacttcagcatttccacattgagtcttttctatttctcattgtttgtgatgcttttaaatcaagggcactttgttttttagctcacatctgctccccccttgttctggtcagactttcaacacgtagttgctctgagattgttcaggagatctcagacaggatcaccacgaccttacctgagagtggtcaaaaaaggagcagatgcgtgttgtgaagattaagcttatgtttatctgacaaatgaccttaaagataaaacgcagaaagcaaaactcacaaatgtggttgatgcagagcaacgagacaatgttgtggcaattatttttaaataacttattaaactttataaaatgaaaagatttttttaatggcaaacataggtctttaaggaaccacagagtgcagttattgaattaaaatattgacgtgaacatatttttcaaatatgcttcaaatggtaagtatctgccatcacaaatattcaatgtttttaaaaatgctaatatatttaggtataggtcaagaaaattactaggattaggtatttgctactagcaaagcaatgccatttttcctagctattgctttttctattgagtaaattattgaaataattgtttgagtttatattttactcatagttgaggctagaatagtaacgccagtgtattgatagagttgatttgtttttgaattatagatctgataatagaaacagccctagaggtgagtccctgatgacatctcaaaatggttgtttaattttccatattagaggagtattatgatagaacaacaaacagagctgctttcagacaagaaacatttcatttaaattattttctttttagttaatttctaatatatttctaatatacttaccttattttacaggagatgcggacattaagaaagcttttctttattttttgccaaatgataaaaaaattaacactctttttttaatcatagatatatatattccgtatggttgaagtagacacattgaggattagagttagaagttatttgcacttagccaggcaaatattgactgtaattaaatgagcaaagataatttgaatgtacagataatttcaaccaaagaagatgccaaactggtcaggtgataaagaaaagtgtggtgagcttgaaagttccaaatatttttcaccatcttcttcatataagaacacattttcagacttgaagttcagctttctcaaaaatatttgaaatactgttgatgtgctgaacaggaaatttcgatgcaacttgcatctgtggacaacatcagtgtccctaaaaatgcaagaaatgatcttggtcagtatagccttaaataatccatttaatgaaagaaaagttgttttgtttggttttctcaatctttgggtagccttttaaaatcatatcattttcagatctccaaaaagccattattatcatgtccctttcatagaactaaaacatacatctacagggaatgatgaccttctcatgaattagtggctttaggcattataatatatattttaaaaaaaaagagttggagtggctagcaaaaaacatgcagacatttcataggatttttttcccctttccacttcaatgcatttatttgaaaactgcttatttgcctgaatttgccctgctggcaaaatttttctaccagatagctactttttattgttgatgcacatcatgaatagcagctttatttgatggcaaatgagatgccccaagttgcaagctttccataaacatatctgaattgttcaatttccttctcattgtataatttccaccctggccctttgcctgctgatattccgataaagatttcattcaagtaattttcaaaactgtcctatgttctttgctatcataagtggtaagattgctcaattcgtattagctataacacaagtgctgcacaggttttttatcagatatttctaaaatcatttctttgtcatgaatggtaacgagaataataaaataatgcctccagttgggtttgcaaacactggtggtttactagcaatagaattagtagtaatatgaacgtgaaaagtcacttttctaaagaacatatcttaatgaattattttgtttctttttctttcatgtctcctaacatggatttgaaaattatgattgctgaatgattccaaatgacttgggcctttgtttctcaaataggtaagtgattcttgttctttggtgttcttaggagtccgtggttgtattttaaaataaatattcattgccagtttgcactgttgaattttctggcaaaatagggtaaaaattgaacataagacaaatcatcattttcagaaatataattcagatctttttcattagttggcacaggaaacagactaacaagaagacccagtttgagttgtacgtattcataggagccatatgttcaaaatcatttaagtcctttttgctggctagcttttgtattttaaagcagcttggtcatattttgcccatgaagttctaggtcacactagactagttactaatcataatactgtatgaattacccaggtataagaaagcatttcatatggcagccagtaatggcttgatacagaataattagctaacaattttcctgatctcaaagatactaggctgaaaaaaagtttagctttaggttctgtagtatcgtcacttgtagagctgggatcaacaagctagtctatgggccaaatctgaccaactatgagttaagaatattctttacatttttaatggctgacaaaaaatcaaaagaaaaataatatttcataatgtgtgaaaataatgtgaaattcaaattttggtgttcaaaagtattgttggaacgtagccatgcttatcactttacatattctctattgctgttttcataccacaattctatggcccatgaatcctaaaacatttacattctggcccttaacagaacaagtttgccgattccattgtttgagtactagcatataagaggttaattccccgaacctcttactttggagattctattagagcagaggtgaaatcattatatatctgaccttttcttagtcacaagggaatccaccatatctaaaatgaccaggtcagaacaaatggaagagcaaatcttgactgtagatttaagttttcctgaaatagtcttttacatagttatatttctcatacattttaagccctacaacattcaacccattaagtctaatgtattttactgccagcaagtctttgagcttgcccacagatattcagagtcccatagttgatgggaactggggaagtggcattttgtggctagtgaagcagcaacatgttgtataatgaaaagaaatatcctcaaacttttcaatagttctcaaggctctgtttcaccaaagagaatactaacattctatagagactgcctgttctgaattacatttgacagtgttggaaaagtgtaatactcatcactgtaatccagcttagcatctaaaacaacacaagtaagtacagttgtgctttgtggaatagattttgcagaatttttcagaggccatgtggaacatgagtggttatatgcatattctaattaaaaaaaaaactttaaaaataattataaatatattgtagttcttttcatgttggcatttatcagaaatagatgcatttgtagtttgagaaagaaagaaataaaagagaacaaagaaagcatattcttggaatattgcaagagagagcaatgtagaaattgctggatattaagaatatgcattaacttctaggtttaggccactgggaaataaagcttccgtgcgtgtatttgatgtataatgacaggcacaaagaaaaaggcaaacatactatagatattctagtatggtacaattatacagtatgtgttctaacccttttcatgaaaatttgacattactgcacctcagatagaagcagcaggaatcaccagggaaagaacagctggatgctttattaggttttatgttgtacataaggagaccatgttttccattgtcagtgtgtaaaagaaaatgaaagctctgggcatcattaaagtctcgaaagcgtaagatgtgtcagctccattctctcaacacctggattgaaagtgcagtgtggggtcaccgtaaaacaaaaacagaccgtcttctctggttggaattgcaagagttgatttttagaaataaaataattcataattgttgtagagagaattcttcctttataactagagagttgcatgtatgaacataaacttatatgtctacctgaagacattttctataaactgcgtctgaatatctttttcctgcaccttaaggggtgctaggaggcttcttggagtcagagagctagaagactccccatttgctgccactgtggtattgtccttttgatgaacatttctccctggcttttcatttgcctccttttgtggaaccatttttgttggcatcccccacccaacacacacattatattctcattgtgtcccttgttgcaagtacctttatgttggagaccgttttaccttatacctttatgtaatccacaaagcttagcactgtgttcctcttattgtggtttaaagtgctgtattagttggctcaggctagtgtaacagaataccacaggctggatggcgtaagccatggaaatctatttcctcaccgtcctggaggccgcaagcctgagattgaggtacaggcacggtcaggttctggtagggtctgtcttcctggcttgcagatagctccttttctctctgtcttcacatgacaaaggggataggtagatggagagagagagagagagagagagagagagaactttcttataagaccacaatcttattggataaggatgctgctcttatgacctcatttagccttaattattgcctaaagatcctatacagtcacattgggggttagggctttaacatataaattttgagagaatatagttcagtccagagcaagtacctttgacacaaattgagttacataagcagaagagaggactgaatttttctcttcatgaaaatttaagagctctttgcctataggctttggccacttctgttttctccaagagttgctcatattaaatctagtaaataataaaaatgcgtttcaaatattaaaagatgttctatgttctggcgctaatctctactcttaattatcttaaaaaacgtacaagaaatttactattgattttattaatcgctcatgaacccacttatttacgtatttaacattgataggttgcccaaccatatgcagggggatacagactaaggggcttaggatctaaagaatgtcctgacaacattgtaccctttaggaactcctagctggcaagaaagacagtctcagagcaatgtgtcaagtgcttaatataatttgctcttgacatacaaatgaagcagtgcccacaatctttagtaaattagagacttctcaataatgatagcatctgatcatgagattgagtttgacagttgaagaaataaagggagtaaacaaacaccaggcaaaaagaatggcaagtacaaaccaaacacatgggtgaatgagagagctttactgcagtctgcaaaccatttatgctgaacaaaatgaagaaaatacaatgctcttaaattttgtttgtttgtttgttgagctcctactatgtgtcaggttccaggttatatgagtcagcatagaatggaaaacaacaataagctccctgttcttgagccaattttcaaaggtgaggagataattaataaatgattagtaaataagtgatcaagaactgtaaatgcaaagaagaatataaacatgaccttgatatagcaggatgggctaccgtgagcctccttttatggtcagagaggtcctcctgagaagatggtgagaaggagatgtttgatgtaaaattggaatgacaaaaaagagtcagccatgtgaagatccaggtatacagaacagcttctttcatatatcaaaaatatttttttcttaaaatatatgacatattaaccttactttaaaatatgcaagaggaaaagtgggaggatgcaatggactgaacatttgtgtcccacaaaattcatgtgttgaaatcctaatccccaaggtgatggtgttaggaggtagagcctttggcaagtgattaggccatgagggcagagccctcatgaatgggattagtgtccttataaaagaggcccaagaaagctctctagtcccttctaccaggtgaggacacagcagaaacatgccatctgtgggccagacagtgggctcttgccatactccaaatttgccagtgacttgatttggatttcccagccaccagaaggtataagagatgaatttctgttgtttataatctacccagtatagggtgtttttttgttatagcagcccaaatggactgaaacagaagataaaaaatagtaagatcagcagtggtagagcagtaagacattgaatggttgttaaagataggtgatgagtacttaggaatctgtgagaattttctctcattttatgtacctttgaaaataataatattaaaagtttttttggtctcaaatgttttctccatgaacatactgtttcttcttgatatattccttatttattacactaatataaagaacattatgataaataattcttgaagggaattgcattccttatctacttcagcatgacaaattaccccaaagcttagaggctcaaaacaacaataagcatgtattagcccttacagtttatgtgggtcaataatttgtggttttagcttgggaaacacccttaaaaaaaaccgtaaaaactcttatgagatttgagttaagatgtcagccaaaactacagttatcgaaactggcttgactaggtgaaggatttgcatcaaaggtggttgactcagaattgactagttgatgatgttggttggtggcaggaggccttagctcctccctgctgggtgtccccacagggttgcttgtatgtccttaaaatatggtgtctggctttttctgaagcaatccaagagaaggtagaaacatggcagacttggaaatcacacacccttaccacacatgattgtattggtcatagatgtcagccccattcaaggtgagaggggtctacatgaggacatgaataccaggagatggagataattggtggacatattgaaggctagctgccacagggagaaacagtatatttggtattaaacaaataatcttgacatcatgctcactgaattgatgccccctccccaaaataaatccctcattaatttgttgttttcaactcataactcacacaactatctttaaacctctgtatctatatttagtttgtagggtacacacttatataatgatgtctttcttctgattaggcacttaaattagctgtatttaatggaataatgatattaaataactttgtaaatcaaaaggtgaaaatatatgcctagaataaattatcaagactttgtccagtataatgagtggtgattattttccagtatactcttcaatttattactgtaataatcttttaaacccattaacagtcaatttgctctgtgatattaaaatgttagccacattatttgcctgttaatgtaggttaaatgttaattatgctgttgtatggcggctaagatggtacatccagaaattacacataatattggttggttctttggccgtcatacactaatgtgcttcattattattgtgctaattttagtaattttagtacaaactacataatactctgtgttactaaaacagaactacccatgatatattgcttgcaaccaaacattaggcaattttggccccatcatttaggagtagtttacatgactaaacaagtaatgattctgtaactctcaaacttgcatttagtgtatttagaatgaattgcttagtatattttaaatatttgtagatcaaaatgtaatcccttttaaaacaaatgtaagtcatgctttttaagctaaatgtacatttaaacttcattagtgtagtgattataaatacagctatgattattcctccagttgtactaataatagaatggcatatcaaccttctccctgggtccagttttattactcctcattctactcttacaactattttaaaataatacttagcagtattttgagaaatagggtttgttttagtaaactatcactgtgtaacttgctgtcacaaacttagtggcttaaaaccacactcatttattattttacatttctgtaggtaagaagtttaggctcagctacctttctgcagtaggttcacattcccggaatcaaggtgttggcctttctagaaattctacggatgaatctgctttttagctcatccaggttgttgcaggaattcagtgttctacagttgcaggactgagattcccatcttcttggtagctgtgggctggggttagttctcaccttctagtggctgcctgcattcctcatcggatacccacttcctccattttcaaagccggcaaaacgatcaagtccttttcaatcttcgaatctctcttaatccctttctcctttgtcctttctcccttctggcagagaagtttctctcttcttaagggcccatgttattagattgggcctacctgtataattcaaggaaatcttcttattttaaggtcagctggtaagtaaccttaattccaactgcagagtcccttcacagtagtacctgagggagtaaatgtgggaaagaaatctcccagcgatatctttggaattctgctttccacagtgttgttgtttgattagaaatttagagtaatgtaacctgagagagcccactcaggagaagttccatttaagtttagttctcagtgacacaaggaatcatggaaagatctggagaaaaccagaaaaagaccatgctaattgcaagtacaccataaagctgtaaggttcatatttgatttattcaaaggttcataaagcaaaatagataccactactaaccaaaacaatacgaattaaatacctcgcgttccagacctgaaatattataatatatataaataaataagcagacatcataatttgcgcttccatgttcttaaaacatttttgtagcaattttccctctttccttccctcttaccgtataattcccatcagcataggactataatgtttatttctgccagaaaaaaatagaagaatctatagtgtgtcatatctccccttatctctccctatctatattttctgctcataatttgtatttttttcttaagccacgtctaaaattcagctccttttcccccaaatattctatgcaaactgcccttacgacccacggtgactttcacattactaattatgatggccttgttagagtattgatctaaatagaccccaaattaggatttgacacagatggtcacactgtcatcattgatatactttcttcactaggcttccagaacaatcagccttgcattgtttttctcctgtctgcctggaagctccttctctcatgtatgtgttaatttcaccttcttgcccaaatccttttctttagagtgctccagctcagggtttttagacctcattttctatcttaaagtactttctaggtgatctcatcatttctcatggatttcactaccgtctctagctttactcctaagagttctacttttcttcctaaaaactgctccacccacacttttctgctcaactaagcccaggatttttgattttatacacctttttttcctctaatccctttcctgtggtgagaaaagcttttaccagacaggggtcctgatccagatcccaagagagggttcttggatcttgagcaagaacgaattcagggagagtccatacagtgaagtgaaaacaagtttattaagaaagtaaaggcttttaaagaacggctactccacagacagggcagccccaaggtcagctggttgcccatttttatggttatttcttgattatatgctaaacaaggggtggattattcatcctcccctttttagaccatgtagggtaacttcctgatgttgccacagcatctgtaaactttcatggcgctggtgcgagtataacagtgagaaccaccagaggtcactctcatcaccatcttggttttgatgggttgggactgccttctttaccacaagctgttttatcagcaaggtccttctgaccttgggtcgacctcctatctcatcctgtgacttagaatgactaactgtatgggaatacagcccggtaagtttcagccttattttgcccagctcctattcaagatggagttgctcttgttcacacgcctctgacaaagctatttgttctattttcagaatatgtccagattgcgttcatttcctttgccactgcctaaagtcaagcaagcactatctgtcacctgaattatggcaaacccctcctaacaagtctccctaatcctgcccttgccttcaggtatcagtgcccaccacagctctgacctctctcctgttagtctctccccagggctaagtcctcattatcttccttgctttttcttacagatgcatcacctgttggctctgcttcattatcttttccaacagatattcatttgtctggctctctcactttcttcacttcttctcccgaaaagcttcttctcggagaggcctttctttacattgcaatccccgcctgcacctgaggttttgtattcctgtttcctgccttgcttcttcttctcacttacctaacatcagcctagcctctaaattctgtgtgagaaggtatttttgtctgcttttttctcactgccagtgctagatgagagccttgaatataataggtggtcaataaataatactgagaaaaaaagaataaaacatgaaagtacattgatagatggtatgttttggtgctggctataacattttgaggtagatagtacaggtattattttctttattttccaaatgaaggcaattatacatcttgcccagggtcacaaaactagttaagtatcaaagattaaaccaaaactcaattctcttgactcctaacccggtttccattccactacaataggtgctaaaaatacaatgttgtctgttcttgggagctacagtacagcatccctcaagaacctggaaataaagaaataagattgccttctgagagtcacactatgaaatcgacgtgtaatgagtcacttaccttaaagagctagaaatgcttttaagccaaagggaccattactgattaaatggtttaacatttccaaagaaagaacattttaataagaaaaggcagacatagaggcacttcaagaggatactccaaagcgaaagttgggcacgtgaatcctaggggctggagtctaagccagtgaattatgagaattccagaacttcctgggttcacagatacatcagactctgttagttaatgacaataaacattggattcatctgaccaactcactttttttcagagaggcctttctttgtcaccccactttatattgcaatcgtgatcacaaaacagccttatgattaataattaattttccatgcagctctgcctgtctatagaagaaaaatcccttctaatatgtacttccagcagtctggtcccgatgttagttatttcttattgaaagttagttgaccttctgattgcagtatggcttttgtaaagcttacttttggaagaaaagacatcctgatttcactgacacctgtacgtccctgcgattggtacattaaaaaaaaatatatatatgtacacacacacattcatatatatataatatatatatatacatatgccgtgtgcagtggctcatgcctgtaatctcagcactttgggagactgaggcaggaggatcgcttgagcccaggagttcaagaccagcctgggcaacatagctattaacccaggtaattttgggaggctgaggtgggaggattgcttgagcccaggaggttgaggctgcagtgagccgtgatagtgtctctgcactccagcttgggtgacaatgtgggaccctgtcttgaagtaaatatacactgaattgtgattttatgtatcaatctcccttacttggttaattgaatgtgagtctcttctgcacctccctcacttccactgaatatggagatgctcttaacatttcagtgtgaaacaaaatcaaccactccagaacttcctagtatcattctgtactcgaagtgctgcacaaaagcaggctctgaaggaggctcctaaattagagacgaaggacagacttttttttcttgtatagagtcttaacagaaggtgtcaggtgaaattcagcattttagggaatagtgggtcaaggataattctgggttttcatagaaggaaggaatcctcttgcagagtagctgccattgttttggcaacttagatttttatcaagaggcaatgggaggggcacttgtcgttaaggtcacttgcaagaggaagcccagaggaacagctacacggaactggacacaagagaggcccagaagaggagtctcagtctttggttgtctctcaacagaagcaaattaggtttctaaatcagccagccagagaactaaacacacacttggtggctttctgatttatcaagcacagctggtcacaaattatttttaatgcttgcatgtatgcatttctatatgtgtcaataagttatgctttggtggtttctcccttttaaagtcttgaataatagttaacaaagcactcagggaaaatattttatttctagcaagaaagcttccttccttcctatttgtttgttttactcctgacttgtctttttaaattatttcaccttggaagataaatcttagggaagtttattgtgacaacctcaaaattctgttgtactatagtcagatctcgaataaataattaattttagggaaaaaaaagagcgacataaacatatcaaaacatactggcattgtgatggcataagaacacctgaatttaagtctgagagttaacaattcctctttaacatcaagatatcactcagttaccacagaaatgaaaaatgagccattgaaggtgaatagacaatgagtggcatgacttttatgttgggcaggaaacaaattatgatggcaggtgaagatattgatcatgagaatgagaaagggtagctccaagcccaggaactgggatcggcaaaaatgaaggaaaaaactgagataaagggttccttggttgagaatcgtaaggtgcctcactacagtcaccaggtatattttcccttaacaaagtggcagagtcatctacgttgaaatacaaggaggtacctccttagacatcaagaaggtctcatttatcagcaagtagaatggaggatcattgtcataattaaccaggttctctaatcagcctaaagctgttgagagtgaattaggaagcacttgttatattaacattctaagtggaaagagcacaacaatataatctggggtctccaacaataagagtcgcaggtttttttgtccttgcgataggacaaaaaaccaaacacctcatgttctcactcataggtgagaagtgaacaatgagaacacatggacacaggaaggggaacatcatactctggggactgttgtggagtgggggcaggggggagggtgagcattaggagatatacctaatgctaaatgacgagttaatgggtgcagcacatcaacatggaacatgcatacatatgtaacaaacctgcacattgtgcacatgtaccctagaacttaaagtataataataataaaattaaaaaaaaaaagagtcgcaggtatcagcattttactctagcattctagaggaccttattttaaactcggtgcaaaccactacagaaacacataatgaatgatttatgctctctctttttttttctgaaaaaaaaataaaaataaaaaaaggcctaggatttgaacatgtaggcaggagtgactatagaagtgttgtcaaaactcttgactccaggagtaatgacaagggcttctttacaattcgtgcatcattctatttcgtggaagatattctcatgcaggtggtctgacatcctgtgtctatacacagcagcatcagcccagagagagacatcagtttttacacaaaacagcgatatttttttttcccagagtctaaagtcaatgacatcctgatgggagaattgcaaggctacgacatgcttttcttgttcatttggtaagccatgaagaaattagaacatgattttttttttccaatagaagaaaactatgacacagaatgaatagtctcaaaaaagttcaaaacttttgttttgtaaaaaatggtcatattattgtcttcatcttagttttttgccttcaccttatttttcggagtgttcaaccttagcaacatcaaagtcatcaactgaaaagtcaccagtgggaatgaagtctttctattgagttgatcttctgttagttcactgtagaccccagatgtgggaagttacttctctctgtgacaagacggctagagagagcattcaggaaaatgcagatggcgagtatttcttgatttaaacagctcatttcacatggtccatcacataatccttttaaataaagtagtttgtctcaatagacttattaatcttattggtcatgtgctacctgtgtttgattgaatctcagtgtttacaacttatccacagaattatttttagaattgttcttttaaattctatgatgaaggaataaattcttaatggcttaaactttttcatagtttaaaaatttatttttaaaaatgttactcttacaaccaaccccctttatgaacctggtgctcaaatgaatattgtaactttgtagtctctctaagaagttttcaaagctgtacattgaaccagatgatatatttctgcgatgtgggccacccaaacatttggggtgctgtcaatagtgtaaaagatttgagcaattactgctacttctaaaaaggtgaattatatcaccgttccttgttttagataaagcatagttggaatttcttgacatgattgaggaccaaggagagctttggtcaaatctattttatttgaatcaagatagggagttctgaaacaaaaatgttcaaaggataaacgtacttggtatctaattagtcagtatgcctcaaaatagttcttgcatacctagggaacctttttttttgagatggagtctctctctgttgcccaggttggagcacagtggcatgaccttggctcactgcaacctccgcctcctgggttcaggcaattctcctgcctcagcctcccgagtagctgggactataggcatgcaccaccatgcccggctaatttttgtacttttagtagagatggggtttcaccatgttggccaggctggtctcaaactcctggcctcaagtgatctgcctgccttggcctcccaaagtgctgggattataggtgtgagccacagcacctggccgggaacctttagaaaaaaaattagtaattattaatactgctcagaacatgcaatggaaaatattgatgtagatcttctgaaatctcttcttggattaaactctaagaatagaaaatgtgtaaatgaattacattaattaccgcttcttcccaccactgctccttcaactccataccctgaattgtttttactgaattgcactttgaaattatgcccttgggccacattgaggatctttagaaaaaaacagccctgagaaactcattactttatttactgtaagatgttgtttgaggatgttgttctctgccttgccatttggacaccttttgagaacccccagaagagatagatctcaaagggcaataccaggaatagtcttctatttcctgaacaagtagttgttggtctcatggacactgacaattacaatttttttttcttttccagtttacactggagtccagataatacagatcaacctagagcacatctctacccttagtacagaatattgcagaattttttctcctggtctcactgcagtttcatttcattgttcctttgttaattttcctttgccttgatgcacttgttgacttaattttatttcgcggcatgaatttgcatcatgaatttgcatctaaagtctggaaaaagagtgtaaacaaccaaattgcctttataatgtgagtgagaccaaggcacctctgggaaaccaaaggcctagtcttagatgaagaatttggggaaagattgtcaactgaaatgtccatattttcatgaagtctctcagtgtggaagttcagtagaattaaggtgttatctgaatcagaatccctggaaacaacacctgagcataggtatttttttgaattataacatgtaaaattaaaagatggcatttctggcatggaaaagagcaagttcaaatgacctgaaaagggaaaaagcttggcatggtttggaaagagtgaaaagtcacacatggctgggacagaacgagtgaaagggaaaggtttgggagataaagttgagaagtagacaggccagatgtcaggcagagccttacaaaccataataagacgttgcatcccatttcaaacacgctagaaataccgaaggtttctttgttaagtcaagtttgttgaagtagaattgatatacagtaaaatttacttttttagcataaagttctgtgggttttgataagcacatggagtcaggtaagcatctctacaaccaaaacacaaaacatttctctcactccaaagagttctatcacatacctttatgatcaacccttcctcccatccccataccctaggagctctatcacatacctttatgatcaacccttcctcccatccccttaccccaggagctctatcacatacctttatgatcaacccttcttcccatctgcataccctaggagtttggctctgctttctcttgtatagttttgccttttccagaatatcttataaattagatcatacaatctgtagccctctgagtctggcttcttgcacttagcaaaatgcatttgctattcattcatgctagtgtgtgtacaccaagagttttgagtgggggaatgatacaaactgctttgagttttatagaaataactcctttgctgtggtaattgtgggagtggggttgtgaagaggtgattgtagcaggtgaaattaagggagaggataggtcacagcaggaaggtgctgagatgcggattcaggaaatatggtgaaggcttatctatcatgagtgctagtgatgcagatatgagtaggacagataattttctacttaggaaaaataatttcaaaacatttaatactaaaaaacaatgaaagtactaaaaggattcataggaaagtttaatataattttagattgaagaaaaacttattcatcaaaacaaaacataacaaaacgtggagaaaaattacaatatgaaaaagttaaatttgcataaggtgaaggacaccataatcaaaactgtaaaagtagtgtcagccagggagaaacattaatagcatatataaccaagtattgatgtacacactgtataatgagcagctatcaatctctgagacagataatccaaaaaaaaaaaaatgggtaaagtggagaagacaattaactgaagaaatatagatgtccaatatacatataaaaatatgcttattctcgttactttttgattcagcaattccacatctggcaatccattctatggtaatacttatgtatgtgggcatagattgttttgcatcaatagggaaataaatatgtaaatgttggtttattggcataataaaatattatgcaaccattaagaagaatgagctagatctgtattaaaagaatgagctagatctcagttaaaagagtgagctagatcatggaaagttctatgttaaatgaaaaagttacaaaacaatttgttcagcatgattctactgatagctaaataaaaagaaaagcacattagtgactatgtgtgcatgagagagagagagggagaatgaaagagagagacagaaagaaagaagggaaggagagacagagagagagtaagagagactaaattcagagaaaaacaactgtatgcacatcaaatggccaacaggttaatagcagttcatattcacagaggatcttagaattgggttgggtatgtagacgaaaagaaatacatttttcttacccatccctgggttcatgactgaggcctctataacaaaaggcagattaatagaaaaacttgcaaattgatttagcataagttttacatgatatgagaacttttgaaatgaaaacgcaatttatatattgttttggggaaatacccattagtaaacggttaaaatatgcaaggaatgataccatacagtctcaggaaagtggttaattcagggggagatggcaaagttgggcttcgtttctataatttttgactattaaaaaatataaagtatatatgacacgatatttaatgtttggtgatctagatgattgaaatatgtggacatattattttctgtttcctgatggtttgaagtttttgttattaaaaatacagagaatattttgcttagatgatgactaaagaagacattatggagtaacatgaggaaatatattaaatattgcctaaaataggggaaggaagaagtgtttagtttggaacagggtgctaccgttgtgacctttcttggattattataatacaaacagtaacttgcatctgttgagaagttattgtgtaccagatactttgcaagggcctttcgtgtattttatcatttaatcctcacaacagctgttaggtgatgctatggcttgagtgtgtcacccaaagttcatgtgatggaaacttaatccccaatgcaacagtgttgagaggtaggacctttatgagatgcttctcatttctctagcaaaagactctgccctctgaatggattaatacagttattgcaggagtgggttccttatctcatgggagttaagttcctgatgaaaggatgagttcggctggcccctttccctctctccctctgtcctgagtattctctctccctgtcatgccttccaccgtgttatgatgcagcaagaaggtccacaacagacgcagcccttctatcctggactttccagctaccagaagtgtaagaaataaatttctgatttttatacattacccagtctcaggtattctatcatagcaacacaaagcagactaagacagcctgtatcatagatgtagaaaatggacatagattggttttgaatcttattcatggtcacccagcagttaagtgacagaatcaagattttaaccaaagccttctgactcccttaaaagcttgtaactccaaacttccatgttctgtaataaatagcatttttctgttgagaaaggaaatgtggaagagactggtcctagccttaaatcagttgggttattaggaaataaagtagggaaatggaaagtaaagtttaagggatagaagaaaaaaggtttgggctaaaaactacctttccctatggaaataaaatgactagagaattaaaccttgaaagatccataaggattggtgtaaaattcttgtcttttcacttttgaactggtagttcaagcataagaaagaaacagtgtcttctcaggaagatcctgtttaaaatgtgttcctcgttggaaatgctaaagggtacacaggtttattggtttgcaagggctgttgtaaccaaatgctacaacctgggtatttggttacaaccaacacagagtttttgttgcaaactgtcataaattgtcagaataattctggagtctagaagtttgaaatcaaaatgtcagcagggccatgttctcttggagactctaggtagactctttccatgccttttcctagcttctggtggtggctgtcaatccttgtccctcaacttgccggggttagaactccagttccttcctctgttctctcattctttctttgtttctttccattgactttttataacaacactgcttagattagattgagtgcaccttactccgatgtgacatcatcataactaattttatctgcgacaaacttatttccaaataaagtcacattctgagctactgagaattaggacttcaacatgtctttctgtgggacacaattcaacccataacaacaggaaaaacacaataaggcaatcattataagttttatgtttcattcttgaacttggtagatattgagcatttaaaataaattaaaatatgttaaatgtataaataactatgagtatatatccacgtgcatctacgcaggccatgttttatttctaaatagtacatcatttaagtgtttagcaatttgtattatgtactgagattttatatctagataacaatgtatttagaaagagatttttaaatatcaccccaataaagaaaccagtggaagaaaactgtattaagtttcctccaattccttatttagaagagcatatagtattcaagtcaaataagttgttgaataaatgaccttttggtaaggtaaattattatagtaggtctgcaagatgagcacagtcattgtaggaaaatctgttgctgagtatgctttgtgttctttttcatttagttgttctgtttggttttgctttattttcttctctgactgaaagccttaacagaaacaaaagtgtttctctcatgtgaaatgattagctctctttctcaccctgacttcctgtcccgacttgaatagaaagcaatgcatgagtatctaaataggaatcaaatgttctttgacaaagatgcaaaagaaacaagaaaacaactggattttattcgtttctcagggacacgttcactgaactgcaaaagccaaaacacctgggaaaatctgcctaggcaggcagggctgtgaccagtaatggaaaatgcatctctgtgtgggcttagagggctgggaactatcatagactgtggctggagtgtgatcaagtaagattcaaaagagagagattatttcagaaccatatagcataaaactgaaacgcagagaacagataaatgtatgtgtctgtccttttaggcagaaagcatccgttttgaaaaaacatttacctgtgctgatttgaagatttcaatatgtgcctttccagagtacttgcaatcatcattgtgtagtgagccttcaaaaatgaaggcttgctgaagaacaccattacctgtgagtctgagtgtgttgtgggttgggtcatccaccagagcagatagggtagagagggcatctgtagaccactaagtaaaagaaaacatctgaaataccaccttctttattcagccctttggtttgtttgtttgaaatgaggtctcgccctttcactcaggttggagtgcagtggcttgataacagctcagtgcagcctcaaactcctgggctcaagtgatcctctcacctcagcctcccaagtagctgggactgcagacacatgccaccacactcaccaaatatttttatcgtttattttctgtagagactgggtttgactctcttgcccagagtgatgttgaactcctgggctcaagtgatctaccaaagtgatccagcctttcagtgccaggatttcaggcatgagccactgtgcccaacctcagccctctaatcaaagaaatagtaagctgcatagatgccaagtgtagaagttgaagtactaaatctctgctgtgttccagcattgctagggatgaaatcccctaagtttatttagcacttaaaataatactctctagtatccaagggcctgaccacttctttatcagtcaccacatgcaggaagcagtgtcagggccggcggggagtgcttaaatattctatttgcaaatgctctaagttgcaacagttagaatgtaatgcaaccccccccccaaatttagaagcccaggagggatttattctacccataagtagcaatgaatttgacacttgaagaaagttattgtgtataaatcaaaaattcagtgattataaattttgaatttttgtttgagatgaagggtggagaggaaaggtgggagtaggtaaaaataaatccatcgaggtaattgaagtcaatgaactttgtcagtcagtatctattatcataaaatgctataactgtcaccttgggcttatacagataatgaggactatctgtgttttaccaataaatttctttgtgttggtttagcacaagccttatacaagcactgaaaatgctaggagtaattttttttcttttccagttgacttttttttttttaacaaaactgtaacatgtggtttgcaattagctttaatttcaaactaaacatattttaagaagccaagtagtttttatgcatacaaagtttcaggattcctctcctctctgactttttaagcaaattgctgtgtctgggccccatctccacattttcacaacttaattcttagcactttcatctgaccacattctatattttgggaagcatccaaaggttttcttagggacttgaggtgggtgctaaaatatttttgtttgcattttttttttctggctacattagtttcttgttggtagtgagtgatttttcttaatttggtgattttcttatattaagattatgactttttaaattgcataggcaaaaattattagtttaaaattccagatctcttcatttctatcaggcatatctattggtaattttatcaatgtttatgctcatgcctagttagtacttcaattagcaaattaattgtacttttcataaaatacctttttaaagtaaggttgccagattaaatgcagtttgcccagttaaatttgaagttcagataaacaacaaatagttttgttccagttaaatttgaatttcagataagagcaaatcgttttgttttgttttcagacatactttttcacatagtaagtacctatacaaaaaagtatttgttattcatctgaaatccaaatttcactatttttttctttgttatttatttgtatatttattttatttttgtctggaaatcctactataaagaaagaagtataggaaaatttattggttaaaaacatgttatatatcaagctatctgtcttagttggttcaggttgctataagaaagaccttaggctgagtaatttagacagaatctatttctcacagttctgggtgctgggacctccaagatcaaggtgccagcagattcagtgtctggtgagggtctctccttcaaagttggcaccttctatatttcctcacatagtggaaaggagggtcaagctgccctgggcctcttttataaggacacccattccatttatgaggatggagctcttatgacgtaaacacccttggccccgacctcttagtactatagcagtggggattaagtttccaactggaattttggagggacatgaacattcagactgtagtattatctctaaaaatgtgtgtaattgactcagttacatttcaatgattagagagggaagggtaaatccaaatttaagatcttgttaactttgattcattaattcattttacaaatgttcaccgaatgcctaaaatgtcaggtcctaagggatgagcaaaacaaacttaattcttgccttaatgatatttataacttaacggagaagaacattaaccaaataatctcacaaatacatggtaaactgtaataaatacaataatggggaaggatgacattcatacatataggggaatgtgttggaaagggaaagtcaggcaagatttccctgaagaagtgaaatttgaattgttaaagaaaacaatcagtcaatgatacttgttaaagcacagtgaggctgactttagtcaggtctattgcaatagacatagggaccatgaaaatgggattttgcaatgggggagagaaattgaacgaaactccaaatatagcatgcacaagtgggaatttatagccaagaagtagagtgggggtcagtggatggaaaattgctaagaggaagcatctggagtaagaaagattcaaactaaaccaaccaaacatgaatcttgctgaagacagaacagagtgattaggtatcatctgggggatggtggaggatgaagaacctgctcatatattgagagtgatcaggtatctgtggtggaggattcttgctaaactgacttagcagggttcttgctaaaactggattttacaaggaagcacacaggagagcttaggagaaggaggctgactgaattttggttaagcaaaggataattgtcagaactaaaactaaagccccagtgggactaaattaggcaaagaagagtgtatcagtctgttctcacactgctaattaagacatacccaagactgggtaatttataaaggaaagaggattaattgactcccagttcacatggctagggaggcctcacaatcatggtggaaggcaaataaggagcaaagtcacatcttacatggtggcaggcaaggcggtgcgttgagaggaactcctttttataaaaccatcagatcttgtgagacttattcattatcaggagaacagcacaggaaaaagatgcccccaagattcaattacctcccaccgggtccctcccacaacatgtgggaattgcaggagctacaattcaagatgagatttgggtggggacacagtcaaaccatatcaaacaggtagaggaaaggaagtgaatttatacatagatgaggcatcaagaacaaaagaattgaaagtatgtgtcaggttgaacccagtgagcatagaaagtgttactaaaaattctgcaaaggaagtctaaccagatcaagcatgactcagcaagctatttcaattttgatactaaaactcaatggaaagatctaccaaggttttaaaagactagtaagatttgcatttgaaaagatgaatctagctgctcaaaagcaagaagattattgttgaaggcaccatttataaaccatttcctggtggcctgtatattcttgtagcaaaaagaaaatgatagctcaatgtatatcagatattggcaaactttttccataaggggtcagatagtaaatgtttcaggatttgcaggccatacgatctctgttgcaagttaataacagaaaggtataacaaattaatcaaagatttatgtgacccaagagccttcaaaaatgaagacccaaagatgtagggaaagctatctgtttttctgctaagtttagcgtagaatggacagccgtctagaaatgcgactggacaaaaggatatgatttgctgacaatagactgagagtgtggcaaaccgagccaggctgtccagacacttcttggtctctctgtgtaacatttcttcctccctggtatagggcacagccccactggaatgagggtcttcaaggaagaagggagaagggagagagtaacctttcagaagttttatgacttgctgtgggaagagagggattcaagtgtctatgacctgccttggagaagacgaattttatttcctatgaactcactatgggggagaaaggggagcagaagacagggggctgggagaagggcagacagaggctttgctttgagggcttctaatttcctttagttcaaagtccttgggatgccaaagcattatattttggagtattctcttctaagccacaacaaactaaaaaaatgaaaatcattttatcttaatacaaggtatatgaggcaattgaagccagcaggggctgacatcttctataatgcttaattgctaaagtctttccagtgcttctccattctgggtagatcttaaattatcttcacttttcttccctgctatatgtcttattttctgatatatttgtttatctactggtgattatcagctctgctccctatcaccacttgttgaactatattctccatgatttttaatattatctagtgtggtgcctcccaggcaatgttcatgacctcacaaatgggtcacttgttagccttggggcaccagggcagagtttgatgaggctttggatgggctggccacagtgatcatatatagctaaaagtggcctctttcattattcttgacagtatgagtgtattactattttctctctatgccttgacttggaaaaatttggaaaaccctgatcaactgtaacggaaagagtcagtaacaggcatatcagaggttctctggttaaggaagtagatattgaaaagagaaccattttggggtcagaacactggttctcatataccagctgatataaccttgggcaaatagtttctctaagctcaactgactaatttgtaaaaagagaataatagtagttgaacataagaagtaactgttatgctttttttgagagtatttaattagataatacttttaacttctagcatggtgttgagaggaaaactttctctgtcccaacttaggtgtgtgtgatgggagaggagaatgtgaatcaattgacaacagatagattaataggagaaaagttttaattcatatgcatgcaggaggcaggagcagtgagtaaccttgctgaatagccaaggataagcagtatacctagttaatgtcaggagttcgagaccagcctggccaacatggtgaaaacctgtctccactaaaaatacaaaaattagcaaggcatggtggtgcatgcctgtaatcctagctactcaggaggctgaggcaggagaattgcttgaacccaggaggaggaggttgcagtgagctgagattgcaccactgcactccagcctgctgggtgacagagtgagactccatctcaggaaaaaaaaaaaaaaaaagaaagaaaaagaagaggttctaagacttcagtgggaaagtatggaaggttctactgttttttgtttgtttgttttcatcctgatgctaatggagttttcttcttgactgaaagctccactgaaggagggtttatggcagctgaatttgtacatccttgtgttaaggatctgtcttctctcaagcaggaaacaccctcagaggggagttactgacagctatttttttgggaggctctgcttgaatttagataagaattttttttcttgttgctgcagttagttcagatgttttcagtttaaagtaacatttacaccagtctggtagattattggtcccttcagaagcgatagtatacccttgtctaagtcactgttctattcctacaactagactcaaaagaattgtcttaccttagaaagattcatcactttgtgtaacactcactttgtgtaccaccagttaagttcagcagaagacttaggtgtagaaaggtatttcagatttcttggcaaaccgttcacatagctggtaacaaagtgcatcatgaattgtgaatcactttcacatttttgtgctgataagaggacctctcatggtatagcccagagtaaactaacatgcatgacgtgatttattctaaccaacccgatgaaatgcagatgtgaatggaagctctaggcaaaatattacatggtgtatttcactgaagaggagaaaaatgtattgactagcaaaattttaaatatctgaaacccaaggtggtggtaaggactagaaaaattattttgattgcagaaaaatgtttttttctccatttctttttaaagaaaaattcagcatcaaaagcagatatcgcaggaatcagtcctaatgattatattctcctattgttataacaactgaaatgagaacacaacctaaatgaatttttctgttgagtttgtaaaaagaagtacatgttacattaaattcactcatccatgcatggatctttagaaagaaatagtttgaaaaaatttcaagtcttttagagaatgtgactaatctggtctgggtatttctggtcagggtgcatcttctctgctacagacaattcttgtgtctactcaaaatccatgtgttgaaacctattcctcaatttgatagtattaggaggtgggactttcgggaaatgattataagagtgaggctctcatgaagggaattagtgcccttagaaaggagggcccagagagattctctgtgccatcagccatatgaggactctgagaagacggcctgtaggaaccagaaagcaggccctctccagacaccaaatctgcctgcacattgatcttggatttgctagcctctcaaattgtgaaaaataaatttctagggttcataagtgtctcagtctgtttatgttgctataaaggtatgcctgaggctgagtaatttataaataaaaaaatttgatttggctcatagttctgaaggctgtacaagaagcatgatgccaacatttgcctctgataagggcatcagtctgcttccacttatggcagaaggcaatggggaaccagtgtagaggtcacatggccagagaggaagtgagagtgagagagagaaagagacagagagagagatacagagagatacagagagagaaagagaggagggaggtgccaggctctttttaactactagttctttcaggaattaatagtgagaactctcacagcacccccccgacactcacagtcccctggaattaatctgtgcatgaagggaccacctccattaggccccacttcaaacactggggatcagatttcaacaggaaatttgaagaggataaacattcaaattgtagcaatacattgcactgtaagttgtattgtgttatgacagctcaaacagatttagacactcactttgaaaccctttgcctgaaccttttgtgtcataatcctgctgctactgttgatgttgtacacataccactcattggaactgcaagaccaccaggttaccgtatgatcatatttttatgtgaatatatatattaaaaacctttaagccagagatatgcacataactcttattgaaattatgattaagcaaagtgaaaaggtgatagtcctaagtatcctttttctaaggaaatgattagagtattgctttacagctgttgactttgcaagtgtccttggagtacggcattccttccactctccccttcccaacccccgacccagtagttaatggtgggcttctagtacacacgctgagaatcatctcccactttggaaatgatgataactcagaatggatcataaccggactcgcgatagttttcatagacaggtaataaaaagaagacattcaacatgaaaaattaaaggtgttacgaagatgccaagagatatattcttcattttattgtagaattatcagaaggagatgaagagttccaacctttaagagcaggcaacagtaattttccgtggttctgtgggacaccttatgcttagcaatgaaagtgtgtaataaactctctggatgaaatattaccgctagcttccagaactttattctgtttatcctctccatgggattctgctataatgttaactcttagaatgctaagatttgccaatgtctgacacttccagttcatcagttgtggttctttatgtgaatatttgactagagagcttcagaatgttataacattctttaatggaaagggaaaattagttttcggatgtgagtttcgttttatggaaaactaaattttcttccatctaagaattttaacttatgaaattataggagacaagaagtatgttttttataaatagtggagtgtttctagtgtcatctgccttgtctgaattttcacatcaagtaaacattttcttagagcatttatgaatcatgaaacagtgtttgtctattaaacagattctggtcataagtttttcaagggcttaatttataattctctccagcaccttgattctttatgctttgtctgtattaaatttccatcatctttttccttttttcttattgaaattatttgggggtcaaatacattcatttttttgttattttaataaagaaaaccgaagctatgcatccaagagcacataagaaatttattattcatgaatatacatttatatgtgcaaatgtatgtataatagacttaatacgtgcttgtatcattgaaaaactttgttactaacaggctttgggaatcatgtctgtgacatgaagttgaaacaagacaaaaaaacttgagcaccaaatttgctcattggtggtttagcaactgtgtagaatttcaaggattatgtcctcattagctgatactgctctagatgtactatatttaatgttatacttttctgaatatactaatgttcaaaaaagaatacaattaaaatattagttaatatgcccacttcaggtgcaaacacattttacatgtgtctccgcacaattccttgtttatgtgtgcattttaatggtttatttagatcttatgttctgtatcttttgtgatattctcagtacatttagctacttaaatttgaaatgtgaaaattattctttccttcctaaattgatctctaatatgatagaaaatttttagtgcttactataaacgtcaaagttgggtatttatcttttatttgacaaaattcatatatatgaatacatgcatagtataacctttagtcagtgaacacccataaagtcaccttacttgagttaattaattcgaaaattatgcattcactacttacgggggtgttaaaattttatcttgcggtggggttgcaaactctcactgcaaatcccttaaacattggcaaattacagtttcacatataagagatagaactagtatcctgttcattcaagaaaagccagttagagcaatgttgtctaaggtggcctcttgatcgtggccaaagctgtcctgggactagagtgaagcaggtgaagtgcccggggtgtgcttcacactcttcagtctcccaagtgcccatcctgttcttgaacaaccctgaaagttgttcaagtgaggtgccttgggggcaaaatttaatgaagtcctcactctcaggatcatgcatctgtcccctgaattttgtacttgctacacaattgtctaggtcctggactgtagcaggtttcacaaaaatgtgtacagggtgcccctcctgtgtcactgagctgcagccagaggcagtgtatgcatgcagaaatgaatgacagtctcttggaaaccaagcgataatcttgtataatgttgagtgatgctagcaggtatgtggatgtaggccataactgagcacttctgaggcaagttgcatacttacctgaaagtgcggacccttttttggtagctgcatttttgtaattattggatcccatagaaccatgctcacttgtgagaaataaggggataatttgtgctcccaattaaagttttttggactcttgatgttgattccctgcaagaggatactggaacttgcattggagaggctgagttagggttttatggatagacttaagccaaaggcaatatgaaattgtccaaatggtgtagggttctctttgtcccaagagttatattcttgcaaggagttattcactggcctatgtgtgaatgaaaatatggccatctatagttaatgtattgggctttagtgttaggagacagtgatatttgaaaagtcatccacacatagtgaaaccattaataatcaagatctaatgaataaactcagccatctgcagagcctcctaaaacactgtgtttaaatacattgtagatgcaacaagagtgatgcaagtcagatttagaagaccaggctgttttccagaaagctgtaatgctctgaaatgtattgtaatgtttctgaaataatggttggattgttataacaaaagtgtgatggtttgaaaaaggcacaaaaaggggaacgaaaatttaaaattgctagtgcatatccaggaactggtatgggttgtggttcttgatctagataagtgctttgctctccttagatagttctagcctttgtatatcaaaggtaatagtcatactacattgcttgaaacggaattcacattttgatacatctcaccttacattggagtctccttagtagcgtaaatgaacctgatcatctctcagtatattgatgaatacaattcctgtacatgctaaaatgagggctccgattttgacttggtgttgaagtcccttcttagttgccactctctctcattctttttctggtgctgcagctttttgctgcctccttcttccctgggcttgtggcagcaggtcgagtgtattgggttatccagtgggctgattccaatttagatcctgtggaagactgtgctttagaggagggatcagcaaaccacggccacatgccaggtctggcccactgccattttttggtatgactcgtgagctaagaatggtttttccggttttaaataactgaataaaactttaaagaagaataatattgtaggacacatgaaaacttgatgaaaggcaagtgtcagtgtccacaaagttttatcagaacacagccacactcacttattttttgtactaccacagtggaggtgagcagagacagagttgataacaagagaccgcattacccacaaatcgtaaaatatttactctctagacttttacagatctctgccctagatagtccagggaaatgagctgaaagtttccataaaagctctgacgtctttgcagttgtcgtatagttcggtcttcaaggggtggaaagttgtgttgtggaagtgcatcctggaaaaagagcggatatgagaaggaaagcaaagggaatgaaggtggtgatattatttttttctggtttatattgacaatcttgaaactgaatcaagaatcaaacttctaaattcagattcatttaacaattcttaaaaatgctttatgttccagggatcaaggttggtgatttatgagaaaacaagaacactagcccattcacaaaagtcatctcaaaacataattatgcacttttctgaatgattgcttaactgtttcaattagtatgtctcctctacaagtagtgctctttatagggtaaatttaaaatctctacattcaaagtctttatcctctttctatgtttcttctctcttctccgttctcctgcctcccttctccctttacatctctatctacactaggtgtgaaacactggacaagttacttaagttctcatttactctcattataaatgagaacttacatactagggccttacttacatacaagggctattttagaaacgttaaataagaggatctgtagtactcagcatacacataagtaacacaggcaaattttgattcttataatgtgagttttcttatgaaactaagaagaaagtgattcagaagtgctacattaataagaaaaaatagaagttcaaaatacatttactgttctatagctacataacactttattcttgtgaaagtttaagaatgacctgctaagtatttcagttatcaaacctaatatatgctgggccatttgggtcatgatttttatccgggaccaggcatgtgttaccgttaaacactttcattcatcatttactagctaacagctaaacaaaactagttgtgtaatgcgaaatcactaaattgctgcagtagtcacttgtaatgaataacagaatattacactgccaataattacaggtgattaatattttctggtcagtttccattccaggatttgagttatgtggataactggaacattccaccttttatgagtgacaaaatcttaatccacatcaagagttctgtattgtcctgtgaatatctaaagctaaagaaagaatttagagactgtaaactacattgaaggagattttaaaaagggggagaaagggaaagagaaggaaggagggagagagtgaagatgtgagagagtaaaggcaggggaaaggagggagggagcaagaaaagaaaaaggaaaagcattattaaaaagtgtccggtttaggcatagtcaattcttatatcaggaagaggatattaaacggaaaagagatgcataaatcaatatcgtctctattttgagggctattaaaataatccttaagtttctttccatttctgactttgatgctaagattgctctccaaatattatatttttcattatattctatgccatttatagtttgtaggagagaaggaaataaatgatgaggtcccatactaaagctgaaaatttttaatctctcagacaacagataatcatgtcaccgtgcataaaacataaccatcagtagtaaatgtataaaactgagttgcttaaagtcatagaataattgcttctaccaactttgtaagaaagagtatactatttttgcataaaatgtaaattaaagttgaaatattatctgtgttgaatggaagtatacaattctttctcggtacagggaatcagtagagccttacaggaggatcttccatgttgcttttagtttgggtgaaaactgttatcactggatttgcattaaatgaagttccttcctcttaagataggatgattggcagggattaaggctttattactacaagatttctaagccaagcttctctttttcatgaataatacctacccccttatttattcatggtatttttgacagctgacagttcaggaagtatatgtgcttctgtattaactattaaagctctctgtttacatatgggtggagatggctggtacatttccacttactccaccaggtatgttaaaatcataagtgaggaaaaaattatataataaaataaattttataataaaataattaaaattattataaaataattaaaatataatattttaaaattattataaaagttataaaattattataaaaattattataaaattattattaaaattatataaaatattatattttaaaattattatataataaaataattaaaatattacaataaaataaagcaagacatgtggaagtattagagggaaatatccagagattatcaagccatatttagttgcaccttttctcgtggtattccatttcagtgattttaaaaaatatatcaatgatgagtcaactagatacaaatgttattacttctggaattcactttggccttgttgaactgaaatagttctatgtaaatgtatatctgtctgtctatctaatttgcttagttttacttctataatacaagatttgacctttatttttccatttattaatatcatatttccatggtaggtcttcctagagtataaagaaatcaagtttctcaaaaataatagtgttaatatcaaaattgcgagtgagtacaaagagcatcatgccaagtgaatggcttatctccagaaaagctgcgtcctggtgaaaaggggaactgagcaaaatgcacattttgattgtgtgtatcagataaattatagctgccagcaatcctctctatagggagaaaattcacaggatgggtttatccaaaggaaggaaaaagggtcatctcccctaccttgctcttgtctgagcctgcagttgctgttttcattcactcccacaggggtgattatagagcagcctcaacaccaaagcaggcaaaaaaaaaaaaaaaaaatgttggcggggcgcgatggctcgtgcctgtaatcctagcactttgggagggagaggcggggaggatcacctgaggtcaggagttcaagaccagcctggacatggtgaaaccccatcactactaaaaataaaaaaattggccaggtgtggtggcgggtgcctgtaatcccagctactggggatgctgaggcaggagaattgctggaacctgggaggcggagcttgcagtgagctgagatcgcaccactgcactccagcccaggccgacaacagcgagactccatcaaaaaaaaaaaaaaaaaaaaaaaaaaaaaaaaaagctggactaaagaaaaaaacaaactacaacctgaatacagtctttaaaattattaggccagtcttagtttttttggtgttttcaacaaaaatatcctgaaccattaaatctgggtttgagtcaagaatgaaataataagttgaagtgactagactaagttcagtgaaggaaaggaattgagagatttttcttaggaaatagataactgttgacaagtaaatagttattaaaaatatatgtcactgcagtgtcagccacttatttatttttaattaaggatctgttgacctttttggccttaaataattgtgttaaatagaaaatattgccatttaaacttctgtgtagattactgttaactataatttaggaatatgcttccttaaagtttttgtaagtttattttctggatcatttctcaatgacttgattcttaatttggtctaagtgctattttctgatgcttttatagagtttaccatgttggtttaaaatatactttgctgccagtttactaagagagtagctgagatgtactgactgaattactcttagttgcttgtatcctaattatagaattctttactaatccaaaagtaattcagcaaaaatacttgactcagtaaattcttattttaatccttgtattttactataaaaagatattttaaaatatttctttgagacagacttttctttcagtacaataagatatatgaatggtgctgggcatgctggctcatacctgtaatcccggcgctttggaaggctgaagtgagaggattgcttgaggccaggagtttgaggtcagcctgggcaacatagcaagaccctgtctctacaaaaagtttttgaaaaatgagccaggtatggttgcaactgcctgtagccctagcaattcaggaagccaaggtgggaggatcatttgaggccaggagttcaaggttccagtgagctatgattgtgctactgtaccccagcctgggaaacagagcaagaccttgtctctaacaaagatatatgaatggaattaaaatgttttcttggagcctcttgtcattgatttagaaagtctatttaacctctgttcggttcccaatgacaatagaatgtctttcttttctcatttattttttctgtcgtatcatgcagctctcacagaaataaagacagaacattaaacaggtgtaccttttaaattctaagattgtaattttattattgaatagaacttcacttttagtgctttccaaatgatggtgcctatttgatttcctttaaattcttctctttacacatgacgatttcacttgtgttgactagtaatctttggtttaacccttccgcactttttgttaagtctaaagtttaaccctttagactttctttactatgaaactatctaaactagaaacatactagggttcaagttaagataatgaagagtcatctggtattaatgggaaacaggagtatgtaaaacccgaggttctcaactgttttcttcctttcattctaggacaaacattgatgtgtgagatatccccatgcatttgagaacctttgcatagactgtactgcagccctacccctttcccacaactgttcactgctcacactttctcacccttcagcacacacatagaaaaaatagtactgaagtgctcagtagtagttaagagtgaaattaccgatgatttcagtactgcattttagccagaaaagtctaaggtaggcctaggaagccaattcagaccaagagatccctttctcaagtaggtcatgtttgtgccttgagtttctatggctctttggcatccattgtgagcgagatggacacagtccaggaaatatccctaaggaatagctactggtagcagatcccattatcaatacagttgtactataaaaggcaaaggcaaatgaacattacaataggcatttaactttcttttttttttttttttttttgacagagtctcattctgtcacccaggctggagtgcaccagtacaatctctgctcactgcaacctccgcctcccaggttcaagcgattctcctgcctcagcctcctgagtagcaggtattacaggcctgcaccagtacacctggctaattttttttgtatttttagtagagacagggtttcaccatgttagacaatctggtctcgaactcctgacctcaagtgatccacccacctcagcctcccaaagtgctgtgattacagacgtgagccaccgcacccagcttaactttcattttttaaaaatttatgtcaacaagctaaaattcctcttgattttgcattacagttaaaatatcacaaggtatcattgaagaagtttaggtgctcagttcctaaaggcccttataaagtcactttcctagaagccgttcccttttctccctaggttggttgcatatccttcttgtatatgcttagaaagtccagcatttaacatgcctagatcttgctgaatgttaattacctgcatattttaagcatcttttacccctgcatcctccattagaccgcaagtccattgacagtatgtactcaacactagcagagggctgggctcaagttctgaaacatgtgtgactttggatatcataatatccaatgaccacccacttgccatttctaccctttctattattcaattggtataattctgactagcagaagtattttaattcaaataccatcattttctgaaaataatcatgctacatctatgacaaagtgtcacctaaaattatttcctcattctcattaagtagaaattcctaggccaggtttatttatttgtaaatctcataagtttggatttaacagttcttgtttattaaaatcaattatgtggtgatttgtgagtttgaccaaaagctgatttccctactttattttagaaatttatatcttcagtctatactgtttttatatttggatataaaataaatttacattattcaaaaacataaaattcaaaagtataaaggaataaaattcaaaattcaaatataaatgaataagcaataaaaattatcttgttcccctagcccatccattgctctttccaatggcaactgatgttgtagtttcttggttattcctcctaaaatattttgtgaaatacaccaacaaattcatatactgtgtaaaaggtacattagtttattccctttgaaaaacaaatattgatatactatacaattttttgtccttgaaatttttatataacatattacagtgatcttaatccatacaagagaacatcctcattcactttataactagataagcattctattacatcttgtatacaagttgagttttgttcgttgtgtttcatttatgggatacaaatccagcaggaatttacacacaagtcaataatgtccccaagaccatatgaaagatatgagacctcgatccttggcaggactgactgtccattgtaccatgttgttaaagtgactgaaggttattgacttactgcaataggagttagatatctgatttagttgagtatatccatttcaaaaggaaaacccaggacttttggtgtttaatcattttgtgaaccttaccttaaccctttcccattagattggacataaacaatgcttaatatcagtgactaatggtattagttcttcagcctggcggccaaacagagcagttcagaactaatcagcaagatacaatcagatagatgccagaggtgagggataatttttattttctctgttctgactctctggagtttcctctttgcagtaatttaggtcatgtctatatttactggatgaaagatttatctgttgaattctttaaatggtggcaccaactaaatctagttctttgcaacagactttagaaagattaatatgttctatgctttctaaaaaaggtagtatagataagacttgtccctttttatttgaagttagaatgaaagtaacatttttgaaaattaccattgtcttattgaaactcaataggtaagtatcgttctccctaacttgaaggttcagctaatattttgttgagaacttgcactttgccaggtactattttaagagccctacctgtattaactctttgagttcctataaggtaggtgatgatgttatccccattttatagaatgggggaactgagaagcagagaacttaaggacttgctcaagaaaacagcagaactaagatattgtaaagccagaattagaagcaaataaataacaacaaacaggacatttggctccagtgtcattactttctatggctaaatttatgcgacttctcagaggaaactctagttccagaagctcaaagtcatgtacctgcaaagtggtaaagccaggatttgaacccaaatctgacatcaaactctgtagttttattcactgtataaatagagagatatgattaaatatatgtattgatatataaatataggtaaatatatttgaaataggctatgtgattttgaagtgggtgaattttctcttgtgccgtctctgaaccggtgttagatttcttgaactgttttatgattccatgctatggttaactatgcaattacttctgcatagatgcccgaaaaaatctttacttaagatccattcaattcgtgtttcttcggtaaagtcttccctggccatgctttccccaacccggcatgcgtaacaagtcaagattatcagtcactccttgatgtcacttctgtgtcttcttttttttttttttggagatggagtttcgctcttgttgcccaggctggagtgcaatggcgtgatctcggctcgctgcaacctctgcctcccaggttcaagcgattctcctgtctcagcctctcgagtagctgggattacaggcacatgccaccacgcccagctaagttttgtatttttagtagagacgggttttcaccatgttggtcaggtttgtctcgaactcctgacctagtgatccacctgcctcggcctccccaagtgctgggattacaggcgtgagccacaacgcccagcaacttctgtatctttttacataacttagttaaggtacttaccaatacatgcatgccttttgttaatctgcaatacctttatataaaatatggtgacttaattttgtatccaaagtatgttacatgctatctgactcctggtatgcactcaattaaaaaatgtaggaagtctctgtgaatgtattctggttcgagggttgcctgattaaaaaaaaaaattaaaagtcaatgactctgacaccatcctacatttgtctaacttaatacgtcagtagctgtaatgaattagagctctataacttgaagaaatgtgatattgtttgataaagtaaatatagaataaaatctttgtacgtcgtttgttcagatgaacattttaaaaataataaatgacgtttatcctttgtccccatgtgtgaatcaagtctgtgatatctctaaactctggtactctgaaatatctcttcctgacctgctacttcacttcaatacactccttcactcccgcagagcttgctcttagcttcagcaggatctcttcctgttccatccagatgccctttcctagccttggtgctcccactcatcttctaaatgacagccagctcagactccattcacctttctagttcccccgagagagtctcaatcccatgtcaactcagttgttagctttcaccctgcacctctcagctcactgcatacaggcggagcatctgtctttttatccccagggagaagcaaaggtatttggattgccctaaaacactcagggaggacttaacggatagtcacttctaaagcactctttctgttccaaccctttcactgtgtgcctctgtgcagtagagaagtgagtctactaatattaatgtgtgaaacaaggaacacttatcaaagtagctgccatcagtgagccacctgaagtggaattttatttgtcttgtactcagcaccaaagcagaatatcttgctttttttggaagaaatcaaaataacacagattttactttggaagatgaaacacactagcatgtctcatctgttccttcttgatgatctgtcctcctggaagtatgacagtgttgacgtagatgtactgagttcatggaacacaagcctattatcgttcctctctgtcatatggaaagaggagaactgagagattgagaaaaaagttaaaacacagaggacccaagtgtaacgtcatgttaaaacatttttgaaattatgcaaagagaaataactatcaaaggagaagaatgaaaatcaatgagtaacaattaaaagacgggattttttttagaattcaaaaattaatagaattggtagtgctttattttcttatacaacatttatttagtgatatctaaacgttctttggctaaagtgcaccttctttttttctccctcttccctccctccctctctccctccttccctccctccctccttccctcccttccttccttccttccctccttccttccatcatcacaggtgtgagtgttacagagattatctcaatggttaatctgtataaagatgaatatttcctttatttctctccgctgattagcgctgtctcaaatggcaaatgttttaaaccctgatcttttgatgcacttcctgcagcctcaccccacccccaaactcaaagagagtaaaatcacagtgttcctttctctttctccccgtgaaactggcaaatccccaccactacccttgctaccccacccatcaccattcatttctaaagcagacatttagaataatcaggacagcattttggcagggcgcagtggctcacgcctgtaatcccagcactttgggaggcctaggcggggggatcacgaggtcaggagatcaagaccatcctggctaacacggtgaaaccccgtctctactaaaaatacaaaaaattagctggacgtggtggcacctgcctgttgtcccagctactccggaggctgaggcaggagaattgcttgaacccgggaggcggaggttgcaatgagccgagatcacgccactgcaccccagcctgggtgacagagggagactccatctaaaacaaacaaacaaacaaacaaagacaggattcttacacttcctgtttccatagaatctatagaaggtctaaagtacctaggatgccgtattagtccacaaagccatgatcagatttccagtctcttgagcctagcttagatcttcagaggcacaatgcaagacggtttttaacagagaaaatgtgcatgaaggaccttttaaattatagcttctaaactttcagcatcccttcaatgatttcatactctgactatttttgcatcttcctgacatttgcagttcccttgaggcatatattacagtacacacactacccatggttagataatcacaagtttagatatttgtgaatgtttcagctgtgaagaagaaaaatgacttcaggcaagggtacttgtgaacatcatcattgaaaatctcagaaaattccatttgcatatatccacatatgtgagcacttggttgattctcctcctttacttttgctactattttgttttgctttaggtcttcctttcttttcatttatttttaaaccagagtacatttatcctggacattttctgatgtttatggggggtgaggggctatgtgaaacttgatgccaattgacatgaaatctatttttctgaagagaaatttgaggtatctaggagaatgcattttcaatcccttctcaccattaacgtgtattaaatgcccaagctaagtttgtccttgatgtttgcagagaacctaaaatctctggagaaatcagatattttagggtcataccaacaaaggaacacatgaaaatgaaggttactcagaaacaagctttttaaagctgaggcataaatggcagagctgcccattgagtaaaatgttctgcaccgtaagagtgaaccggaaatggatagaaaaataaattaacatttaaaattatactttgtgtttaagaattgagaaaatttgataggccctgtaaaaaacaccattagaatgagaacattctaaattacatcgttgaaatagtagaaaacacatgtccttttttttttttttttaaaaagtctttttttaggtgttttaagtaattctctttttctttttcttcttcttttttgtaatttcaatagcttttggggtacaagttgtttttggttaaatggttgaattgtgtagcggcgaatcctgagattttagagcacctgtcatctgagtagtgtacgttgaacccagtatgtagtttttctccttcacccccttcccaacctctttcttctgagtctccaaaatccattttaccactccactctgtctgcctttgcatccccatagcttacctcccacttacaagtgagaacatacagtgtttggtttttcatttctgagttacttcacttcaaagaatggcttccgcctccatccatttgctgcaaaagacgctactttgttctttcttatggctgagtagtattccatggtgcatatataccacattttctttatccactcattagtcaataggcatttaggttgcttccatatctttggatttgtaaattgtgctgcaataaacatatgtgtgcaggtgtcaaaaaagatctatttgtaatgtttcattcctagttgccaacatgccaacaaaatacttttttttaatgacagagaacttaaaattgatgttgaatttctgtttttcttttgttactttttacaagtatctgcaagtttcttgctgctaggaagcataaaatagaaactatttgcatatgcatttaaaataacttctgacttatatcttattttcattaataaacttcagctacttcactggaaataattttattaccaccttgtatatagttgataagaaatgagactctagaacctcattagcatgtttccttagacacataatttaacctcaattttctcatctgtaaaatgaaaataataattgtgctttaactcaaaagccaaagtttagacacatactgcactgtaataggcatgatgttcaataatgaaatagctattattattattttgctatagagaaagatatataagtaacattaaaatttggaaacaagttttccatattttcctattaattaaaatatttatttttctcttttattgttttatatattttatgcttttatggtcattgcaggaatggaagtttaaggctcaaacttgcaataagtagagccagttttaattatttatgctgctgatactcaaagtttagttgaaattttaactagtttttggtttgtttaaactaattcaaagtttagttgaaatttaactattttttggtttgtttaagtccctaaaggtagatatattgattttaacctaaaagctgttaacttaggattctacactttgccatggaggaaaagaggttgactaagtgcctcctttgagaaacttaagatttaattaacatttttcctttccctctgcttcatccatacttcctttcaacaaaagagatttttcatcctttatgtactttctaatattccatagaggtttatcactttagttttcataaacttgcaaagatgatctcaaataaacggcttcaaaaataggacattaactgtatgtgtttaaggagggaagagattgtagttagaatacttaactaaatgagttctatcaaacattggagaagtactttagaaagagtttactaattgacaaatgtaaaatatgccgccctgaaaattttcagatgtagtatggtgtaaaatatgttcacaaataaacctaaaaagcatggtgagttttttcatatatactctttaaacatttggtcatgacaaatctatgtgatgtttgggtggagactagtgctcaattatttcccagaatgctaaaatctaaatgtatgccaaccgaaagtctttaaatcagatgtttattacttaaaactgaaataggttaacctttcctagatgctctgattaagcttagtcctcaatgactgatgtacactggcttacactaaagttattaacctaagaatcttcccagcaagtccatctctttcttgatattatgatctgtgaagtttgaacaaatgttgtttttcttcaatgttatttatctttaaaaaaagtccaggagtagaaagtattcctgatactcgataaaccagtcctctctgaacaaggaaataaatacctctctccaacttttagaaacaattgaatgacagccttctagtctcctattactgagaagattatgtgtggctttaagacacaaattgtaccttattagtctatatggccctctacccagtactttgcctgaaatataagtgatactcaatgaacgtcattttaacaaataagataataaattaatgagcagatatagacctttttaaaactcatatgacattttgcctgctccttatagagtcacaaagtatatataaataagatgtaattagaatttgtgttaatgagaatttaaaatattgtgatatagaaaatggctgtagactttatttacagacaagatactataaatttcccttcccccattgttacctctaaaaatttccatgatttcaaagctgttgagttcattgaactgttaattcttcctcggaggcagtgcaatctctgcaaaacaaaaacactctggctctgtggtttacaataaacttcaaatatgaagggttttttgtttgtttgttttgtttttgtttctgtttttgttttagacggagtctctctgttgcccaggctggagtgcagtggcatgatcttggctcactgcaacctccgcctccggagttcaaataattgtcctgcctcagcctcctgagtagctgggattactggtgcgcacaaccacacctggctaattgtttatatttttggtagagaggaggtttcattatgttggccaggctggtctcaaactcctgacttcttgatccgcccacctcggcttcccaaagtgctgggattacaggcgtgagccaccgcacctggcccaaatatggagtttatttgcttgttttaaaatatttattagagaataatgtgagtaattttagtcagtaatgtgcagttattttaaaattcaaaattattatcatttaaaatcttttcaatatcccattgtaatggtacccaagcgacatttttgtgtggtagtgtatagatctagaacatttatctgaagataaataactttgaaacagagtttaacaatgattcaaagcttgggaaaagcctaaacattcatcctgatatatccgaggaagtccttcctctagaaatcttttacacctattcctatggaaaacttagcttgaattatacaagtttttcattctgtgaggtctttgggatgaattcctcaagtgaaatgagacacctccattgataaccctctcagttacatgaagttcctgccgcacagtaagacattgtatgttttcctgccttaagtaaagacactttgttgcagaatttaggtaacttactcaaaaccctcagacacgtgagtgacagagcctagaacacagttatcctaacactcgatccaggaatgtttctatcacatcacttctaatcctaaatctaaaagtgaaatctaacaatagcaaccaccacaagaaagagaaataaaaacatgaaatattgtcatgtaagtcaatttgtaatgatatttatgttttactattctaataataactaatgcatattgagtatttcctaatgaaggtaaaatgcaggtaatatgcttaacagtacatccactgcgtactgtgctaagtattttacctgcattttattactttatctttatgggaaccatcagaagtgcatattaatattatctcattttacaagtgataaaaataggactttaaaaagttcaataactttcctagctattagatgtcctgactagatctgacttcagagcttgttcttataacccatctatgattccaatttacagtatcttcaggactaaagtaaattgttaatgtttaacactttaaaaaaagataccagtggaacacttgattttctaaagcacacagagaattttcttttagcacgttaggtatagaatgtaatacatttaactgtaattcagactgtgaaaattaaattatagaaaccttgtagcagcatttctttgagtgttacatcaggtacatttcagttaatatttgaggattacaagatattttattaaaatatgtttttctaactgttaaaactcagagttaattattttttcagccaggtaatttttttttttttttttgaaatagagcctcgctccgtcacccaggctgaagtgcaatggtgtgatcttgtctcactgcaacctctgcctcccaggttaaagtgattctcgtgcctcggcctccggagtagctgggattacaggcgcccaccaccacactaggctaatttttgtatttttggtagagacaaggtttcaccaggttggccaggctggtctctaacttctgacctcagatgacccacctgccttggcctcccaaagtgctgggattataggcatgaaccactgcgcccagccgataatttttttataaattagttctgcttgatcaaacaggaaaagcttgaaggtcagagtttgaagtatttctgacttatttatgaaaatgagagaaaaagaatgctcttgtcttgatgaaagccttattaagccgctcacattcccaaatttgggatgttagagtgaaatcttcagcctcggccccattcatgaaaaatcttggaagcaagtagtgatttctcaaactgtgatgccacccatttttacaccaaatatcagtgtttctgggactatcatgcccctggtgggtgtgtgatttagaatgctaatgagcgttggcagaccaccgtagctcctgctgtaatcctcacactttgggaagctgaggcaggaggattgcctcaggccaggagttcaagaacaacctggccaacatagggaaaccccgtctctcaaaaaaaaaaaaaaaatgaaaaaaagaaagaaagagaagaaaaaaagaacatctaatgaaatcctaggagaaacctaggtcgaatcaagcaccatgttgggtccagttggtcttaggtcgcttgacctacaccctggattttcagggtcttatcagtccctagcttctgcagctatttgaagtttccttttgatagtcatgtgaaactgctgcctgaaattttctgatctcctgcgatcaccctgtattatttctgtctcaaaaggaaaataaagcttgagaccccaattcactctaccaaaagaaaaaaaaaaaagctgaaagctgagtcgtacaagaatccgcctttccttttgttcctaagcagatagctacaggcagaaggttaaatatccccacaggtagctactctatgttcatcttatcttatgtaaagtgtcagtttactgagctccagaaaaatacataattgactattgccctagctgctccttttgttctgcaccttgtagattcagtaatgtggccataccattcttcattcacctccatcctgcttttccccttcaaatatcgaagccgtctaaatcatccttagagaaaggctcagacttctcttttaggcattgtccttaaccttggcaaaataaacttccaaattgatcaagaaaaaagaaaaaaaaatgagtttcgcttgtcccaccatttacccctgccgagtggtcagatatttgtagcaaatttagttatactctcttaatatctataagcaatccaaactccattctcatagattcacacatacacacacacacacacacacacacacacacaagcagtttttttgtaaaggtactattttgttaaaatgtgaaaggatgcagggttatcttttcaatgtatattcaacaaatgaaaagatttttggcaccaggcatggtggctcacacctatagtcccaattactcaggaggctggggctggacaatcacttaagcccaaggagatggaagctacagtaagccctagtcatatcattgcattctagcctaggcaacagagtgaaaccttgtctctaaaaacaaacaaacaaacaaatgaaaaactatgttgggatcttcccttttgttcttctcgctccttctcttctttccccacctctttatttctctactttcttcttttttaaagtttgtttttggcatttctcaaattattttaaaaattaaaggcatccttattgtaattttctaatgtttttaatttttattctgtgttgtatatatttaaggtgatacaacatgatatttttatgacttctctcacaattaatatcaagttccagtttgtggtgtgaaggaatgatgtgtttcaagtattttatcatggatcttcaatttgtggccttttactaccatagtaaattgactgtaaattagaaaggaaccttaatacaccaataaaatctataaaaaatttgtctgaaagagccatgtctctaaagacaatttttaaatagagacaagatgtagcattttaatacatagaatgtaaagtaaattcagagtttacgtcagaggggtttttctgatttatttatttatctattttgttgttgttgttgagacagagtttcactcttgttgcccaggctggagtgcaatagcacaatcttggctcacctcaaccttcacttactgggttcaagcgattctcctgcctcagcctcccgagtagctgggattacagccgcccgccaccatgcctggttaattttgtgtttttagtagagacagggttttaccatgttggtcatgctggtcttgaactccggacctcaggtgatccaaccaccttggcctcccaaagtgctgggattacacgtgtgagccaccacgccaggccttatttatttttttaacccactttcttcctccatagatgtatggtgatgatagagtgcccacttgctgactgtgcctatgtgtatttaaataatttaaaatttaaaaaaaaatccagttcctcatttgtactagccacattttaactgttcagtagccccatgcgggcttgtggctactttattaggcaccacagacataaaagatttccatgatcatgcagtgttctattggacagtgccacacaacatactttggtatttaaccaggaaagtcagcagtattgcagaactgtgtgggttcaagccaatgttgtttaagggtcaacagtatttatattttatatttatatatttcttacatttatatttactttatcttctttcctttttttcttcttcttccctttttccttcctcccttctttccttcatgtcttttcttcatgtctttctcccttttttatttttaatttctttgtaatttctctttttgaccgagttcattaacttttttttaaaaaaaagaactatttcagcaagaccatgacattggctcacccactttgtattcatttaggagtgtgtctgttttctcacccccacctggtatggttgctaaatccagatgaggataaagagcacagatgttctcctccactgtgtggaagcctaggctacactcttgccttatacttgatcatgtcaaacgcattcactagaaagggatacaaagaagattctaagattgtgattttacctataagtgtatttaaacagcagcaacctatgtccagaagagaggaaacagattttccaaatatcagtcttgggcctgggtcattatggggaagtgggatcaatgagatgaaggtggtaagatccatgtccttaaggccagtccttccgccccttcttccaccttaaccacgcagcttagattgcaacccagattcctattttactcgacctgtaggtaacctgtaaattggttactctcctcctggaaaatctaaagttgttatatgagaaaaagttccagtcaagtactctggtgtttttcttgatgtatggcatcttacacagtttggctgtgtccccaaccaaatctcatcttgaactgtagcttccacaattcccacgtgtcatgggaggcacctagcagaaggtaattgaatcacggggatgggtctttcccatgttgctcttgtgatagtgaataagtctgatgagatctgatgggtttatagagggaagtttccctacataatctctctcgcctgccaccatataaggtatcccttgctcttctgccataactgtgaggactccccagccatatggagctatgagtccattaaacctctttcctttctaaattacccagtctctggtaagtctttattagcagcgtgataacagataataaagcaactatgatcaaaatgtaatatgaaaaaaatgaacattatatttttaaatagcatgtgtgccacttacattttaaaaacattcagtgatcgagattatccattattcctgtaaaccctgcactcattatacacagtgtctgaagtgttaatagttcttattggaatcattgccctgctgagttcccaacatcccaacaattcagcacatctcaccagtctctttctctctttcagcttgcaggtaagcgaatgaaagttttccctcccttccctatgccttctggatgtgtttcagtccctttgaatttcagacctgccttcattttagacactcttctgagtgctgaatgccacagtttgaagttcactgcatccccctcaaaaggcattaattccactcccaggttctttctctctgttggacaccaagggtctatgattttggaggagaatattttattatattaatgtatttacaatgccaagtattgtacaagtttagaaaggaagaagaagacaaaacactttcctaaaaaattgcttataacctgcagtattcaaagtcaagttttcattagaaacctttgaaatttgcattatagtataatttataaacatcaaaacaaaaagcttttttaagaaatttttttgagacagggtctcactctgtagcccaggctggagtacagtgacacaatcacggctcactgcagcctcaacctccccacctcaagctgtcgtcccaactcaacccccaagtagcttggactacaggtgcacacctgtagtccacctgtagtccagcaagggacgtcttacatggcaacaggcaagagagagcttgtgtaggggaactctcctttataaaaccatcagacatggttttatagcatggcaaagacctgcccccatgattcaattaactcccactgagtctctctcttatgacacatggaaattatgggagctacaattcaaaataagatttgggtggggacacagccaaaccgtgtaagatgccatacctcatgaaaaacaccagataatttttttgttggaattttagtagagacgaggcctcattatgttgcccaggctggtcttgaactcctgatctcacatgatcctcccagctcggcctttccaaagtgctggcattataagcatgagccaccattcctggccgaaagcattctttttttgtaaagtgatgtactttagatggtttggatcctctcttttactgtcatctattttccacatgctttctaatcccttgagacttaatatttaaaaatcctaattttagccaggccatgcataacagatctgtggaagaaactgcattgtgaaataagacctgtcaaagcaacaatatttaagggcagctttgatgtcaaattgaaggctggcattttagtttggaagtatattcatctattctttgacttcataaattatatttagactactagtggctacaataatgaaattactgtggattgtaaacatgaggtattgctactgtggtctaccatgtatccttaatcgactcagtttttaaattgctaaaattcaacctatttgactctgtcagaagagctttaatgttcttcatttgtgcaaactttgtttctgtcacccttgacaaatcctaatagggattaatttagttacgggtgacaggataagctgcaacggcaaccctgcattctgccatggatccaaactagttgtgagctctgtttttcttgctgcaggcagaaagtttgctgaatctacaatggacaccacaatgcctgactctcgtttccatctcttacttgttcttgtttaacataacctcgttcttgtgtggcccaatttaaaattatatattgtggaggtatttgcaattgcagtaataaatatgtgttctacacttttttaatcacttgccagtctgcattagccttttaattattaataaagtgaaatccattgatttcctccagttgttcgaacatgagtctgacctaatcctgcctcaggcttgaggggttctgagatgaacagcaaatccttgagctaaacattaattttgtgggatttaaacatagtactatttttttattcctaacagaagctatttctttgtcttttttcttctgaatttgcagaagtattatgaactttggtctgttccgtgttatacatacgaaacaaatcttgaacaaaacaagtttgtgatgccactaaaatttgacctttcttattattttgtgctgatattagaagttttatcattgatgctcataaaattgtaggttcagaagactgtaatcacattttaaatttaagttgagcaccagtcattactacatcatttttgtctttctgtgttaggaagagctctgttttcctggttatattttaaaccatatttaagaataaatttgcatttattgaaaattttcttaatgaaatctcattttctattttctttgtttattgatataatatcaattaacatatttttattctgtctgcctatagaaattgaataatgtatcaatttctcttctcaatgtccttttacctgcaaaggtgtggtaagcaggatgaaaggttgcttttgaacagaaatttatatttggtctgatttacctattttcttttggaaaaacacagtttagagctttagcagctggtgaacagcattaactaaaacttccggaagacaaagcatcataagtataaatggtctatctcattgtatatgctaaaatgttgtttttcaaggacagaagaaaagttacctatgataacagtaccacaaaatgactagcacagagtaagttacttatatatgtgaatgaattaactattatattttatatatagttaatagtatagtataattataatatatagtaatatataatatatttatactgaacatcaaacaatgtttaattataacaactactttgcaaagacaacttcacatagttcaggatattcatatttatataaagtttattaaagttattacattctgcacaggctgatccccaagtcatatattattagtcaacagtcattatttgctattcatatactagctgttgaatatttaactcaatcaatgtggttgtttcttacaatgaaatctggagttcttttcttacttaaaaaagattgcagaatattatatatatggtaatttattaaaatataaactagactttatcaaacttagagttaattgtaatatttacaattggaagctgagaaatggaagattacaagtgcttatttgaccaaacagtggcaacagattttgtttttatgtgtgcggcctctccttatagagtgaaccctcataactgcttctaatcccaaatctcagggaatttgtttccaacaccataacagtctttcaaaagcaacggtgattatagtaacttcaaagcggcaagcatctgtactttaagaagggccagtggaagctagcatccatcttccataaaaaagcaatcgtgcttttccctgctgccacttagaagagcttccttggggaccttgttagatgctttcatgtgaagaccatttgacccatttctgattagtgtgcaggttttcatggcagtggcttctgggagggagatgccgttggctggtcgcctccctattcttgaagtgaaaagaaaactctcagtggaatatattaaggataataaagggaagaaaaaattccagttaaaagactggtgaagtattgaactactattaaaaaaaactaatgaaaacgtatttctatactgactgttaagaagaaagcagagccagtatcacagttccttgttttgtgctcagatgagttttgcgtcttcatttctctttcttgcaatatttcagaaatatgtagtttgagaatgcaaagaataaatgactttagctcatttcacctttattttgtcagttttcttttacctgaatcatcatgtctacatttaaaataacagtaaacaagtctttataagtaacaggaaagataaccaagaatgcctgcattgttaatgctgtaataattgtcatcatagcttttttagcctcatttaccttacctatcttcactccaccaaattcactgtttcatatgatattcatatcagcaatactgttggtatcaagatatcgacaagcttctaaccgtactacattattttttaactttaatgccaattcttcactaataactattattcaatatagaattattttaagatcctgcttgcctaaataggcccagtatttctccatttctcatattaacagagtgtttacattcacagactcaaactatgaaggaaatgattccttagtagtttctcttgctatttgaattttatttgtatagatgcataacggaagagttcagagcgtaatgcagtatttgctattttctaccctccctcctccatataggattgccacagtctaatttcctattatgatagattgattttaatgtagtagattgcaaacactgtgttcaagcattcttatttttaatttctcctgcttcatccctttaaaaaccacagctgttactaggataacaaaaataatgttgaataactgcttacttttccgctttcccggaggggtgggggaacagcaggtagcatagcctcatccccaaacagatgttactttattaaaaattgagtgttttggagggagtagaaggagatttatgctttaggagagcagtgaaattagaaggagtcagaatatgatatggaccaattcagcttttaaattcaagctttgcttgtattttattgatagcattttaattgaattgtattttagatgtgtttggattaatcgaatgcccaaggtccagcctgatattaagtaattgctatcataattagtcaactcaacaagtttttctagactcttcatataaaattgcactggataagttctgtagtagatctaaatgtaatcgtgtatgatacaattcttcttttatgagagtttaactgataataacactttactaaattatttattaccagaatttttaagggaatttaatatgcgatgcatgatacattgctctttatttaaatgtatttcactatacatttgttggattacattttgcatagcgtcttgtatacttctttaaggcatgaatgagccatagctttgaaagtccttttgttttgttagagaattcagacctgcccccctttttttttaacttaattgtggaagcattctgaaatttcaactgctaggaaatcgttctgcaataacttaatctttttgatatccaaataaccaataaaattatatattttcaaatgagtttttaaaattatatccaagaaacttaaaaaaaaaaagaaaagcactagccattctcacttgcatccatccatccctgagttaaaattctgaggattattatctcacctcctatttggacctgctttctaggttactatttgtttctatatacaagattaagataaattatggtaatatgcatatttccaatgccattgaaacaaaggatttataatttgtagaaaaactagaaaaatcagtcaaaatttcaaaactaggcagtctgtaatacacttcaaataaatttatttctttctgtatttttcagttgtttctctttgaaataatcaaattattaaaagcattctaatcaccttgcaatcacaatgtagagacaaaagagtgaatacgtgaaacactgatcttcacaattattgtgaacttaagctgtcgtactcttgtagttactgtgaccatcagcaactgaggacaattatgcagaatcattaaattttagttatagtacttaattaaacacttgcaattttttgaaggtgttggtatctattaagttttttgtttctacaatgctaaatatcttctagacataatcatcatattagaccctgtcatggttagattgctgttattaaatgtctcagtcatgaaagtctgtcaactgccaatgaggatggagagttcaaatcttgcaattagtcagtcagcaaaagtacattcagttgtttttcttaatcttgtcagtgtcattttatatcattaggtaaaccaagaaaaggaaggcacttatgtgggcaatttattccgtgatactatgaacctataagtagaacaattattgtttttcatttgtgaggttaatagaaacttcatcctttgaggtccatagtaaaagcgaatgcattcagaaaactatgacacgtttagattaaatataaatatatgttaaaattttcagattacaaatacttaaaggatatttaaaggtgtcacatctgaatttcaggaaactgtgtgagtattacacatatcattagattatccagtttttccaagcaaatattcagtgttattgtagaaataagtcaagtttctggggaaaaaattgctctctcacccaaaagaaagtccgtctgttcatattcgggaactgtaggtaactaaaagtcttagtcagtgagactgatcatggcttgttcatttgttgcaccctaccaaaaaagagattctgtgaaatcaaactacatcaaaactttcacagtggaaactcctttatggtttctagaattctcattgtaaaccccttaaaccagccatacctgacagcaataatcagagatatttgtttctatagtgaagtagaaatgcatcctctagaacaatcccgtcttcatgagtcccatcataacatgtgctcttacctagaaggctctgtctctcttctggttggcagcccaggttggagatgaagccttgtaagtgtgaatgcgattagttactttcattaaaagatcctcagtaagaaacctcttgatgccctcctgtgtatttactagcatcatcacttggcaaaaatgtatatctttcttttggcaaatgtgtgtgtgtatgctatcttcctgtaaataagtgcctataaatgttcaatagtattcataaaatgttcattgcaacaaattggtgtataaattgcatttatctttttaatagttttctgaagaatttccatttacttagtgcaaactatataatttttgttttgtaaaatttctgaaatgttcttcctagctttgtactgagttctcaatttgtctgcaaaaccgtttatttactaaatattagtaattgatgctacttaaagaaaaattaggagcaacaaagaaaaagaagagacataaaaataaagataatttttaaaccactattaatcctagtacttaaatgaaatgtctttaacatttagatgtattgttttctgaacatgaggaataatataacacagagaacattataggtcttttagaatgtatgtattatattttatatatgaatgaaatacactaatattcactacaataatgagataactaggatcattttaaagccaattatatgagcttctgggtttaattgagctttagacatctaagtcttttgtaaactcttttgatgcaggaaaaccaaaagagaggatttcagggaacatgcgggagggagtgagttagtttggaatgttagcttggtggagagaagggagtgttagaactgatgaagcaggttgtgggaagccaagatgccaagctgaggagtttcttctttattttattaactttgccagtgatattgttttgttcttgaaacaatcagagagatacaatcagagagaaacagggagactgaatgtagtagaattctcattgtatattttgtgccatgtaaaattacttacatggaaaaaaatcatttcctttggtaaagggctttctcttgctcaggtttactgataacctggatttttactaggcctcttttttctttgtattttaatttattttttttagagacagtctcactctcccgccctggctggagtgtaatggcatgatcatggctcactgcaacctggatttcctgggctcaagtgatccttccatctcatcctccctagttgctgggactgcaggcatacatcacctcccccagctaatttttgtattttttttggtagagagcggggtttcaccatgttgtccaggctggtgttgaactcttgagccaaaatatccacctgcctcagcctcccaaagtgctgggactacaggcatgagctaccatgcctgaccattactagctatctttttaacttatttaaagtcaagtcttgtaaaatagcctggagttaatagaagttatttttttttccttctaaaagtgatacagtcaaggtcctgtttcagaaattagcaaaattggttattgtcttttagcagttggttccttatacaagcctttgagaattcctttgaaaagataaatcaaattgccaagtttgattttttaaaaatatattttccttctttcagttctcattagatatagatttcaagaaaatacttggggcagtaaatgattctagaaaggcacttaaaacagttaactactaaaatagcctatttacatgctttgagtgaatgataaagagaattaagtttatttttgtcacattaattcccttcatatctagagctctccagaaaagctctgcagataggatgcccaatgcacatattccttggtgacaagtagtcaggataagttttatggaagtttcctaggaatctttttttctttttacaatacttggcttagtaaatcaatatttttgtttgggtttctgtttaaatcacaattcagtacagcttcagccactgaatcaagatgtgaaatccatgtactgtggcacacatttcaaattgtgtgttttaaagcctcaatctaagcaaattctaaattcctatgttttttgaggatggaatggtaccttaatgaccataacatgtggttagaccatatatctagaagtaaattgatttaattggtcatgataaggacttatatagtacttaatggtaatagatatagagttcgtgcagtctccttagggttagaattcacatggtgcctgtgtatggatccagatctatgcataactagctagccaggaagcaagctatctctatcttttaaaaacatttacacctatctaaagtagaaacttgtattatctttggaaaactgaggccccagaaaccctaagtaacctgcctaactcacacagctctaggagtcatggtgattccactgaaacccatcagcttgacactatgatgcaggttgaaatctgcagtgcgttgccttgggctaggttaatctgcccagagaggtattttgctgtgagtggattgtataggaaaagggtttgtgtggccagacagcagagaggaaatggatgaggaggcagagaaaatgatgaagctagtaatgaaagcattgacattgattaaattccacttcttagaattgtcactgattaaccatgtagcttagcattttatttaaaaattttccttatttctggcccaggatgccatgagtccaaggatttaggctttaaaaatgatagggttagctcaaaaggaaatggataggttgtgaattatctgacttggtgaattctaatcagacaaacagagctattaaaatgtttcaataacttttagggcattttcaaaaattagtagttaatatttctgaatggtactgctttcttttctgtaggctttatcaactattgatcatgtgaaatcaaccgtggattcttctggagtcttttggggggccttttaaagtaaatcagacattggaacacatagttctaagaaggagccagtacgttcactttagacattagaaattatccaacacattcggttcgtttaagtgtataaccgtacaagtaattgttttaacatatttaatttccatatttgttttaattaagaaattgtgttcaactttttcttctgagtcacacttctttgattgtttttatgattgccttgtaatcgttcaagaatcccttttatattggttagtatggggctaattatgcattcgcgagtgagctaaatgcagatgtagttaattctcacatctactccatgaggtaggtattaagatcttcacttcagagacgaggaaaactgagatagagcctggttaagtgagttgttaaaattctatacctagtgagtggcaaagtttaattacaattcaatgtttttctactacaaaattgatcttgttaatcctattccttattctgttcgaagtcagttttaacattatgcatacaatttttgtgttcttttctacctttcctgggagggttcttgcaagaataaaaacatagggttgtgtggcatttccggattgtttccacgattcttggttatttcctccatagaagccatgaacatagaggatacaaaagcattgtagaaagaagtaaatctgtcaagaaatgtcatgcctttgtttagattacttcctcatcagtccttgcagtttattgaaaaatcctgctctgggtggattgactatgagcttacattttattttatttctgctggtcatgtactactgcagagttgtttgtatttaaaaaaaaaaaaactcaaagaggggatttcaatccttaaaaggcaagaggattttgtttatctttctagaattcatgcagtgttgaatccaagtctcttctttacagctatattttaaactttttcaaggcagggacagtgtatttttatgtgaattttcatatacgctagatgcaactcagaattttatgaaatgcttcttgaattagattttgcactgtacattttgaagactatcctacctctttaaacagggagatacagaagtaaacctattgggctggtaaaaagggtatgcacttgaaaacttggtggcctttagaaagcattgagatattggactgagcacatcaagggacatattctgtgaaatcgttacagtagccagctagtcagatatgagcagagcaggagagtaccctccccacaacacacacaccaggaatgtcaggcagccatcaggcgatggtcaggcatttgttaccggcttctttaaaataataattggttatatacccaataatgggattgctgggtcaaatggtatttatggttctagatccttgaggaatcaccacactgtcatccacaatggttgaactaatttacactcctaccaaaagtgtaaaagcattcctgtttctccacaatcctctccagcatctgtatatacccaaaggattagaaaccattctactataaagaaacatgcacacatatgtttattgcagcactattcacaatagtaaagacttgcaaccaacccaaatgcccatcaatgatagactggataaagaaaatgttgcatatatacaccatgaaatactatgcaaccatataaaaggatgagttcatgtcctttgcagggatatggatgaacctggaaaccattattctcagcaaactaacacaggaaaagaaaaccagaaatcaaacaccacatgttctcactcttaagtggggattgaataatgataacacatggacacagggaggggaacatcacacaccggggcctgtctggagtggggtctaggggagggatagcattaggagaaatacctaatgtaggtgataggttgatgggtgcaacaaaccacaatggcacgtgtatacctatgtaacaaaactgcatattctgcacgtgtgtcccagaacttaaagtataataaaaaaaattaaaaataaaataaaataataattggttgcagcccatgtcagggaaaggcaatctcccagtaaacagaaacacctgaaaccggtgatcagaaacttctgaatatctcaggagttgggtgaatgggctcaactatgtgcactaaaaggcaaaatggcagagtttaactggtatatgaccttctatggacatttgactgttaacggaagaatgcctcaagtgagcgtgtgtacaactccagtaaacacagtgcacacgctcccctcccaagtgctagcaggccactgtgcatgagggcagcccaccatagggaagaatcaggagagaagggatgcaaggcctcagaagtacgccggcacacgaaatcctgagttaaaaggtcaaaccacgcacttgatctcccaagtcgcccacttggccctcttacaagtgtactttactttctttcattcctgctctaaaggtttctaataaacttttactcctactctaaagcttccctgagactctccttctgccttatgcccctcagttgaattcctatttctgaggaggcaagaattgaggttgctacagacccgtacagatacattccaccaccaggaacagaattagtaagcaatgatagaccaaacatttttcaattaattaattagttaattataactgacaaaattatgtatttgtggtgtaccacatgttttaaaatatatatacatgtggaatggctaaaccaagctagttaacatgtgcattgtctcacatatttatcatttctttatggtgagaacacttaaaatctactttcagcgatgttcaagtgtacaatacattaactatggtcactatactgtacaacccatctattgaacttattcttctatctagctaaaattttgaaacctctgaccaacatttccccaatttctctcacaccccagcttctgttaaccaccattctactctctgcatctatgacttccactgtttagagtccatgtgtaagtgagatcacacagcatttgtctttctgagtctggcttctttcacttaacctaatggtctccagattcatccatgctgccatgaatgacaggatgcccttgttttttaaagtctgaatagttatttcagtgtgtgtgtgtgtgtgtgtgtgtgtgtgtgtgtgtgtgtgtgtatttttttttttatccattcatttattaacatttaggttgattctttatcttggttattgtgaataatgctgcaatgaacattagagtgcagatatctctttggtatagtgattttgtgattttgtttccttttaaatatatacccagtcatgggattgttggatcatatggaacatttctatgtaccaaacatttcaatggagtaataaatcaagatgaaaaaagtggagtttgaatcagaccaatggagagagttttttttttaagttggcactctgttctcaagcctgaattgcttggaataggtcacttttccaaattggcactaggctcgaaaatggttggttttcaagttggcatttgctgaaataaaacactagcaccagcatccagttaaaggtacacaaataccatagttattttttattatgaggaaagaattggggaataataattcctcataacactgaggctgcaaaaatgttatatgacagtctctatatataataactcatggattcttggtttttaaataagcatagggcatggggaaattattaaaatagagcaaagccttatggaatataatatctcatgtgtaagtttatgtacacagcccctctatataaacattaagtgtgtgtgtatttgtaggatgtaaggaggcaaaatcatctcttagttgtgtttatatgaaacagataatttcatgattacattttttcttctgtgtcacttgcagtatgtcttctaacagttgttggacaactagctcagacattttaagagcctacagatgtcattattaaacttagtaatcagtctagaaataaacacacaaataacaaaggatcataaaggtcagcagtatggcaaggcataaacatggaattctagaacttgtttttattatgaaaagatgtattttgcagttcaaagcatgtcattctttgcatatgttcaactgaaatatgaaagaaggaaaattccctccaaatgactaaggtaacgttttacaggggacatatggatattcttagaatttaatgggggataggggaacttacctggaatcaattataggaaatttggcaaaatggaagtaaaatattcatttgctttgcttgttataattacgtttgttataagctttttaaaaatccaaaagaataaaatgaaagtaatttcaatcaatgggaattaattgtgttcaaataatagcatgacaaaagagacattggaactgattttgaataatagatttcaatatgtgctgagtaaagctctagggctgatgtcttctcttgtctgaaattttctaatactctccccaactgatgttgtttctcccatgtcttgtgttccttgaacatgcacttccctgaaagcaaaaatcacagaattgtttgtttacctacctatcccacgagactatgagtttcttggaagcagtgatctctcttacaaaacacttttggatcttcagttatttttaacacatcatgaacttcctatttcatgtatagtattgctagctcagggctgagagagcacaataaaggatgaataagaacttacaactaaatggacaaataaataaatgagtgaatatgatagtgtatgaatgttgcactgatatttacttattttgatttgatacatttcattgtaaacagtaaaaatgtagagaatattcttctctgtaaaaataaaatagtattttagagctttctttgtaaaatatatgtaatttatttaaacattacagatgtatttgattcaccaaaaaattaaaaatatcatagtaccattcatatctatcttcatattctaattatgattaagttttaaatagcagttatgtctttaaagtgaatgtgtgttatgttctgccctaaatataacttaacattgcaggtagaactctagtgtttgaaaatgtttagaagtcagaattgcaattactgagtgtgggataaatattagctataaatataattatgtataaatataatgaatataaatattagttataaaaagtataagcctcttccaactcttaatgtttataagtctactaaaaaattaaagatttctaatagtttaggagttgggagggaaaaaggaaaaaccacaaacaatgatgttggaatgcaagaaatataatttgatagtgcagaggtgagcaaaaaggtctgttgggccaaattcagcaaaattcaatgcagaaaatatttactatctgacccattgaagaaaatgtttgctgatccctgtatgtcatgaaaagataaacgtgaatttgatttgaatggcaaaaagtagaggtatgaagtaaaatgcatatagtccaaaatgtatatagtctccacagagccataaagatactccctgagactgcacaatttataaagaaaggaggtttaattgactcacagttctgcatggctgtggaggcctcaggaaacttacagtcatggcagaaggtgaagggaaagcaaggcacagccttacatggctgcaggcaagagaggaagcgaaggggaagagcttcttcaaaagcactttaaaagcatcagctctcctgagaactcactcactcactgtcatgagacgagcatgggggaaaccacccccataatccggtcacctcccagcatgtcccttccttgatatatgggattataattcgagatgagatttgggtggggacacagagtcaaaccatatcatagggatttctccagaatatttgtgttgtgatgctatcttacgtacttatttttaccttttaaataaaaattggagtgaaaatggcagagtcagaaattaatggatcaattatttttttgtttgtatcaaagtttgagataataaagataaatattttatcaacatggccttattaatactgtatattcaatgcaaaaggagtgctgactggaaaacaatttcaattagtaatacttattaattggatgctaagcctaattctgtccttgttttattttttttcccaagatattaaaatatatttacctataagttgaaaagtaaaaatatgactgcaggtggctcattttgttttcacatattttgaaagttctaggctatggtgcccctttttgtccccacttcatgctttcccatttctcggagacaagtcacaatttctaactatttttgctctttgaattattttatgcttctttgtagcaatgtgaggcttggaagaaaatgtacagtacatgactttctcaaagtttacattttaaatttaacacattggaccttgcatttcgagttcaggttgcactaatgagatttctttatgagcaaagacaggagaaatgtttaacgtttttaatagctgtaactctttttatatatagatatagggtcttgctatgtttcccaggctggtcttaaactcctgggctcaagcaaacctgctgccttggcctcccaaagtgctggaattacaagagtgaaccacccaggcaataattcttttttatgtttgtggatatatatctatcctaagtgacaaaggaatggacagtattcacattgcctcatgctttcaaagaatatatggtgcagggacatctagaaaatgggcttttggtggattaaaagaaagtcatgagtgggttggccaaatgatttctaaaaaaaaatcaactctagagtagttttctctaagccttttagaatcgtttctttagatatttatatgatcttataaacaaatatcataaaattatggttccaatttactgacacattgccttgctggaaatgtggtttcatgccaagaacaaatatgaaaaatgtagcaaagctaattacagtacaacatgtgtccatcatttgatcttttggaggagttaagggaaattcaaaagaaaaattatcatgtgcaaataaagagagcttagctatcttgcctactggcctaaggtttctccatcactcctgcagcgtttactttatgtatcaggagttaattaaggtgaaacatgaggtaattagggctaatcctcccagcctcctgctggcttgttgcctcccaggctattgcctaaaccaaactatgttcgcagttttaaaaaataatgctcgtgtttattttagacattactcttaacttttaaagttgccttattcattttaaataggactttccatggaaaaagtataaagaatgatcaaactttagttttgatttaaaaagtaaaacaagactcattaatatataggtggtcattgacagaattgtaagtttacacttgttcactttacgtgttactaacagatttaataaaatttgcattagtataaatctttagctttgattatgctggaaaggtgcatgcacttcccaagaaaataatatttcttatacagatttctcaatatattatgcatttggatgtgtatcagggtaattggagggaggatcagagaacaaaaacaaaaaaaaaaataaacaaacaaaaaaaccttccatgaactgcatttaggtattttatctttgaggaacattctaacttttagatttcactaaatagatctggtaagtagtgactgatttattctccttaaaataaatacatcgcttgtgtcaaatatttttaattccacactaaattgtttgtgcgtgtgtatgtgtcgtttatattttcactttttcaatgaaagtaaagaataaaaaggttttctatccttgttgtttctctaagttgaaataaaagcatgtgcttttttattaccctagtcttataatttaccaatcataatagaatctgtactcttgccaaagacatttcattaggatgtgaagactttagaattgacaccccctcacatattaattaaaaagcaaattgcaggtaagcagtcatgacatttataaaagggggaacttacatgggtaaaatctcttttgttgttttttataatatactatcaggactgggactaataattctattataaatttgatttggggagatgtttgttttcccaattgctatcaaaatttgacttttatttagcctacattgacttcttctgttccatctttttatttatttgtctgttttattatttttttagagacagggtttcactctgtggcacagtctggattgcagtggcttgatgatagctggctgcagcctcccttaatctcctgggatcaagggatcttcctgcctcagcctcttgcatagctggggctacaggcattcaccactgtggctggctaattttttaagttttaaaattttttatagaggtaggtccttgctttgttgcccaggctagtctcaaactcatggcttcaagtgatcctcttgcctcgtcctcccaaagtgctgaaattacaggtgtgagccatcatacctggaatccatcttttatatgtactcttaaaagaattgtttatgctagcatcttgaaatacatacatatatatatgtatatatatatatatatatagtcttttactgaggttaaaatcatttttttgcagagtaaaccagtaaagattgcagaacaattatattgcaacaagttgctaattcatagtttctgcttgagactctaaagcagttaatatttacattgttagatgtgtggccaaatcatgaacttttatttagtaggcgatttcataacctccaaatgtctgaatcttactctttttgtattgtattgaggaaaaaaatgatcattttgattctataggctttaaaattaaatcaaactctaggtagcattgtttgggttatttagtgaatttaatgttgattctttaaaaatagaagtggggcttttctcctgcaaaattgccaagagagcatttgcaccatggcatttaagaatatatcagttgagattttctattgatcccagctggggggatgagtgccccgagagaatacatgcgccggctttatgagggtccctgtcatcaaggatttagctgtttcatttacagattcctgtaaatgttcaccagatccatgaccagtaattttcactggagaaggactggaccgtgggtaagcaaatgactctttgtcattaatggtttcaagtagcattaaaaatgttctggcagctcagttgattttgatgaagctatgaagcccaactgcaatgtgtatctagctcatatttccaattataagaccaaggaaagaatcaaagtgaataatatgtaacgtacacacatacacacacaccctaattttgattacatagcttttcctgtatagagatttaacttgaagtctacagatgttcacatttagcacagcacaataaaaatacaagtaaaacagaaactactttttatgtaattaaatttatatctgctaatgttcacttccttaattgggttatctcctaagtgatcagtaaattgcatgcaataactaatttacatgcctccttagacactgtagctgcctgatgatttgaaaagtataagtacccacaagtgtaccaaaattcattttgaattaacagtgaataaagaaatcttcaaaaattcttgagacatgacagataaatgagttaacacatctctctgtggaatctgtttctatgtatcaaaactttttagttcatgttactgtttaaatgacctcccattaatgtaagcctgtcatttataaaaatattattattattgtttctaaatttcacttagagatgccttagaaaaatctatagctaattttcttcgcctgtattgcttctagtatgggctgactcacagagatgctgcattacacacaacaaagtgttccataatttgcaatatcctctcctcctccttccccttctccctcttctttcctcctcctcctcttcctcctcttcctcctcctcctcttcctcctcctcttcttcctcctcttcttcctcctcttcttcctcctcctcttcctcctcctcctcttcctcctcctcctcttcctccttcttctcctcctcttcctcctgctcctctttctcctcctcttcttcctcctcctcttcctcctcctcctcttcctcctcctcttcctcctcctcctcctcttcctcctcctcctcttcctcctccttttcctcctcctcttcctcctcctcctcttcctcttcctcctcctcctccccctccctctcctcctccttcttctccttcttcttcttgtcactctgtcatcccaggctggagtgcagtggtgtgatcatagctagctgcagtcttaaactcctgggctcaagggatcctcctgcctcaacctcccgagtagctgggaccataggtatgcatcaccactcccagctgtttttaaaaatgttttgcagagatgaggtcttgctattttgcccagctgttctcaaattcctgggctcagaccatcctcctcccacctcagcttccccaaaatgctgatattacaggcatgagctaccacaaacagcttgtaatctgtaatctcttataagcacagagcagaaataaaaatggcatcatttttaggttctcctaactcttcttgcccattcttcactgtctgcccaggaacaaagtcctgctcttgagtccacaattatccaagtaattctaaaggtcttctcatacatgcctggtgagggcataaattaatgaaacctttattgaggacaacttagcaatatttattaaaattaaaaatgcttgaagccttcaacccagcaattccactgctgtaaatctatatttcagataaatttgtgtatgtgaaaaatggcattatatgtgtcaacttttgcattatggcattgttttaaatcgtgaaagatttcaacctaagaaggatgaagtcagcaggggacttgctaagtaagttatggtgcagcttgttttgagccataataaaagaatgaggaagtccttcacaccttgctacggtaaagttaccaacacactttattaagcaagaagaataaaggtggtaaattgaacttctccattttaaataatttgtgtaaaaatggagaaatgaatatatacacatgtatatgtatatttatgcatattagcttatatgtgtgtaaactctatctggaaggacggacataaaagaaattaatcatactggctgtttatggggaggagaactggacaaagctaaaggagacaggtatgagcatggcatttttctttaaccactttaaataatgtttttatatcgttaagacattaaaaatattctcatcctttattgtttccttcccaacctgacatcccatgttcaaatgttcaaattacatttttcctcttcccctcttttaaatttccattttagtgctgtcaattttagttggctattagaaaaacaacccaaattcatattaatgtgtaggtgactcatagcctcagaccttccaggcgtgttttctatttagaagaggagagttattaacttgcatggaattctaactcgttaaataccaggcggttctaaaagtaccccaggcagtgcttgcacgatcatttgattaaagtgaggacagcaagccaaagacatctgtaggttctttaatccacatccctgacaaaaggacaaagcagtcactgccactcacaccaagattctacccagaggtggatgcccagagggcttccaaggaagttgcatgctggaaaactccaagtacagatgggacagagctgctgagctctaagccagtatatctaagtgtggttatcacacatgtggcaaaagacatataacacatggcatatgcttcatgatggaatgtttgttaaaaagaaagactctagagcccctctgtcctcaagatctactgaaggcactgtataaaagagccctagtttgagcactgctgtctgtcatgaattcgcttcatctgctacttttctgatttcagtaactggggacagtgggatctcaatcagaaaggatttgctcctggaacacccaaggcttgggcaatctctgagcagccaagcccagtgttctctgagttcaaagatctgaaagtctttgcaaagaccttagagacccatcctgccaagactgatcccaaaaatgctttcctaatccatttcctgaggctctctgctcactagggcccaaccccacacttcctgttttatagggatagttagcctctgccctggggcactgggctggtccatgtgttcctttcctaccctagctaatgtcttttgacatttggggatgcgtcagtgctgcagattctttaaactctattcatttattttaaaaaaatacttaataagggctgggcacagtggctcatgcctgtaatcccagcgctttgggagcctgaggcaggagggtagcttgggtccagccagcctgggcaatatagcacaacccccatctctacaacacaaataaaaataataaaaatatctagtgagtacaggctttgggaccagtactcttttgggccctggggattctgaaaggaacaaaagagaccaaaatcagtccttttgggaagtagatatataatagacaataaacaaggcaaataaagaaaacataattgttttaggatgaaactctaaggtttgggggtaaaaaagaaaaaaaaagtatgtaggaatggggagtggggacagaaaatgttctagaaagaggaaagaggaagtgcaaaggcttaaatttacgaaaagcgaggagttccatgtgagtggaacagcctgggtgggataaatcctgcaaatttgaatgaggtgaactgagagccatgagcaggggccaggtcatggagtctctttgggaactttggctttgatgctaagcgagacaggaatccattgaaaggtttgcgttttgttttgttttgaagaagaatcaacatgatctgacttactgaaatgatcttgatgttcagttgagaatttcccacatggtgacaaggcctgaaatacagagctccgttacagtaacgtaggtgagagttaaccaggtggaatcagcggagaggttaagaagtaattagaatatggtgtattttcaaatcaaaaccgtgaggattccatcactctatgtgaggatataaaggaagaacgagagtcaaggacgactccactttgttggcctaactggaagaacagaattgccacttactaagatggaaagactggagagagatgcaaatgttaatggacaagtaaaatgtggcaggtcaatctgacaactaaaaatggagctgtaatgtaggcagttggatgcatgagtccaaggaagagatatggcttcaacatataaatttagaatctttgtgtacatgtagtaatttaagtcatgatatttgataagtctacagatggagtctgtggaggcataagagatcccaagactgagctttggatcagttcatttttaaagattaagaagatggagaggacccagcagaggagactgagaaaaaaagaaaaaaagaaaaaccgtagctagtaggcagaaaaccaaatgagtgtcttattctgttggccaaatgaactaaatatttaaagatagaatgctcaactgtgtcagatgctacttaaggtcacagaagacaagtaacaagaactgaccgttggaaacagcaatgtggagattatgggccacctttataaaagcaattttcctggagtggtacaaggaaagtctctattgcaggaggttcaacagagaatgagagaagagactgtggagatagcaggtaatgataccacactagtgtcctgcagtacggggaagaaggaaaatgaggaatatatggagagaaatgtggatataacaggttttgtttttaaaacaggataaggaaaagcgtgtccatatgcttgtgggaatcatctagttaagttagaaaaattaatgatacagcagagagggggaaaattgctgaagcaaagtacttgagcagacaaaacaagacgggagctaggcacaagtgtagaagtgactgtaatgtaggcacatagacagattatcattattatgagagaagggagataatgggtgaaggaggtagataagcccagatatttggtctttgtagtgtgcagtccatgatgcattcattatttcacattaatgtttggaaaataagtgggaaccctggcatacattgtttggtaaagaaacaatgaattatgctgaaagagaacagatttccagacagtgttgttggagtctttatccattgcatatggctcctgttagagtcaatttatataaatagagaattccttttccagtcttgtttaatttaagcaatgaagtattgagtgctcctgaagattattaagactccacccctgccttcaggaagctgcccatctggtggaatgagccctaagatattttgaggactgctcactccacccatgatcccacaacaggaaagaatatttaacattagggacatccaggaatattcaggacatatgtttgccattactgtaattagtgtcagttgtttgtaagtgcagaaatagggaaataaacagtgttacaggagaacagaagagcaaatgctcaactttgtctgggaggtgtagagaagcaatgttaaggcattgaaacttactgaaatagaagaagagacaggagttaagcctggacaggtagattagggtcatattgaatgaataattgttctaaggggtatgaatatttttctataaacatcaatggtgacgttaagtatgtctgtgttttggagagaaatgtagtagctgtatggagcagaggctggccataattgaaggttgaaaaccattgtgtgtcctctgcaatagtccaggctaaatataataaggaagtgacaatgacacagggcgctttcagctccacttcaccagccagaaatctctgtggccagctgtgcccctgcccaggcttcactcggctctgggctcgccactgggctcattccacccacttggcccagtgggctgcactcagcttgcactaccaacccagggtagggcacaggtctttgcactcagtggctgagctgggtgtgggcagtttttgctttgggcaccagcatctagataaggggaacccagtggcatcggaaaactcagagatgccggtaaccacagagacctaggggttttatggctctttcccagggagtccccaggtttgagcccccaagaaatgttacatcatttctgctgcccgcagtgcagcaaacaggagggcatattacagcttattcatgttacagcttgttcgttcctgcagcccatagctcagcaaatgggggcatgttgtgcccagaggctttttctccacattgcttggtgaatgagagggagggttacagtgttacagctctttttgtacctactgtttggtgggttccgtgttcttgtcccacaaccaagaaggatgagattgcacagacattggagagtggacaaggcagggaagaattttattgagtgagagtaaagttcttgacaataagaggggagcccaagttggtggccctttgtgtgagggggagggcccgaaagtgggtatcccaatgtgtgcctgagtctggggtttttatgggctcagaatgagagagtgcatgctgattggtccatggtgggcctggagaatgcaccatttaattggctaaaggccttaaggaagttcttactctggtagtggactcccctcagaactggaagttcagttttcaggctttaagctgtctttggcttgaggttggatttcaccagagacctgtccctttctgcccagaaatttatctgccgtggcctggagcagtggctcatgcctgtaatcccagcactttaggagactgaagcgggtggatcacagggtcatgagtttgagaacagcatggccaagatggtgaaacaccatcactactaaaaatacaaaaatcagccaggtgcagtggcaggtgcctgtaatcccagctactcaggaggctgaggcaggagaatcacttgaaaccaggaggcagaggttgcagtgagccaagatcatgccactgcactctagcatgggtgacagagcaagattccatctcaaaaaaaaaaaaaaaaaaaaagaaaggaaatttatctgcctcctgctgctatcaacaagggcaataaatgttgaaaggagggagtacatctcattaagtttttaagcagggctttgacacgtatttagaaaataagagaaaaaataactgactatgaggttgctgtttggggtaaaagttacattttgatttcatttgtcaagatgtagattgccgaggatgagacagatttggtcagaaggtgagcaagcataatgagttcattatgtacatgttgaatattaggtaattttaagctactctaaagtctaggatttgtttctttgacatgtttcctgtcttttaatgaacgttgaatctataatcagaactcaacaaaagaaaactcaggaaaactagcaatatttaggtgcaatttcatgtgagggacattgactgctaaaggacaaattcattacatccctagcaaaatcaagggtttccattattttaatgcagggtagcagggtaaccactttttttttttttttttggcttaaaataatttttgtaagttacaagatgggccagacatactttactttcttttcttgttatatattcacaggcaatcaatcctttgataaagaaaaaataaaagtttagaaggatggttaggaggatgtgattaagtaatacagcataaagaaaaggattaatttacttgaagatacccttttctttcatatatgcccagtggaaaatgataatagttttaagatttccaagaacttcaataaaatatatgtaataaatgcatcaagcttcttattgcattgtctcagtcattaattatacaccaaaaccatttaatgtcagaatagaatgcttacttgaccaatccacaaaaactccattgatttgtaccactttagtctatggattcaatatactgtaaaaactttaaaaatcagtaaacttattttttaacaaactaaagaacactatgaaatgctatgatgttttctcattacactgtcatagtgttcttgtactcagcaatgttatcaatgacatagattatcatatgaatgtattatcatctttattgtgagattatgtatatttaatgcaatgcttttttctggaaagttaaacctaaatttaatatataattatggccaatatattaattcctttaaggtatttaaaattttctcatgttacatattttttaaagtttccttttttaagttcttatatttttattaggtgaatgactttattattgactaaagtctctgacagcagataaaaggaggaataaatgaatgaatatacaaactgaacaattaaataagccttgttgctacctcaagtgatttcttaaaaaaatcttgctttcagcaatgttagtagcccactgaaagtaacatccttatattttttttacctacagaaaagtatgtgaaaaagtcacagcagcctttttggtgcttcttgtttttcttcaaattgatatcaactgtgtttagcatggataggtactttgcttgagcaaaagttttcttagtatttctaaattagcttctcctcattttttggaggatattcttatcatcatattgactctgcaacatattagatgcatccattttccaaatcgtgtacatttttattgcggttataaatggtaatcttttaaattgtaaggtttttaaattaatcatggctcaatttaccaaagacattataaaatggactaaatttgctggatcttataatttatgatttgttcttttactttcatttatattttctcattttctttctttttcccttggagattcactatctcaaatattgtgtaacaccaaatctctttaagagccacaaagaaaagtattgtgattcatacattcatatgacagatcgcttacccaaatctccattttactaggagttatgagatgtagaaagtaaaggcctaacctgccttttccaagaactagtaatatgatggagagagacatttaaagtacagtacaagagagaatacagtatttgttgctgtagaatttttaaaaactataaactatgggagcacctagaaaaaattgttaaggagtgttaaaagcctcgttgaagttggcacttctctcacactgcagattatgaaggaagacctattcatatgggcaaaagggatggttgcaatcaggagaaaggaataatggtttgtttcctagagctaccattaaaaattagcataaattgggtggcttaaaacaaatgtattccttcttcattcaagaggccagaagtcagaaatcaaggtttggttctttctggagactctgagggagtaactgtcccaggcctactcttgaaaaataatagtttctcactattgtttcaatttattttagaagcagagagacagattctataaaggcccaaggcaacataaactcctatgtctggtttaagtaatgtcctatcatagaaaacgttaaatcatactttgtcagctcacagagatacattgacctatctaatagaataataataaatgttattagcaataaccgtcatgtattgaacatagttaagcgtttcacatgtatatctcatttaatcatcaccttaatggtagtactagcatgctctaggtagagataagaaaactgaggcctaaagagagttatctataaacatttgcttgtgataagcagaataataataaaacaaattgaacatgaggacatatattactatgaaaactgaaaaaagaaggagaggtggcacatgagcataaatatgaaatgatagtgcaatgacagaggaaatggaactctgtgtggtgtgatcaacttaattttcagcactttctgcttctgccttctgcagcaaaactcattacacaatataaaaatattatgtgctacttactatgagagtaaatattaaggctatagtacacattgctttgaaaccttgcatttgaggattgaaagctttatctcacaaagtagaagttaatataaactgccattataagtaaatggatatttgttaaaaagcaaacaaactgaagaacttctcaaaaatgaatttatttctaagctagaaaagcctaatatttttgaggtgcttcacaaggctgatatttttcaagtatgaccaccatagtgtattcctgaaaataggtgtcataggaataggtaaaagtgaagattactctgctcaacaccatgccttctgaatcgaagtttcaggaaacaaactgaggcaatttgcattataaatgaacatccagggtaattgtttaataccaaatacctgagaaccattggtgtaggtttaatgtgagtattcataacattccccccaacattaaaaaaaaattctttaatttttaactttaagaaatgacttcagtaagatggaagagatggtcataaaatgaaagggtgttctcagtctacagtggttccatgaattttcatttcaaaggagttgtattaagtaaatatttaaggtaactattttacagatgacttttttttttttaaatcaaataaatatgtttggaaaagccatgacctatttgtaaattcttttctaaaaagcctgaatgtgtgtatgcatatggtatatatggtcgtgtatcataaaataaaatgaaataaaataaggtagatattgggctttctcttgctggtcagaaaaaagccttcccatttcaagggactggctctaccaatcaggccaaatttcctgggcacacatccttctgggagtggttgctctctttactttccatttagcagctgtacagttgggaaatgttcaacagaatgaaagccacctgctcctctaatgatttcagccaaacagacaggattgaaggtttaccaaatgtgttgtctgtcactctgactctgctcaaaaaagtaaatcaaactggtcagatattcatatagaaaatgtgtcattagttaactcctggagtgcctgaagctcctttcaggctaccagactctgctgatttggagatgcctttttaaaatgaagaatggaagtgatttgaagagacaaatttggaaaatgaggcattctagaatgtttcccttatcaaatgctatatcattgcactctataaaatgagtagatttatgcacatttttccccacattgacagtttgattttagtatgtgattatatgttcccaatccgactaattaaatgtcaaattcccataagtttccaactcaccccttcttccagctcagtctctctgtattccctgaaaattgtctacaagaaagtatagtatggaagggaaaaccatcatagtctttcctatcacactggaaaaatcacattagaagtggaaattggcctccaccttctctggcagtttgggcacgctctttaatccttctgtgccttaggtttttaatctgtaaagtagaattattttatacattagatgtgtctggaaatgtcacaggacatttgttttcctgaataaatgttcagtattatgtggttttttaaatgttattttgagatacttttgttttatatggttatcccattaatatttacatcacgacaaatatccagagaagtttcattttatgtattttgttttactacaatctgatcgtgtataacattttttttctatggccatcttcaaccttatgttgtcaatattggttaacagagggtgatgcagcttcagtataaatttgtttgtgtaagtatttctgtaatctcaagggattaatgcttcataagaattagctcatataacgccatagaaataagtagagaaaaagcccacaaacttttgttgaataatttcaggaaaattctttatgggtgcacttttttgttggatcacagagctttagtcatcgaaagcattgaactagtgagcatcctcagcatcctcagtgagcataatagtgttaaaaactccataaacatgttaattgaagtagattttgaaaaagggaaaatgataagcagatagatatagaaaaataaaaatgggtaaataacatttatcagtaatccattggttatctttttttcaaaaggcatggtagaaattttattataatgaacaaataaattatatcagcctgaaataattttaagtttaaaaaacaagatctgctgtctaaaaatgttatttccttttacacattaaaatgttattaatttagactcctctaatttagagttcctcaaaatttattcaaatgaattagaaataatatcatgaaaaattagattcatgtgctgatttgtattcttgcatttaatgggcactttgctttatactcttctggcaattttgaatgctgaggcagcacactagaaaacgccaacatcggcagattagtgcaaaagtcaagaagccatttacctaattgctgtgtcagtctaactgcacaagcatcccactcggttttatggaactgtacctgaaggcgaaatcaagttggtgtagaataagacaggggattagcggttccttttgacattttatgcctttcatttccctcctgtgctcactgtatcttctggtgtccagggaatcttgcttagaaatggacatgaaggctaagcaggcatttatagctaatatgtacttttctactcctccatatcattatttcatggttatctttgcatcccagacggctcctggtacaaattgttgcacaaggtgggccttcaagacaccatttttaaaaacgtctttgccacgtcctcctgagatatgactctggaatcaatctgttcctaaactagtgtttcataaattagagtcagctcaatgatatcgaaccacagattcattcaaatagaactgcatttcaggcatggatttacaaatgattatcttaatattttcttgcaaaacatagctaatgtgttctttacatttatttgacctcccctggttggattgttctgtctttattgcttcagcatgcaacattgcctggacactcacagtgatttgcacctattttttatggatgtgtcagcctatgattatataattatatgactttttataaaagcgtagaaggcatagaaaataatgtgccctcattttatgaatactcaagtaccctttaaataaaacactttactcacttttagagatgatatgccactggaaagcaatcatttggtcttttatgtaaattactatttttcattgtttaccaattcccttatggcccatatgtagtgtaactatattttctatggcagtcagagttatacaatctagaagttaagtgattaataaagcagatttcctgggatcagatgcagtataatgctgtgctaatataaataactattttttccccacattactcattggaccaaaagcatcaaaatatattttatgtaaatgaggaccctacacttttcaccagcttatgaagcaacatttctttaatcttaccgtttagtttctaatatgcttttcagataaatttctttaaaagactagatgaattactatgtcatattaattgcatatttgttgtgtagttggtatgttcaattcagtgacattattttataagaagtagacctttcctgccatgagctttcaaagtagttgcagaatttcccatgaatgtgaaatacagaatgacaaatactgtaagtaaacatttaaaataaacaattattaaggttatactaggttgaaatgtatgaaattgccagttttcaactgttttgaccaaatataacctcatacaattgtattataattttacataatattttattcttcctcaattctgtgcctttgttcttcctggtttttctacttagaatgtccctccccacttttttctgacaggaacacttacttttcatctgtatggtctcacctggaacactatatgtgcccagcatttttgctgatattcacaagaagacttaagcactaccactactgattatacagattttacatttaaaataattcaatgtgtggacattttatcatatgtgatttcataaacccctaactccaccctggtgcttcctaaaacataattctcccagggtaacgttatgacttactgtgtccttcaggctagatgtcataatgtatttgtatctatagagcttattaacatgattggcatataacagtaggtaaattcagtgctgactgaatgaatatgttattctattaataattcagtaactttttttctttgaactgggaaaaatcttggagagtttctacttctttccccttattttataaatgagaatactgatgctcagaaaaataccttgatattgctctttaagagtggagttaaagctgatacagcacgagcaaaatactaaaaatcatctaaaattatatatgtgacaatttgcacagatattaaaccagagaaatagtaactctgggataactctagacaatgacaatcagagaaggtgttgtagaagaactgggatttaaaatgaattttaaaggacgggtagaatttggacaggcagaggaaatgggagaatgtgagtaggatggtatgagtaaagcattgacagaggaagacctaaaatgtgcttagaagagtgagcaaacagaatgttaatcaatgattgttctgatgtctttacaaagtatatgcttttacccaggggatatatacttgttggctttcttattttgatataagatacaatatatgtgaaattctggagactattcctttgagattgaaaagcgagtgatactttgtcaaagtgttctgtattacaagttagaataggattgaaaattaaatataatccaaaccttgaaacttggcttaaacataaatatatttctaatttactgaagcaactaggcttccacaatttgtaatgtaaaggttcttttcttttttttgttggttttatccccatgaaattgtttccatcaatttgagaaaatactgaggtttcttagtttggttcttttttgtatatgaacactgcgtgcccgtgtatgcgtgtgaagtcacaaagagaagggttggaggggagagttggaggaaacaaacatccccttgtcaatgtagtttagggttttcagctccttccatgaacctttgcacagtatgacatctacaggttatagatggttttctttctgtatttggtgttggctctaaaatcctccttagaaaaggcaacacaagtatcccttcccgattaatgtgaattggaacaaaaggtataaataccatagataaagagagatacatatatatgacgtagtatttgagtgagataaactcttacccatggctaatatttgagtgaaaggcaaattggtaaatattttctctattgaattatttttaaatcacttgagaatcatctgttgagttctcactacgtgcccagcagtgtgctagttgtcagggatgcaatggcaagaaaaaaaaaaaaaaaagacttgaatggtctttgctcttatggagctttgaactagtaaggagatatataataattacagaacaaatatacacattgcaaattgctggaagtatgttaagaaaagcaaacagatgatgtggtaaaaagcagtttggtctgttagaatttgagtaaaattaaaagaaaaaacatagcttgagatggtgtcctcttttggaggtggccaaagatgttctttctaagggggtgatacataaacttagagccaaggtgaaagatgaagtcacccatactccataaaagacagggacaaagtgctaagcagggaggtggaactgtatatgcagtggtactgcagtgagaggaactgggaaggagtgagggtgaagactgggtatgaggaggatggggtgatcaggaatagtcaggtcatgcaaagatgtgcagaccatgctaacgacttcaatatgactctttttttttttttttgatggagtctctctgtgtcgcccaggctggaatgcagtggcatgatctcggctcactgcatcctccactcctgggttcacgccattctcctgcctcagcttctcgagtagctggaattacaggcattcgacactacacccagctaatttttgtattttagtagagacagggtttcaccatgttggcaaggctgatctcgaactcctgatctcaaataatctgcctgcctcagcctcccaaagtgctgggattacaggaatgagccacagcgcccagccccttaatatgattcgtggtgtgactagaaaccatgaaagaatttaaagccaaggagtgcatgacccagttcatattttctaaagattcctgggattactgtattgaggttggattgggagggagcaagaacgaagcaggaatgtcacgttaaaggtcgttcagctgtccagacaagaaataatggtggatttggctagggtgatggcagtggaaatggagcaaagtgagcatattctagaaatacttgggacattgagctgtaaggactccaagtgccggcttcatgatgtgtgggaaagactgatcaaggagaatcgatgggtttctaacttgaacaacaggatggataaaggaaccatgaacagagatggggcccactgtggcgggcaggttttgggggtgaagaagatgagttccactttgtattctgaattggagatacctgattgtcgtgaaggttaagatgcttcagagtgttcagaaatcaggcgtgagattaaggtaacagataaggatttgaataatgggaatatatagataattgaaggtatagaaattctttttcttgatcataaagggggaaaccctatttgaatgtggtgtgtataatgtaaatacctacacacacatacatatgtgtgtgtctgtgtgtgtgtgtgtgtgtgtgtgtgcataaaacctaaggagtaaaaagaatagctgatatcatttggtcaggaaggaaggaaggaaggaaggaaggaaggaaggaaggaaggaaggaaggaaggaaagtttttcttgattgaagaaacccatgttcaattcaaccttacacattgaaatcatttactaatttgctttcatttactaatttgctttaattttcccccacaaagctgtatatgaatgtaaaaagaaaatgattaaaaatacaaataagattaactcagcttccaaagttcatatagggtaagaatttgcattgaaaatctgatgaaagtgtttgaactctatgttctctcccaagagtcatactccttttaaaatttgctaacagcgaacttcatattttaatttaacattgagctgaagcctctaaaagtgacatttctacatggaaggtgtgccagattcctggagagggcatatggaatgtgcggaatatgagcaacctgtttgtaggcatctggaggcactggaaaagggatgaggttaacctgaaaaccactggattcaggattagagtagcctctcttgccgctgatcctgaagttgtatcttatggaagcattgtcagaccacagaacgcttgctactgaaaacacagggctgaattaataattgctaatctatattttatttatgatgtgctagtcagtgttgtaagcacttgatgtattatttcatttaattattacaattcccttaaaatgggtgcaattgctatctctattttataactgaagaaattgaagtgagcttaaataatttgtagaagttcacgtatctcataagtggtacacctaggatttgaactcctgttcgcacaaagcatgtatcgtaattgttatttgttgtttgggatgagtgggttgaggggacaagaaatttcaatcccaaaggaaagaaatgctgtctttcctggatgttagttgatttcctggagtgaatggccttctggctcccactggccagggaaaaagaaagaaaataacagcaagtcgttaattcataaaacaattttcccaagtgcaaggcttgcagtttctgcacctgctacgttgctgactcatctcacctgaatcatttagtcagcttcattgtgtttgctaagactgctaattatcctactggaataatttaaactatcaataaagaatgcaataaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgtggcctcttatgatatgaattagaaattatgatatacaaattagttctgaaaaagatggactgcatttttctcttctcttattctctggcatttgctgaaataaatacttacgttgttcagggcagaacagaccaagatccaccaaaagaataccttattaagtatgaagggttccttgtattaatgcatttcaagagaagacgcatgctaaccattagtattaaggagtacaaggcaacctactaaggcaagaatgtcaatcaactttgacagtcccatgtccttcaacatttcctgttttttcctaccctccccaattttcctctcattttccttgcttcctttctcctgtgttcttcttttctagataaacattttatctgaacattttacattctaacgtgttttagctctcttccagacacctcatacatatcatacctcatctcttaagtggtttttaattaagttaaacacattttggcctgttacttgtccaggaggcagtccaaaaatatttattgaatgaatgatgtagcaacataatatgcaaacaaaaaatagtttttacgtaatatgtagttttaaatacagaagatagttattatatatatgctcagtgtgagaaacaggatataaatgtagctaaaacacagaagttgttttcatttatgtcagtctaccatgtgcttagagtaacaataaaagatggtttagtaagatgaccattactattcccatttttactttgtctttacatatgacacatttttacactgttttggtcaataaaaagcctagctttccatattgattgctatcacgtacttattgaatccaggctttgtccctctaattactttcttatgctattttacatccttgtttttagtattgagtggcaaaactcattattaacttgagagtcttttgatctaaataaaagttaaatcaccagtatcacataccggcttttttccaaataaatgtaaagattttgcatttatggtagttaaaaagttaaaatgtacttttataatgagctgtgcatatggctttagtagttaaaatatgcactgagtaaatatcttagcccatatatatgggtcatgacatgatagatggaattattctattagaaataatatgaagaataaaaatgtaagttcactgtgtttatagtaaacatttgataggttttcatgttctttttgaacaaaatgttttgaaattattctcaattgcaagacctatgtgaaagctcaattttattcctctttattcattcttactgggaaagaaggaaagtctcagccgagtgtaaaatctttgaaattgttcaatttttgctacattctttttccatttacaccattgagaattgacctggttgtggaagctcagtctccaggaatatttgagggttgcgggtggtgaggacgggaggagaggatatgtcactatgcacccagatttagaaaactccccattctctgcgttcttttctcccatgcctccccattttctcttttcttgccctaattctgtttacaattcccatattctattctttctgtcgaagatttcctgctgattgtggaaagacaatgtccaagggaagactgacatacaaatgagtagagtgtagttctacacgtcattttctccctctggacctttcctctttcactggggcttgtccccttgtgccattcgttgcccaactggctttacaacagggcagccccttttcatttttgcttagttttatcatggtgtgccttaatttaatccaagaaacatgtttgaagattgctgtgtaaagcattggatgtttccaaaacagagacgggaatgtatatgtgctgatactagatcagggtgggttgaaatattattgtttcatttaaaatgtaagtgtgcaactgtatatatgtatatctatacacacacatatacctatgctgtatattaaaatattcataaaataatacacaagaaaaatgataacagtgtcatgtaaaaaaacccaacgctttaactttgttataaaacgttacttaaaaatccttttgcaaggattgaaaatacgagatatgaaggacatatgtcttcatgtctaaatttaaacatacaaaattataaaatgagctgtactgcataagaaatcagtgttctgaaggacagctgggacagaggcctttgggatcagactgaagaaaaatgatcacacagagtaacagttagaagataaatgtctttagtcaaggttttcaaagtgacattttacctctcctagaaaaaaacctgctagtttctaaactttaaaattccattttggtgaattagcttaaaatattagaagaatgtgactgtcagcgattctcttcagaaaatcaaagaaaacacaaatttacaatggtcattttttgctgatgcttatcaacgttttgattatggaggaatgaaagttttaaaacattttacatttaagataattttttatcttaaatgtgttaggtttacccacaacacattttagacttgcttcctaagtattagttaaaatggaacaataatatcagatttacggccgggcgcggtggctcacgcctataatcccagcactttgggaggcctaggcaggcggatcacgaggtcaggaaatcgagaccatcctggctaacacggtgaagccccatctctactaaaaatacagaaaattagctgggcgtcatggcgggcgcctgtagtcccagctactcgggaggctgaggcaggagaatggcgtgaacccgggaggcagagtttgcagtgagctgagatcgcgccactgaactccagcctgggcgacagagcgagactccggctcaaaaaagaaaaaaaaaaaaattacattcatgagtcatgtgtttgttgcatgatgctattttcattcaaagagagagtatggtcattctgtaaaactatcctgttgtgtaggaaataggactgtaattttcaaacttttttcacccaatgaaaaccttttcttcatggcagagctgtatcatataaaacataattaaatagtatttaaagagatactatgaatgtaaatgtctaaggataagcatttaaaacttatacatatcaaaacagtctccaatacatggcacaatatcatggtgctgtgacgtgttgtatcagttagtagcagtgaaatgactatagcgtgatgatgtgcacttaccccacatatgaccctaagtattgagtaccagggttcacatgtgtagcattctcatttgtaccatgttccaaatgagccggggcaaatttgaaacgctaaatcagaatcttctcttccaagatctattgtgatgtagtgtgtgactttcccatataaagtttctgaaatggttttgcaagccttacagtgctatacagatattagtaataataaacacctgaattttacatcagtgctcagaaagagtggactccaacctctgcatgaagtcagttagattgcttgcacatatggtggttctcatatgatgggattggaatataatgtgtctgagtgcattgttagtttttgttataaaaatagttgaaaaccaaatttaaatgaaattcaaatcaaatattgttgccattcttagagactttagcgaaatactaggatttcattggatacaatggaaagaacaatgaatgtaaaatcaaagtcttattataattttgcttataaataattgcttttaataatacttgtatagccctgaactgtttatagaaccattttacacattatgctcaataatcttcaaataattctcatacaatgaggataggatggttattattatcttttttttttcagaagaggaaatagactgagaaaaaaataaattcagcttaacatggatttttttctcacttaaaatcttaaatttccagtgtggcaacatcatttacatatagtgctcaataaaatagtctaagtgccactcattgcccaatttaagtagtgcagttctagtatattttataactactcagctattgttagtagtaccatgaaacagtatgtcaaaataatattgaagaataaatgtatgtgcttttggagttcttgttttagaggtagacaattctactaaaattgcattttataaaataatagaagaaattgagaaaaatactataattttttttccctttaacatttttacctatatattaacataaataatttctaatttaacatcttaatcatttctcatatgagtaaaaagacattaaatcctctaacttcatttggagagttcttgtctcttccccatgcaagttgtagctatgtagccagcaggcagacatagcattaagacagccaacttggacgaaaggagacataaagggaatgtcagagttacccagcccagagcccctccctcctaccaaatctgaactttttttcttgattctcatgtcattctttccaacttctcaatcttctaaaacaatctgcataaagcatcttaggcttcacactttacaaattaagcagataatgtctctaattagccttacttcttctcttcctgattacctccccatttgtttcttattatctttgtccatgccttcatttttgatcttagatcttcttttctatttattcaacatttccctctaagattccatatgaagtaaattcaagaatactatggaatagcattttaatattaagattttctcttactaaacatgtatttgcataaataaatgtaggttcacgtctttatgtattttattagaaagaataacctcctatttaatacagaggatgaagctttaagggaatataaactttttatcgtgcctgatatatttgagtatataattatatgcttactctgattaggtagatatgtgtgtataaaaccttcaaattttaatggaaacattaacttttgtatacattaacttgtgtctctgaatacattaacttatgtctccatgtaaacagcctcaataactctgttcaatgacataccagtttctgtctgttggtgttttttagtttgccctttgacagataattttttctaagttcagttaattgaaactaatattttgccaccatgaaaagttttaaagaggaaaaagaggttaaaatacacattggaattattgatttagcagcattgacatctctacataaagcacattgctgcttgatactgaaggctctcagtggatgacgtataaaatcctatgtgggaaaaaaggcagaaaataccgaaaagaacacatctgtttatcccaggctttgggagtttggaaagacctttatttaagctatataatgtatagaaaagggcagggatttcatatttgaatagttagtgtctccagttaggagttgtcagcagacatgcagaattgtcacctatgtttggaatgtgcggaggcatccttaccaattgctatgacaaggtctggatgggatacgtgtctacaatgcattccagttccagtacccaagctgatttggtgttctcattcttgaaatggcgtatggctctttttcggcaaataaaatcagcaagtgattgatgtgccacatccgtttggtgacgtcaactgccatgttgctgatacattttttgtcttctgcagatagagcctttttagggacttagatagttcagtgtcttaagaagatgaagacaggagagcagaaagatgggcacctggcccacagcatcattagccactctacgctactagtggaaagatacatttaaaaattaatgcttttttaatttaaggaaaaatatgaaattaaaattaagactatctcaggacttcttaaaaccagtcaaatgagtgtaacattcaataattgtcacttacctcaaaatcaataggatatatattaaacagaaagcttatttggtgtaatatgggtatgtcactcctcataaaatacttccctacttccctctcccagtgattatatatacttatttatactctcatccttaaatatccatacaaaaataattatatatcgcaactaatagtgactttcgaccaaacttctaataggaaaaataaaaaagttgactcttgaaattataaataatattgtaaaacaaggttagagatttcaaggttttccacaaagtaaagaaaataagtgaacaatttaaatatagatatagccttaacttgataactatggaagctagaattttcatgatagtttcctgataaaaatatgcatgtatttttgtctaattaattgtagtagcatataaaggtaccagttgcttttaaacaattaaaaggtttttttttgtttttttttttttttttgctaattttagtatagcaaggatagctttctgtaatataaaccacaggaattccattttgaaactgtgtctagtatactgtacaggtgaaataattactaggatgacacgtagtaattgggtctgtaactccaattaccctgaggcattgactcatttagacttatgcctttattcttcgggtttgtgagataagcttttctgtagaaataaattcagagtatctttcctagaattccaggagtctacaactctcctctccagaggaccagcaagaaatcattgaattatttgctaattgtgagcaaaatttgtattgatttttctctgtctctctagtcgatgttaatagcatcatacttcaggttactaaatacttttcagcaccatctaattgtcaaagattcacttactaagacaaaattgtagacatcaaagctatacacacacacacacataaacacaaagaaaatgatgacacaggcagtttatatgctctttcttacttctctttctcatatgataatgttttgcaatatgtatttcataatttgaaaccaataacaatttgaaaggatattaagactactataccactcagctccatgcttgatttaactgctgggcaagtattaatttctcattgcacccaagtgcagctaacagaaaaaaagtacatcaaaataagtatatatccatattgttttcatcatgttgtcatatcccttaaggatataagcagcatatcttttgttttcctattaaaatcactttatatctgtaaaaatagacactgtatttttcttatagtgcttaaacactgtatatggtttctactacaatgaaactattcccacatattataatttctacaatatattagcagagtttttaaaattaaatatgaatgtccgttctccacaccaatacacaaaactattgctcaataaatttgactaaatttagtgaaatatagtggtggaaagaacagaaaaaaaatcctttgggtgctcacagtagaattttacatgggaaaagctatttctctcatggcccctaaatagttgttaaaatcaatgtacctcatctttgacatctgtttgagcagaatgaatccatcttaaattcccaaatcactttcactgtgaaagaatgcagtaaatgaagcaaaatagtttggggaaatgagaaaatgtaaacaggccaatcagatgctgtttaatttcctggatagccagaagttttctcaaggaaaaatgagatcagagtttgataaaaggaaaacctacttataacccattgctagctgagggaagttttctcaagtatattgagattttaattgatactacaccttgaaatgtttcatagcaacagccaatgctaataagttacttagcactattgcttgatagtccataaatatctgttctgtatacacaggaacagtcatcactaatattttggatacaacttactatagtaagaaacatagtattctgaatgtcaagtgttggaatattcaatactttggccttttttgctgtttattaatattgatgaggttcttcttcagtaatgctgttggattattaattcctgttaaattctgagaacactaaattaaaatagactgttaaaaatttaactttttatatactaaggcttaatgtaataggcttttggttagtactactctgccataagatgctaatgtgcttgagtaatatctctggaaataggttcacaagacggaccaccaaaattatagaataaatttgacatcacactttgcttgagacggaattcattttttatatttatataagttctgcaggagcatcagcgatagtatccttttgaactaattagtgtcttcttttaaattcagagtaggaaatctcatctgctggttcccaaatcaacgttgactaattaaaaagttctagtgcacaacacaatcaagatagaaagaatccatatatgttaaaccttcatgtttggttgtcttgttttaattatagtttgtttctatccttgaaagattgtaagagatggtgaaaagtggtgcaatattgagctactcaaggtcatatgtgtgagaaaaactgttgaatataaactcttgctcattgtacataaagattataaagtgtcgcagtaaatttttcaagctatggtaggcagagcatttataaagatgagtgacaataatttcttctgtccctatacctacagtttttgcgatgtgacattgctcattttcctactgagaggaggagcccttttctttattgcttgaatccgggctggtcttgtgacttgctttgagaaaaataatgcagtggcattgatgggctgagctaacacctcatggggccttgctgattccacatttgacttccaggatcactgatgtccccatgtgaagtagtctggcctatgacttttgaagttgaaattactatgaggggagagtagcccagctgcccagctatatagctgccccagtgaccacaaacagcaccaactacctacaaatgtaaacaaggccacctttggccattcagcttcagtaaagatcccttgatgactgtagatgaatcagtgtccccaggtaagatcaagagaagaaccattcggcaaagtcggccctaatctctgacacacacaagtgtgagccaatgaaataatttttgtaagcccttaagctggctttgttaagccactgagttttgaggttagcaaggcagctagagttaactaatggatacaccttttattatgcgtaaggacaggtattagtctgcgtacatttcactgcctggcacagagtatatattaaggaaaaattattgaatcgaaatgaagtaagtagaaaactttatttcaagagactggcagcttctcgggggaactgggcaaaggaaccacatcccttattgaacttttgcctgtaagagtcacctccagtctcttgctgagctctgggcttgagaccaacattaagcttttcctcaaaaaatcacatataagagccaagttaaaaacatttatgcacaactctatgtgaaaaaaaatcacatgagaaagtgtgaataaatttattatctatttcatttggtgtgattgtgttggtttatttgaagtagaaaattacagatatttataggtatgtaaaaattgtttataaaagttttagctctttaagttttgtagaactactttgaaaagaaaggtaaacatttctaagcatactgagtattcaattagatatgctaattgcttacatgaaaaggtgtaaaaatcataaaacatggaattagtttgttctttaaaattaacattattaaatattctattctataatgcaatattaattaaaattttccaaagaaaacttgagcttgaagttcatagaatgaaataagcactttagtgactaaagcaaatggtcattcgggtcatgaaaacaagatagtaatgagaagaatgaaaaggtctgtatttttaatttccatttttaaatttttaaatatgcgtatggggtaagtgaattttaggttgttaaatatgcagtcagattggcaaatatatatttagggatgagaagggataataaatgtgctgtaagtccatacatcttgaacaaaatatgcgttcattttaatcacagagaggacacttttggttgagtttcattcaaaaaagggaagaaagaaatctgcatctttcattaaaatctccatctagctgtgtttccattagagttcactgaaaaatgactcataaaaccaacaattttatgcatcaggtgacaggttttgacagaaacagcactgcagtttttgcgatatgctacattttgaatgcttaagctgtgtgattaggtgtgctttatatgacttccacgtgcttagctagcaaaatctgagtttatttatataaaattattcaagtgaaaaaaatagtgtctctcacagtgagcaaagtcagatctcaaaaggggccataagggattggctagcattttatcaccaagtgagtccagctctgttaaaaacaagccacagaccttcttgcgatgcacaatgggctttttatttttaactgaccacagagtaaaaataataaatctgccatctgcctgtcaatagaaaataaaataattttccatttcagctctagcaaaataaaaatctgtgtctcctgtaaacacagaaaaaaaaaaatttgtaaagtaataacatgtgtgccagaagcttttgtttgtccatatgagaaatagctcgttgctaatttttagatactctctagacagttttctctgggcatattttagaataattgcatatttgagtcagctggttttatttaaaattgagaatccagttgttagaatattcaaacttactttttttactttgatgttaaatgagacactacactacttgttcttaacatgacatgttgatcacgcagcttcaactaatgttttctagtaagggaagtgaaaagaatgcatattttagagaaaaagggccctggatttccatctctaagcttaatgacctttggaatatcactttctgaaactcagaaatgtacatctagagataataatcccttgaaaagtgaactagagataataatcccttgataagtgatgtgagttttacagattattggccaatgtggtgcctgctgtataatagatacccaagaatggtaattattactattagtactggtatatttaataaatttctatttgtcttacttggatcccatcaattaatatgaaaaagttttaaatattatttgtggatacttatacgtgagatttctactttgtcaatatcaaaatggcagaataagtacagcaagcctaaaggctttagtttttagaaagactaacgattttcttgtgttattcataagtcgaggcaagttaaaggtaaagatagtggaaggaaaatgtctttgttaggtattgtatatgcagaatcgtactttgagataattgacggtattcaagctggataattagagaacgaaattttggcctttattaattaaaattcggagtatagtgaaatttatgaaagaattgcacatttcattgaaggcatatttgaaattctacaaagtcaaaaagcatgttccaaacaccctagttttcttgtacattttgttatattcatccgtcagtttcagcagctatattcattaagctttcctgataccacttttcaaaagtctaaatgcatttgagaatggccttaattctcaaagggaatcagaacatacgctatgtaagtggattcctacaaatttttatttcccagttacatcaaaattttcttcaatagcttaaaatccagtgtaagcaagtttcactaagcagcatttataatttccaattctttctatttaatttgtttgaattttaaagtttgaaaaatgatccctatccatataaaaaccacatttttaatttatttatgctgaaaggatcctccaaacttaaaagaaataaaattcctcctcccattctaaaattattatgattttatagtatttttctttgaattcatatgcttttcactatttagatcactacctttggcttaatgtcctcatgagaagaaagtaatgctattttaacgaaggtccatagggtacaggtatgttttggctccacattgcatcccaatgctagctagctcagtgcttgcccaaagtgcagttttatttaatatatattaagtgaataaatgagaagataattgcaagatctcactctttgactattccaccattaccagccaaaatgtgcaaagtctagttcatttcctctttatctctcccctctcctgccctttgattctcccttctactctttcttttttttgtgtgtgattcttttcaatcattctgactctaaaaagcaaatcctttttttttaatttttttattatactttaagttctcgggtacatgtgcacaatgtgctggtctgttaggtgtgtatacatgtgccatgttggtgtgctgcacccattaactcgtcatttacattaggtatatctcctaatgctatccctcccccaaccatcccacaacaggccccagtgtgtgatgttccccttcctgtgtccaagtgttttcattgttcaattcctacctatgagtgagaacatgcggtgtttggttttttgtccttgggatagtttactgagagtgatggtttccagcttctttcttcccttcattcttcttcctagcttccatctttccccctagacaaaaatgaatatctcattgaattatattttaaacaaggaataattttgaaagttgattcataggcaaaataatgtaaaaatgatccttgaaagtccttcaaatcatttgcaaagtatcatactcattcatcgtgagcagaagagtgagatgttcacatttcatgtgggaaacaggactgcaaagatttccaaactttatttcataggaatattgtttggaattgactgaattgtggaaatattatctttttctcccgctctctccttctgagcatatatatagttaaaatcagataaactaaccatgtttgtgtcaacctttatagtgaatacgaaaagcatgcttataagtgcagcagacactcattccaatcccccaggtacccctttgctatcactggaagtggacaccaattatacattcgatattctcattcacaaaatggcaatataataatacgtaattttgcggttcttttaaggttaaaaaagaaaatgcctacaaagtctttaaacagtactcagtttacagcaagtgctcaataaatagtagctgttcttattactagatccagcttacaagtgacaagattagcattaaatggattcatttcttgaatgtgatattttgtgtcctaaaaccaaaacatgttttttttaaataaaaagcagaatttaattatagaaatcaatgggaaaattaatcccagttgcagaaacaggtttgaatatcaaaagcacacatacaagccaatgtgaattgaattgtaatgttttttgcagttttcacttttcctgttgatccttaaaatgggtatttctcagggttcttgtcaggaattcatccatctcctcaagtagtgtcttctaatctcatgtcttcagctactacatggctgacatttccccaaagtatgtctatggcctaggtatcacacttccgtatagccaagtctactcaacattgccatttaaaaatcttaccaacatcttattctattttcttatttatctaaaccattttactgccttctctattaaactactatgaaattttggaagaaatactcataaaacaaaataaaaataggatatcttctccatcaattgtcttctgtgtcatttttcattcaacatttattgagcaactttctcatcactgcagttggctttgaggcacagagttaaagagaacatggtatctctccaaatgcccatctacttggattgattcctattagtcacaattttaaagcctttttttttttcacttcaatctcaatggctagtcatatccactaactggaatttaatttcacattcacttactattcctgcttgtttccattattgttttatttatgttataggatataagggttaaaaggaattgtagataatctactctgatttcctcaatttacagatgctaatggagcttcatataacttgagactttttcctttgtcaagcagctataataaatcctctgttagaatctgtttgataggaaaaaagtatgtaaaatttagttaatattcctgattatctctgagaagtattaaatgttttctcttgtttagtcctagtttttgttagattcttagattcttgaagacagaaactctaccttattactgttattttccaggttatgtttgagtgcatggcttggagtagtaatttagcaattatgggattaatttttatcaattgactgccaaaatcaaaaccaaataacatattgacctttttataatatgagcttccaggaagaacagtgaagaaagatcattagaagattgaaacatttctgatgtgttttaagtgtcttgcaaatacatgtttttttgctcccccgttcaatcagcacatctattttcaatcctcatttcccgttaatgattggaccagacaccctcattagacattttaaaaaatagaacttgtatgtagccttcttcaagattagcatcttcctcaaagtcttcttactctgggcttttttttttttttaatacttgccggtttatggtacaaatatttgctagcttatttctcttctttttaaatcttgtctgggacactgatattttaatggttactgttgtttaccaatataaacaagattgtgtttgagaaaaagataagcgttcaatttggttattgggtttttgcattttctggtgtcctgccttggtaaatttgcagagtcttcagttggcctcgtcaatttctacacatttccactgtcgtagtcatataggtcatgcccttatgctaaatccctgactcatttgcaatcaaaactctcttgattgcaccctaggtgttatattaagacaccctttcatttagtcattcttatacatttgaggcagaaagttggaaatatttgtattaatctcctgcagaatgatgtttatgctgtgacatcactctaactctctactggcatcatttgtacagaaaattatttttaatccatagtgcatctgacttataatacttcacagtttggcattttgaaaggtgtttcctttgaatatttttttcacatctagttcataagaagccatcatgcactcttaaaaatttctaggatgatgattatttttcattctaaccaattttacttaattgtgtcttctctttttcaatttatttatgttatttgtttatatccattcatttgtggtagaggttgacataatgctaagatcatttgttaggataccatatgaattatcatagtttgaagatcatggttgagttagctttttcttatagtgaacacattcctacagccaggctgagactgtaatttagtctaccatctcctgggtgtataaaagtggcttaaactaggagatggcgagaaaaaatggattagtagtttgttgttgctgatataaagtagatgttaatagtcactagcttgtaatttcaaaaggtaaaattattatgggagaacaaatagaacaatgaaactctaatgctgaccccaaaacagtacatttaactggctttacaataaatagaattactagtataaatagcaaatcttgcatgttgtttgattaatgagagaacattttttcatacctttgagaaggaaatactgaatcattgacggaaacttgaaaaaagtgtttcagcagttacaatcatttacgaaaaacttttaagttacgctaatgaaaagaatgtatggaaacaaatatggaaaaattatgacactaaaaatataatcgctgacatgtgaatatacttaattagggcaaaacagaagtccgaaattaaggaaaagcaaaaatcgttatactctttttctttttgagtcttgctctgtcactaggctggaatgcagtggcacagtctcagctcaccgcaacatccaactccctggttcaagctattcacccaccacaccctcctgagtagctgggattacaggcacacaccaccacgcccagctaatttttgtatttttagtagagatggggtttcaccatgttggccaggatggtctcgatctcctgacctcgtgatccgcccgcctcgggctcccaaactgctgggattacaggcgtgagccaccgcgcccggccttatactcttttttttttttttagatgtttgaggcaatgactaatatgcatttttattcattcattaataaatatcaaatgccatcatcctatatatcatctcatttgcaaagcaattttcacatgtgtttctctttatagtaatgtcctttgaggattgatggcaactaaggagctttgccagttaaatattcctaaatgtggaaggaatctgcaaagtaaatgcaaatgtttatttccctttctcttattaaaaatgaattatcaaggcccagcatgtcttcttgtagtagagtgatagaggaattattcagaaagtattgtcagtgctcatatgtaaccttgaattcttagcatcctatttaatactgtagtatgaaaatatgccataatatcatagcacattctatagaaaaccacacataaatagaactagtaaaaagcaataatgttgaaagctatattattttgtacttacaaagtgaacttttttataagttgaaacaacaagccaataaaattagccatcgaagatcccaaactaagtgtgaacaggagttgctgtctgtaattatttatgttttgttggagatataagaaatctcaaagcttggccctgcttcaaaggaaagaatattggttaggtaggaaagaggtagggggtagtcttggaactgttaaggaaacatttatgtgaaaaaacacttaatgatgttttaataaaagctaaaggatatacagtgtgctggattttgtgtgcaaaactttcattttgttccagttaaatactgagttctaatgtacagaagtgagaaattcagtggcgaatccaaaaagaaaagaaaagaaaacaaacagacttctcttcattctgaagtgccaaggcagccatccaagtggtagaagatcttaggtgccatatgtgctgttcttcctatggggatgacattttaaacttaactgaaatgactgggcttatttgaattctgctggattcttttcacttcatctcaacatgggatggctcttctcagtagaatatattcttagaagaatccacacttactgaaaaaggaggcatatcatggccagtgtcctttcatgtcatgcagttcccatcatggaacacaactcagggtcacagtgtagatatggcaatgtgaggcatatttggagggtctgcatctgagcaccaatttccctctctccccatttacacatcttctttctgtctcaagggtaccaaaggattatttgttgcttttcagataaaccttgctatttgcttccacactgaatagagattacagtcccctccagccctttaaaagtccagcacaccaagctttgccatatgtgagcaatctacaggcactattagccccgcttgagtagctcttgataacattctctaggaagtcaattaaagatgtcaggaggtgggctggactgcttttcttttactaacaggcattcagagagtggaagatggaactgtcagaaacaggtgattttgggttgtcaagaaactaaggctcctgatttgttttgtcttttcccctcattatttcaactttttttctttctgtgagctcttttagtttttaaccagcaatagctatataatagggaggacaaagcacctagtgtaataaatgacaataacatttgcttagtgtaagtttaaaatataaagagagataaagtcttagaaatttgagcgtagcgaaaatttctattaaggagttactttttgtgttaaaatgcctatatataaatacaagttaaatggttattcactaagaattggtcataaaacttgatcggtattatattagagtgattctctgcccttgcttcccatacaacagggatcactttcttttgctacaaatctcgacccttttattttatgtgctttcactgagaaagactatccaaagaagtaaatgactagattttattctaaattaatatgaagcaaagtgtcacaactatttatctaagctaatgaatttaagtgtttaaaccagattattctgtcctcctaagtattattttgttcggtcaaaatagtatttgttaaatattatattaatttaatatttgttaaattaaagtaataatagagaaatagacattttattgtttgagctacaacctagttatatgtttatatactaatcaggacaattatcactgtgggcaaataaatactttataagagactatatataactttaaatatctctatttgattatgcaaaaccatgataatgaatgaaccttgctctttgccaggtatgtgctaaatgccaaaaaactatttcacttaatcctcatcgccgccttagataagaggcgccattatccccatttcacagatgaagaaacaaaaaattagagagggtaaataacttgctccaaatggcatagctgttaagcaacaataccaggactcaaacaaaaggctttcaatcaccaaaacatgtgggcataacctccagagggcaaagaatagctgaagacgcaagattctgtttgtacttgcaattgcagaaaatataacctataagaattatgtgactctgagaagttaactgtctccaagatggtaacatacagttttgaatgttttaataacggtgaatgaggagacagaaaagattgaggctggctagaaggtttgggtttgttggaagaagaagctggcttaaatttttcttaaaaagtgaagaccagtcctgagggtttccgcatacctattaggaaaaggtgccatagttggttatacagaagaagaatgtaacactgatcagcaattcactcaccatcagcttttgttctccagtttttgtttttcttttttttttttatgaaaaaaaggcaattgtacagaatcaagctcatattagggatttattcaaagaagcaagtgtcatcatgaattttgaattaaaaatagatttagcttaatgttcaaaatcaccatctcacagcatggcataataactgattataatgaagaccttagttacaaagctaaattatttttagtatactttgattattaggttaaggaattgtaaaatatgcctgttatatcttatttcatcacaatatttttaaagtataagatctagaataaaaaattgtctattttcaaatcctggccacttttattaactagatgaacttgacatcttggaacttctgtcttttcatttataaacctgcccacctcacagggtcattgtgagtattcaattgaccttatagacaagaaatcttgaccatttagtagacactgttttattccaccccactagacaactgcaatattttaaaataaacattcagaacatgatctttaaaaggttatggatgtgataagaagtgatacaagctactggcttttttctgatcatttgaatacatgaaatttagaagttagtttttacctttgaaaataagaaactactagcatttcaagatcattccacagtgataccttcaatgcatattacattccttactaaagcaagagataagcaactacccatatattgagtaaactcaacaattagaccaatataaggaactttctactaaagttgcatatgtaataattaactatatccggtttagtaatgacaagaattgaaattcgttattcatctgtttattcaatgaacatttattgcgcacctactgtgtgctaaggataccattctagactctggaaatacaacagcaagcaaaatgaacttggttcctgcctttgtggagctagcttacattttattaaaagcagatagataacgaacacaaacaagaatacttttacacagtaatatgtgatattcaggggagaaaacagaggaatatgatatgtgtgatcttgctgcttctttagtttgggtagtcctaacaggggaaactgaagaagtgataagtaaactgagatttgactaaaagaacaggagaggtgtaggaagtcatggggagaataacaattcacaggccaactaaataatgtagaaacaagacccaaggaagtaactggccttgctagaagaagaaaaaggccagcatggttgggaaggaagggagcagaaggggtagatactacgagatgagaggtcatatctcttgaaccttgtaggccaggataaggattttcacttttttctaaatgtgatgggggtggtggagtgggtgggggggtccttcggagaattttatgtaaaaagatgttaacatttatttttataattttgaagaggttcctctgtctgctgcaggaagaattgactgtagtgtggacaggagtaagagtaagattgttgagttggctgctgtgtactctgagagatgttggtgactcagacaaaatgacaggggcggaagtcaggaaaatcgggtggattctgaataagtttcacagtcattggagcttacgaatggtcaggatggtgtgagtgtgttcatgggtgacagaaatggaggagtaataataattccttgagcgattcatagaagatgataccatgtacaaagacagggaagattgcggaaataaagacttgtatggcgaaaaccatgaattccattttggtaatgttgagttactcttagacattcaagacactgtcaagcaggcaggtggacacaagactgaagttccagagtagctcaggctggaggcatgcattttgggatcatcagcatggaggcagaaccagcaggggttcactcagaagaatgtgtggctggaacactccgttttaagtactgacgattttttaagggcaggaagcttttggcaaagtagatggatgagtaatggctagttggaaggaaattaagaaaagtattccagaagacaaggtaaaaaacacacatttaaattagatgcattttaatgcaatgctttcgtggtaatgatttcattatgtaggaattcaggggagaataaaaaaaaactgtaggaattttccacatattaactcttagcaaatatatatctagcacttattatagataaggtgcaatgggagagaaacatggagttattatatctgcattggagataatagctgatagctaatttcccatatttttttccatggccatctgattcttcagtcttataaggtactgatgtattatgaaatgaaggaaattaatcactatattttattgagccatccgctgttgtatggaagtcttattcgaccaaatattttaaatattgaaaaggaaataatggctatattagtatacttttgtaccattttaaatgattttcaattactaataaacaccatctttcatatgactattttttataattgaaaaaaacaacaacaactgggactctgtggtaaaaaataatatgtttttagaacctgcaatttaattattgggctgcttaatatttgagatctattgaaaatatagagtgaactttttattatgcaaatttattcagttctaaaaataactaaatgataataaaacattcttttttctttacatcatattacagtaatgaagctgttacctctcagtatgcattttaatgaattttaactaacattttaatgagccaacattattatagatccaaggattagacaaaattgaatttactggtattgagaaaagttcaccaagagttatattgtttaaagatggaatataatacattttatgataaaccatcaagtatcctgtatgaaaaattgtgctaatggttgaataacattatatttatgctatacatagatatattcttcatcacactttaaaaacattaatgatatttttgtttttgtatattcaatccatatgaaatataaaagacatagcatatcaaagaaaataatattttataatattagatttttaaaaaaaattttctttaaggaaatctctatgaagtatcattataagtttttattttttaaaggaggaatcatttataattttcttgatgtactttttttttttttgagacagagtctctctctgttgccaggctggagtgcagtggcactatcttggctcactgcaatcctctcctcctgggttcaagccattctcctgccgcagcctcccatatctgggattacaggcccgtgccaccacacccagctaatttttgtatttttagtagagacggggtttcaccatgttggccaggatggtgtctatcttctgacctcaggtgatccacctgcctcggcctctcaaagtgctgggattacaggcgtgagccaccacgcctggcctgatttacttacatgaaatagatttatacactcacaacttataatttgagagagaaaaataactttttataaaattgataattttgggtaataattgatattttaggttctatagaagatgtattaataactgtaagccgctctcaactaaaacacagttagtaatacttgctccttcctttagaacctcctcactcaatattctgttgaggcactgaaaggacctaagtctcaaatcaaaaggttgtcatcgaattcgtctttatgtctcttgtgcctagctcgcaataggccttcagttaatgttaaatgaaaagaaatgtccttctcaatagcaaagtttgtgaatttttagtctatctttgaaaaaaactcattagttgaattgtacactttgatcaggctcaagttaaggccatgcttactagcatcctacagatattttattgacatttacatttcaaagcacctaattgtggaaaattgccatttgtgtcactgaatgactcttgtaagaaaccatgtttctatactctcttcgcaactctttgtgttgaatccagttgggaaagacagtataatttgaaaacactccgtcaatatactttttctttatacattgaatttatacattggtaaacatacgtattaataagtagttaatacatttacagggttttaaagaagtataaagtagatgcagggaagtcttcctcccttattctttactttccagtattttttttttcctgcaagtgcatttgttattattagtttcttgtgtgttctttcagagattgttttatgtgcatgcaagcacattccagcatgtttcttttccttttctaattaattaaagcatacaatgcatattccaaacccagctctgaaactcgctcctccaaaaagccttccttatgaaaacaaagtttcctccattttaccttacggcattttaagtatacttgtccccaataattcatactttcatctttcagtttgtggtttttgagttaggtatggtaactttcctaaatctctttagcaccatgaggggaccatctttcattgaaatatcttgtactcctaaagtgtgctatatagagactggaacaacatgtgcagtacatacttgaatttaaaaagtgggtgattgagaaataaaactcttctgttacctcacagaggtagtctcaacaactagagctggttgaaaagtgaaaaacaaatatctaagtttgttatcaattaaacagagcaaaattaaaggtcatattaaaatcaacttttaaaatgaactaggtaaaactcactgggcaaaatttatacttttagattgggaagaaccatggatattagtactgtataacataaaatagtacctctaaatgtgtttgtttttagaattatattatatataaatccctactcgcttattcatagcgatgatcgcttttagcaattgcatagtaattgattgaccccaagacattaaggcctgaaaaattttatatatgggacagggttattgaagattattattattattgttattattattattagttttcttgagacagagtatcactctgttgcccagactggagtgcagtggtgcaatcatgtttcactgcagccttgaccacctgggctcaagcaatcctcccacctcagcctccaaagtagctgtgactacaggcgcacaccattacgcctggctaatttttgtatttttggtggggatggggtttcaccatgttgcccaaaatggtctcgaactcctgagctcaagggatcccccgacctcgtggcctgtcaaagtgctgggattataggcgtcagccaccatgcctgtcctcttgaagatcattaactatttgatagtcaaaggaattaaaaattgacagccattaaactcattgaagatcagatgcagaagtaaaattcaaagtctttcttgtttactatactacttctaattcctaataacagtgattcttttatgaactacttcctttacttttcactgtactttacaaagatcatttgttcaggcttcataacaaaccaaagacaaaggctttttttaaaccttcattttacagatgaaaaagctgaagctaaaatggctgaaggacctgtaataatttaataataaaagtagataatcatctggataataaaagtagcagaacagagacaaccgaggccatctgactaagcccattatctttaccacagtgctgtgttgccttcctgccaaatagtagtagctccataaacacttgttaaatgggagttccaagtccctaagaggaactggcatatggtggaggggatttcgagtgcattccagaaatagagaacaaactgtgtttaggccctaaaaaaagaaaagagcgtgttacatttcaggacctgaagaaaggcctgaggaaatgtgggttgaatattatgattgaagtgacaaagaagaggctgtagagacaattttagaggctagactacttagagttacagggggaggaaggggactattcagcctgaatttcctggaactgtcctgcaataattattaatagtacttccttaggatttcaaaagtgttagtttggaaggtaaaatagaaagttatccaattcttaggtaatgttgaagatttttttttaatttcagaatgaatgaatgcatttcctcctttgctacttgggatattagaaggaaaatgaaaagtctgttagtccatacttcatatccagcacttttatcaactgagagcaacttcagtgattggttctccagtgatatattgaagacatttgtcataaggccctagccctctaaagcaaaggtctttcctttaactaaatatggggaaaatatgtcaagggcagtattaaacatgtgcattagaaattactgaatctgtatataacatttgagtatttagtatccactaatttatttcaaaaattatcccatttgccaacttcagattttttggttgttgttgctgacactttagacaacttgccctacattcacaacagccgtaatttgttcatcaagagtaccgagaaaacaaggttctaattttactatttgtagacagtttttagagggagtaaggttaatatggtgcatgaaaaaagccaaaaagagattaaggcagtttgtgaattttagtaatatggcataatgaagtgcctcgatcatgtcaaaataatggaggtttcgtagactttctggtaaatcttatttatcaagtttggtaccatcccagggagagaaactcaaaccatctcatgcagctaagtaagtagtaactacaatgtagagatttgcttcctctctgcacagaaaggaaatggctatgattattttttatctccaagcattctgagaatgaaagtgtagtaagtcctcaggctaggagaaacagggtagcccagggaatagatatatagctagagactcagaaggcagtactatttgttttcttactgctgagcacatactctatggatggtcaaggtgactccagtgtgtatcagaggaaaagaaggattttattaaaactctactgaagaaggcttctttccagtttcagctaagatgtgaaggtttgattaaagcatccatgagttttaaaatatttacatacttttgggtaaaacacacatataattaattctcttcatgagaactcagtattacttataccttaaaaagatactcagtatctgttgtttgatatcagtttgtctttaggaatgtaagaaactgtgcttttcataagtaaacaaacatcttcaagcacattgttctccaatcactgtcaatggtgtaatatgagttttctgagataatttaaatttggtatttaggatatttgcatgtataaaaagtacttggatatgctccttgcttcctcttctcctgctgaactgtcagaagatggtgatgcttttgaagatttatggtagatgggtaatgagattgctgaatgttaactactgcatttggaattcatttagtagcaaaagaaaagaaggttactgggattgggatagagtagaaaagtgatagagctatttttaatcagtgaatttaaaaatcaatatgatacgttctgaattaggatacatttcaagtctcttgtcatgtagtaatcaagtagaacatttcttgaagaatataggatgtcaaattggatctaattcagcaaaattcatgatagtgtagtgcccatattttgtgatgtggacatatcaaattttaatattggaagactaaggctaaaaaatccacaagcatgtggaatatgtttttaaaattcaaaattcgaatataatctattcagttaggctttggtttatgttctggtgcaaaagaggaacataaaccgtgtactctcaaactgctcatttttgagtttatggatgatgatgtgattcatgtgaaccccctatctaggacctccaatggttatggttacaaaatgtgttgttaaaatagctaaaatgatggaaatggtgaaattagcagaatcaagttgtgagcccatagatataattatatttctactctattcggagatttgttgagtttcgggtagaggggaaagaaaagataaagcaacaatagtgttaaagtaactggcaaagaaggttgaccttgaccttcttttcctttcaaccctcatttcatcagcaggggtgagattactttgagaccctgccaataggtaataaataacacataaattccaggacacccttgcactgtagggtgccctaatgtgtaataatccttagactattgagtttataactcatgacatctggcagttacttggcattgtaattcatgttgatcatgcacatcagaatacacaacagtagagaaatatcggagcaataacacgttgataccaggagaggctagaatgacaagagatgctgctgaaactgtgtacctctgtgaactgtgcagtggaatgctgtaaaagctaatatcttcagataaggactaataaggtgggaggagagaggcgatctgttgggatccagaataatgcagcacattaatatgtacttgataacactctttatttcctttattcaaatggacaactatagctataagtcagtaatgaatcctgaaatttggatttaaatatatacttagatatattttaatttaaaagtgcatgtaaacaaatgtattgaattcaaattttgtataaatatatgtaaaagagatttaataatttaatttttgttttctttggtctaatggtaagggctaaatgaggaaggaatgcagagagttagagaaaaatgagaagcagtagggaaaccaggcaggcattctacaaagcacctgtaacacacctacctggtacctagcagcctaactactttgtctgaagacccgaggcccatgggacatgaaccagactgaaaagctagaagcagacagatggttatttgtaatcatcctgtaaatgtaaattctttaaaactggtgggcttgctggctttatcatctatctgtctgtatctatctatctatctatctatctatctatctatctatctatcatctatctatctatttatatatctatacccaaacccagatctaagaaaagtaggaggcagtattataaccttaaaacaatctggtgtttccccttgttaccatcttaaaaagcactaatataaaaaaaaaaaagccagcctgtgtagttcttaattttaagttgactgtattatatcttctaatgcccaaagttataagcattgctttgagcaagccaagacagttttgtccgaactgggcaggtgctgaaagacagttgcctgtggaggagaacagaatgtgttgggagcatggtgagatgggtttttgttctgcagctgagcaagacattgccttgaacatgtttaggttaatactagcatttctagaaaccatcctcctcacatgctatgtttggacacaatctctaacttgatctggtttctttgagctttctgtgatttcggagacagcaatgccacgtgaacaattctgtgggcgatagctctttaagggagaaagaaaaggaactgattaaacattaatcagcttcaatccacagcttcctcataagctaatggataggctatgcagatccctgtcaaatatcacatgctaggctttgccaaaaataggacttccaagtgttgaaggcatgccaactgctggctctttaactgcaaaccaaagcaaatgattgccagagacaggcctagagtctgccgtggtcagatgtcaccagtttgcagtgccacatgtgatccaagagtttatgaatgatctcaacacttggtccccaaggagaacatatgcattacagaggttatggatacaaattacagagagcgcgatgtttccatgcaatttctaagaatccttcagcaagttttaaacataagtggaaaacattaaggaagacttggcactcttagcaggacttcaaattatattgtgggtgaggacagaacacggctaaaaaaaggattcaagaataaagacttggctaagaaactcgaagctggccattcctcctgtgtgaattatgtttgtgtttgtgtgttttattccctgcagaatactagacttcacaaaatgctatgacttgaaaatgaacaagtcacagggcattcttgtttattcaacatgctccaattcctaccgctggtttatctggatcatttgctcagtgaatgtgcctgtgcacagaatctcattggaggtgggggtgagagcttctcattttggagttgtcagcatgctacagggtgccagagtgtcagcttgcacagcggcccccggatgtctccccactgagttctttctttcccattccccttctgtgcagaagaaaccacttatgacttatgcccacatgttcagatgttattgtctatttaactggtggctagcctgcccatcctgaccatattttgttcaattgtaccaaatgtaataaagtagtttcttgtgaatgacaatctttatcagttgtttagtcattaaaacttcagaaaaatacagaattattatgcgatgtcagtggggagcttctggttgaaaaaggaaacttacactggcttaaatataaaaggaaacatacctagaaagtccagagttagcatagttttcagaattaatttgtccagccatgtccttaagagcccagatttttttacactttgtacatagctccagtttcatcctgaggatcggtctccccctggggtcaaagcgtggctgccacctatagccatgtagtccaggaagagatagggtgcttttttcatgtgcagagtagaagttctgagctgcatgctggttggggttacactcagtcattccctatggtaactggtggtggtggtggtggcagtggtgttggtagggctaggggaataatctgtggtagttttatgagtgaccatcattgttttttctcttagtccattggaataatttaatatgatatacctataatttgtgctaccagtttttttggctgacataaatctgttctattccttgagtcgttgatttctgaccttcttgaactgtctggcttttattttacagatatatgagtatgtagataggcaagccaagaggattctatttcttaaatccaaacaattcaaattgttcttcataaatgacattttaaaatcaaattcaaacactgtggtctattttatatcataaaaaaggggtgcagcacacatcttgaaggagagcacatcaattcaatcaaccaatcgacattatttggttaacttttctgatacccttcaactagagagctctttggagggttacccagtccagttaagtagataaggaaagacttcagatgagtgagtccaaagttgacactgaatgaacagtatgtacttcagaaaggcacaggcaaaagtaagagaacaaagggacagctaggagttacttgcaggcagaaagaccatcatatgccaacttacaatgataattaggtgttccttcatatccctagggcatggaggttacagaaatgtccctgatgagcctggagatatatgcagggacctggttccaaacaacatttgaaatcatattaaggagagaattttatcttaagagccattaaaaagtgttaaaaagggaattgacatgatcacatttgcattttagctaactcataatagctacaatggaaagtttaaaggagaaattagagaaaaaggtcaaataggatattcttacagtaattcaaggaagatataaggacattctgaactagggcagtggagagaggatgaatagacccagatgatattgcaaatcagtgcagcataatgactgtgtataaattctagtgtcagacacactgggttgaaaccctgtgcttacctaacacaatagatgaggctccaatgacctattctatatccatgacgctatctttggcacatagtatgtactcactaaattttagctattatcatagaacaagttattttaaaaatagattaaaagtgtcattatatgtgcctgttaattaatttttaaaagcaagtctaaaaaattcttactgaaaatcagcacataattacatatattatatatatggataagtaaaggctcctgagtatgcttctatttatcataatttactgaaactgtattcataaactaaaatgtatgtcatataaggaactgcttcgggctagaggtcggtcttctactgagaagtttggatgtcattgtgccacataactccagcagttctgatacatacacagagagaaaacctgccggcaggaaagacttgtgttcagtgttgtttgggtctcctgcggttttcaactgctgttggccgtacctttcattacaattatttcttagattatctttctcgtaatgtttagttggttgtggatggtattctttattcaatgatgtgtgccaattcttttatcagtaacattttaggctttacccttctaataactttagttgggatcatgtgcacattgtggtttagaaatgtatctttcagaagtccattagttatacagtctcacttcattgtcattgctaatttgttttaataaactaagatggaaatgactaagtagtgatttgcctagactgaggttaaaaaaaaattctaagaactattgatttaagacaaaacagagagggtttggggtgggaaaggatatgggattataaggaagcaggagccaaagatataagctctaaaatcacagctggacataaaactttttaaaggcactctgttagttacctattgcttcataacaaattactacaaaattcagtggtgacttgagtcctcaagggtttttggactgagggccttggtttcttgccagctgttggctggaagctgacttcagatccttgccaaatgggcttctccattctgcaacatggcaccgtgcatgatcagagaaagtatatgaaaagagagtaagagaggagttcagactttccctctaaagattcaataacttagtctgctgaaatacactgacaatagacatattaacaggagaaaaaggctacatatttactatgcacacatgtgcatagaagccacacaaaatatgagactgaaagaaaggtcaaatacttgaagcttaattattctcctcatagaggagaggaaagtgggagacacaggcaattttagaagaataagtgatttttttgaggagatgaatgggcctgaagaacaaagggtggcctgggacaacatttccctgggctctgggtgcggtgtcaactctggtctttcctcctgcaggatgcgccaatttcccctggttaatgagatatctgagaaaggaattaattgaataccttctggaggacagcatctttaggtagacaggggatctttagagaaagctctttcttccatttgctactcactgggtgctcttagtttaaagtctgaagtggcgtattttggggtatcattttctaagccacaatgagagagagagagagagggcaaaaacatgaaggtcacaatcttttataaactgatcttggaagtggcatcctaccactttgtaacattctgttcatcgaaggtaaatcgccaggtctagttcatgctcaaggggaggggatatacaaagggaataaataacagaagggagtgaccattggagaacagaacaagggtctatcacaggcactgtcatgtcattcttgttaatctatttcttaaccagttcataggagagtgtttgtcacattacagcattcaatacatacttgcagaattttaatttgtcaaaaatctctatgtcgtaaggtagtaatttagaatgttccaattttccaaaataatttcctaagtcatggtgcatcccaatgtaaaaaaacatgcaaatataattcaggttatattatgactagctaagtgaactatttatatgtgttttccagctcacatatggaagtgaatattcgggttctagccaattacatatcccccccacctcaccccatggagatttgaaaccctgtattctaacttagatctgaaagcaagttctatattagaatgtacctaccatatcccttttctttttaaatgaagttttaaaaattctatttttatttgacaagcaatcgtatatattatatatttactgggtacaatgtacacctgttagaaaagctgttatctgaaagatgaaagataaatattggtaagggtgttgagagaagggaacccttgtatattttgttggggctcagaaactgataccctgaaatatgtcactgaagcagtgtccttcgtctggggtaatacccaaggttcgttgcctcgtgccaaggaaatcaaggacatggacacacaaggactgagtttaagaacagaggtttaataggcaaaggagaaaccctcccttgtgcagagggaggggttccgagcgtatctcccagggtgcgacgagatgcggttggttttatagatgagcttgaggatgcggtgtctgattcccacagggtttagaggattggttggggcaggtgtgtcatttacacagagcgtgaagaagttggccaccccatcccaaccttttattatgcggatgagttctgtacctggtcggcacgatgttgcctgcttttttactgcacctgtggcggaagaaaaaaataataataagaagaagaagaagatggagcctccgtgttgaatagacttggcttccaggtatccctttctatcggcacagctgcggcattcacccgtgcaagcttccggcttgcttctctatgtctgcagttcgattttacaaactgctctttttttttttttttttttttttttttttttttttttgagacaaagtctcgctctgtcgcccaggctggagtgcatgaactcgactcactgcaagctccgcctcccgggttcctgccattctcctgcctcagcctcccgagtagctgggactacaggcacccgccactgcgccaggctaattttttttggtatttttagtacagacggggtttcaccgtgttagccagaatggtctcggtctcctgacctcgtgatccacccacctcggcctcccaaagtggtgggattacaggcgtgagccaccgcgcctggctgcaggctgctctttgttagaaattatttggggctgttttttgttaaaagggaagcctcgctgaggacttgtttaccctcactatctgcctaaataatttctagctcctatagcagcacttggacatgctgaactgaagaggaagcctcaagatctctctgaccttccttcctccaaacccccatctctcaatcctctgtgtctcttgaagcacaggatgaagttgttctccaaagtttcttacctgcctaaagtccggacctaccaaagaagaaaaccattacctctggccccttccctgaattttcatgagctcaaatgatatcgcagaaaggaagactgaagttggacaacaaacctgggcaaactttcgtcaaaaaccatcgtccccttgtgagccgaaaagacttagtcccaggctattgtatgttctttaaggttattgaatccgcctaaaaattatctatacttccccatctccctttcccctaagaaacggagtatataagcattggtataccatagcggtgttaggcaattactctgtgattctcctcagggtacgctaataaatttgtgtaccttttctccaattaatctgctttttgtgagtcgatttttcagtgaaacatcagaggcaaaggggacgctttcccttggcccctacaacttggtagaaatgtaaattaatacagccattatggaaacagtatatcctttttctttaaaacacaactgctgctaccctgtcatcgaatttatttctcttcatcatatttaaagactttttggagagttaggtaacacacactgtggtatgtgctcttcttttgacatacgtgtcaagtcacacttgaaaatatagttttcagttctttctagggtagaggatttagggggaatacacacacacacacacacacacacacacacacactcaatttagaatttaaaattgctttgctattttctacatttaccagaccattttagttctcttaatccgacacatgggaatacttcaccatggctaacactttcttgtttttatcggctacgataaagagcacagggcaaaatccaaggcagaaatgaataattagcacaaaaatgggaactgatagatattattttattttacttttcttacatttatgaatgtaaatacagaccccagaaacatataaacaaatatcagaatatacatatcttccttcaaaatttgagaagagtaaaaatgattttactcctttttctaaaaataagttctaggctgcctatggtggaacctgctgaaaagcatgtttttcaactgagagagagagagagaagaaacatattataatatcctgaagacttagggttaaataaatgatatcactaaacacaaatggatttactgagtactatacaaaccccaaagagcacattacaagttgaagagggtacagtatcaattatatcattatctcaccctactctctgggtgaatagtctgaaagcctaaaattacagttgatgttagatttcttggcttcatttgcaaattggagtcattttccccctttttgttgaatgccataagcacatgttttattgttgaagagtaccagtccttatagtttgttatgatgtttttcttctttttgtcctacatgtcaaaggacctttaaaaaaaaatggattgtggaaaattggtgtaacgttgtatttctgaatgatttgcaatggtattaggtactacttgtgcttaggctttttggcataccattttttaggagagcagatctggagaaggcccttcaactggccagctgtgccattttggaacagattgagggcctgcaaaaacaccatttgttgccagtaccggatattgtaggggtgctcatcaccctgttaccatatttttgcacttcttaacattgcataaataggcagctgttctgtatttagaatataaatgagtcaccagcttgctctccctggaggatttacctgcaagagggaaccacggtgttaaccccttctcatcagttgcatgaatgtcacatttaaatgcacactttcctcagcccactcagaagcaaatcctcatgcatataaatcacacctttcttgccagttagacaagggggccaaaaatatgcagttcacagagctaaaatggaacacatttctttagcagtgaaatcagtaaattaatcagcttataaactgagagtgagcaatttgtgctgaattatttcttactgctccttcaataagagacaaggtgctctaatctcataaagggccatgacttcattaagatggaaaaccatgttaaagggtgtgttgcaaaatacgagaaaagaaaaaccctgaagtcactgagttgactctctggagctcttttaaggacagggttttttatttatttggggaatgacaattaacctacagacttggcacaacaaagaagcagagtgctgaagtgggtctcattataggacacggaaggcagttggtttgacctaatccccagtcgcggcacatgatttacataacaggctaccacaagctgcctaatgttgatttcaaacagcttgatgtgtgcatgtgtctgtgggtatgtgtgtgtgtgtgtgtgtgtgtgtgtgtgtgtgtgtgtaggttcattttacctcaaggtactttggaaccaaacatgtcggtgttggaatgtccaagaacagaaatagtaaagccagtcaggaaaagcagaggcagttgcagtatatggtacatttgctgatctcaactacttttttgaatgtttaccctaaaattaatgtagctctgatttaccacctaaatgcagtccgatagggctgagccatctctccaggcttttcatcttgtcaggagcagagaagcacaagtagatagataggtgacatttggagaggcaggcatgccagattttcggtggttacagcgaaggtccaacctgctgttctccttaatgaaaggagggaaatttcagacaggcaaaactgctataagggatatctctgccctgaatgtcacactgcccagatgtcactcggcaggtggagttgcagaatgaaaatgtagccctgcgtatgtgggtgctagtgtgctgcaagggtgaactatgaatctgtcttctgaagtgtaatgaaaacagtgtggatcttgtctatgtttgtgtcatgagaaaggactttgtcaaagaattctcaccccactttccctcacagatcattaggcttgcaggctcacaaaccacatgcatatatatatgcgtgcacacacacacacacatatatgagtttctatatagaaaatagaattatactaatgaagggttctgcaccttgcttttttaattaatcgcagaactgtacatgaatatttctcatttttttgactgatttcatttttaaagttgaatttttgaccaaaggtgcatgataatttagtcagccattctcctgttgatgatcatttatgttggctccagaatattttaaggtggatgtagctatgttctcagtaaaaatccaggcaatttttactagaacaaggtaaacaagacttgaagttaccttgtacaacaaaaagcctaagttactgtcgttgagttttcttttcctgtaattatttttcctcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtgtgagttaaattaaaatcatggcccagagagattgaattttcagtctcaaaatacaaaatagatgtattttattctttaacattattaatacaattgtatttgaatgttaattacaatttatactgccttgaaaagatttaaaaacatttggatgagactacaagagacaaaaattatgtaaatcaagtgtacatgaaatattaataattgcaccaatctgagttatatctttacactgcaatattgatattttagctctttttttttttttttttttttttgagacagagtcttgctctgtcacccaggctggagtgcgatcctgctcaccgcaacctctgcctcccggtttcaagtgattcttctgccttagcttcccaagtagctgggactacaggtgtgcgccaccacgcccagctattttttgtattttttgtagagatggggtttcaccatgttggccaggatggtctccatctcttgacctcgtgatccacccacctcagccccccaaagtgcttggattacaggcgtgagccaccacacccagctgatgttttagctcttttataaaatctccagaagcttctgttgatcatgcagtacctgagtgttaaagtataaatgatagccataaaccacattaactacatctaattttgcaccattttcaaaaattataagagaaattaatttaaggtgatgaatatctcaaatgctttttccagtttttccaattgaataatatttataacagtaaaattttatacatgaattgatttaaaaggaaattgaatagatgtaaaataaaatggaaatcaaaacagctgactgattctgcatgtagaaaaataactgttttcaaaggaaatttataatcagattcatcagttgattaaaattcaaaatgaaacacacagaaacaggcaaatggcatgtaatcattttatttcttcagaggatccacgcaacatttgtatgtgaagtttttaagtgagaaccaacccacagaaatagtatgtaattgcttaactttctgatattattcagtagtataatttttatattcaatacaactgagagtgaatacatttaagataatttctcatttgactgaataaatgtgccattttaataaaaaaactataaagtattggtatctattatcttaaaaatatgtttattacaaatgaggatttttcctctgtgcacagtgagattacaacataaaacagaactagataggctgtggaagggatgacaatgtatattcatgcgtttctggtatagaggcaaagatattttttcccttcaccctctaaaggtttaagtcttttagtctgctgaaataaactggcaatagacagtttaatggaaggaagagcatacaaatgtatttatatgtaagtgcaagggaatcacacaaagtataaaactcaaagaaaggctagatggttgaagcttaattaccctcttcataggatagagggaagtgggaatagtaggtgattttagaggaagattaaatgattttcagagaagataagtgggcccaacaaatagacaaagttcctctggcctctgggagaggtggtgacaagttctgggaaggtgaggggcagaactgcactgcaagcaaaggttgtcttattatgtagataaagtctcagataacaaccccaagaagaatagttgaacagtctgtccagtaggcatggtaatgacctttagtttcttctttggtgattaatctttgcaggttactgagatttcagacaggggatttaaggcaattgtgtttcttttggaagaacttttctcagtcagataaggaaacttcagagagcttccctctctgttcttggggcaagtggaggggagaaacaaaggaatgtcagagagacattgatgttaaggaagtttctaatgacttacaatttcctttagttcaaagtgctcagaaagccaaagcaccacattttgggatatcgttttctgagccccaacaccagtctcactattaacactgtgagatctacattaccaaagagagttttgttctcagtggtcttgcttgggtaccaaatttatgaaaatgtactcctgatgatggagtaaaatcattgtttatggattggtagtttatgtttatagcatttagctcttgcctatttaaaggtgtgctggcagctgaataatccaggatgaccttacccacaagtctggcaattggttgactctcagctgggtatcttcgttcccctccttatgatctctaattttccagcaggctagttcagtcggttcccatgttggtctcagttccaactcagcaagagaaggcaagacacaatgtacaagaacctttcttccagtgaagtatttgctgtagttccattggtcaaatcaagtcatattacctagctctcagcttcaaggggaaggagaaatggccttcacagccatttttataagctctcattttattctaccagacagaattgagaacaggttaatggtctttttcacctatgtaaaaaaaagttgaaaattcctttctagaacatgacaagttgtaaatcttgaaacatctctgataagagccaacgtacatgagttgtgtttgcctgtgaaattaaaaaataatggagaaaaccaacatgttcttatcttgtatttcttcaagaacactcaatcattgtaaagctaatattgaattaaatgagtaccaaaaaaaaaaaactggaaaagaaactatgagttatagatttactgaaagcctaactctgctttaatgtcctccttagcaaatacatattttaatattattgcatttgtttttatcagccaataaatgcttctcatttaagaaatcttgaaggggaacctattagatgctaatggtttatactaatacatattaccattttataaactgtgtttgtttttatccaacctgccattttctccaagaattatctcttaaatacaattaagatgaaacaaagatgattaatattaacagttgaaatgtgaattctagggaggcaaagatttttaccgtttgatttaccactgtctcttaagtgtccagaatatgcctagtaagtatggatatatatactttctgaatccctctgattcagcaggattttattagattatttaaaatgaatatctagtatttctttctgatgacaaatgacaatagcaatttattcaaatgaatttcagtgtgaagactaactactgggatttagggaggtcagtcacaagactcaaaatgcgatcaggaaagagaggacagctgccttaaaaaatattttctatgaagaaagtatggaaacttacattgagggtgaatttaagaaaagaaaacatacctgcaaatgccaaaataatgggagagttttttcctttgggaaacaaatatgctcaaatactcaaaactatttattaatgacctttattttctattctgttcctttttcttcccttctcttttctttttgtttgattttaacagatccgtggtggaaaactgatgatctccaataccaggaaaagtgatgcagggatgtatacttgtgttggtaccaatatggtgggagaaagggacagtgacccagcagagctgactgtctttggtaaaactttcttctaaattataaatttttatttttatcaatttttctttgcttttaagtattactaacattaaaaactgggccatataaggacagttactcatgactcatggtaagcagtgacaaattagaattatcttgttttctgtctttctaatgaaagcttcgatgtaaagaaaaaattatttgaaactttaattaacttacattgttcatgtatttgtaagattttgcagttcatcaaaatgtaacgttctttctcaaagtctatttgagatattacatctatctaaagtttatcactcattcaactctcatgcatttatcaggtagctattatgtgcaagatacagggtaaggatttttaaaagttagagagtatagtataaaaaaacttgttttccagttcttagaaattcaaactgaagtatttataatttcaactcttgataaatatactatgtatgcacacatataaattcaaaatcagaaaatggacccctaaaatgagatattttgttatgatattcatgttccttcaactttaagaaccaaggctctccttagctggttaaatgcaattaataggttaaaaactgactagaaccatatcatataaatggtggataaagtattggaaaggagaaaactggggacaaataaagatggccgaggaaacaaatgtaaggaaaatactgcagggcagctgtggaaggttgaaagagagagaaaatgacaaaaaattggaaaaaatagatatgctaaagatactcaaaaatgaaacactcttttagaatacattctatttaaattctatttaaatctctgtatagacatacacatttatagacccacacatgcacacacatacatgtacacatatgtatgtatgtgtatgtacatgtgtatatatacaatcttcattaaacattttactatagcagatattatgtgattttttaggagcaaaaatatcattgtgattttcaaattatttttcagtagcggtaaaataatcctctacttctgtgcatgatttaaaatccctatttctggtcatttcttcaggacacacccaagtgtggcaccaaagccctgcataggtccccagagaaacgtattttgctggcttgggagacgccatcccaaggtgtaatgggagtgccactatagaagagctgtattatgacttccactatatttcaagagttaagattgtgctttgtgcatgtgtaccagaatgcaggcctctcctttcaatcattctgagcaccaggtaatctctggtaacactccctgtggctactaagcagcttgaagtcccaaatgacaaagctaggagaaatcccataatttgttaaaggaattgaatagaaaaaatagaattgttcaaagtatgcatgtaaatttctatcctgcagagctcagacaagtgtcagtttgcccctacatttcatgcagtcctctataagagtctcaagatgtgctccactctgtaatgaataaaacacagttttgcctggtaagaaatgatattagtggtcactgaacgttagcattgaaagcccacaagtatagctcttctatttaaagaaacactcattgctatttttctgtaactaccacaaactctggaatagaaagaaaaaaaaaagctatattactgcagtatagactgccttcagaaggaaattgaaagggtttaatgtcattacagaagcaattagacttaccactaatgagacatccttatgaaatatttactctactttccctaaagaaatgatgagaactactggggattcctaaacatgtcaagagttatgtgggaacttctaaattattttgaaaatagctattatccaaatagattgaatttgtctagaggcagttcccctggcagaattgatttaggaaacggagaatgtttattagatggtgtaagctagtcagaactgacctgaggggttataagtacaagattaagttgaaggaaaaactagctttccattattggtaagaaaacaacatccaaatccaaaagaaaaacaaaaaaaacaaagtgatggtccaaatcaaggatgtgacaagtattgcccgagaaaccccttctgtatcttggctccctattcttagagaacataaaagaaaaaaaaacagtgtactattaatagggaggtcttctttattttatgctggtgctcctacatctaatacacattttccaatacaactctttatattttagcattgttacatattatcatttttgaccaaatatttatataagtaaaactgattgtacttcatactctacctccctcaattttattttcatggagcagcaatttcacttttaaaggtctagctactataaccactctgtagctacagaaggtttttaaaggtcctttgcagttcaatctttatcttaagatatgttttacagaacaagttacattttgttgttcaaaaaaataagtatatatattattattataaatatgatgtaaatatattatattttattgatacctattattattataaatataataaaaatatatataataaagttacatttaattgttcaagaaatataagtcacttgtaaatgtcaagaaaaacaatgaaaggaataaagggttttttccagtataatagctgtctactttccgagacatattgctaggaaaaagaattttctgaattcttcaagtattttgattctagtgggcttgtactttgaagttgtatagtttaaaatttcagcattatatattttaaatgtgccatttgatcatatcaaagatatgatcggtgtaacctaactttaaaaagttactgtgccatactccatgaatcacatattgtggttgatcttctaatagtttttggtcatgaaataacatcctaattaactgggcattatcaaatctaaaaattagaagtaggtatcatagtctacagtagcactgaaatctgtggcccaatctatacaccttcctgaagtatagtccctagaagtttacatatgttaagctctgaagatcctggatggcagagaaagtagagttgaagtaaataatacaatttctaattatgagtagatttcagaaaactgctgtccaaaatttgggttttaaaaatgacatgtggatttcaaaaatgatttttaagtgtttatgaatgcaatacacgaaaacttattttatgtgtaacatttgtaaaatataataagtattacaaaacttagaatgaaatacaggaatctcttgccccaacacaaacacacacacacacacacacacacacacacacacatatatttctcatcattttacgttctgttttatctaattattctgggatttgtttccatatttctgaatatgtgcttaatctgctatttattgatgtatcaatttcatacattatttgacttcctattatagaagatgatgatttggcccacttatagctccttccccaccttctcacctccacttttccttctttttctctttttagtctatgaactttcaaaacattggttatattaatattcagaatttgagttattatagtcatgtcaatattattgactgtgagttgaatgttatagtattatgaccatatttcttttctggtactatttttgttcttctttgaattaataataaacccattttcccatttacttatgctttctatacctgtcatgaattcttgaaatctctaacagaaactataaaatcttctataatcatttttttagactttagctattaagtccccttcactacagtcttccctgaggctgcctgatctgacttggttagacattccttaggtcaacaccgtaaacctaattctgcttttgtcttccttgtctggaatgctggatctgctgttttctgcatcctatgtttgtttctttcttggttaacccctcttttcagaaggggttctcaacttctttctgcttggctgaagcttggagcacattctcaaccaaaatgccttcattctctccagaccttagagttctagtttagaattatactttagttagggaatttgactgaaataatatttttgctcagagtattacagttgtgactctaacatcatttagcatctcatgatgctcttgagaagtctactgtgattctgattcctgtatcctgtatctttgtatgtgatcagttttctttttctttttcttttcttcccaaatgtttggtggtctctttaccccagttttctgaaatggttcaatacattaccttagtttgacactcttctcttttctgtgctgtaagttgatgagcagtctcaatctgaaaactctcaaacaaaacaattcaatgaaatgtttaatttttttaaatttttctttgtcaaacatgttttcatcaattagattttaaacctccttggtttttcttttctctaattcctccttacttatagcatcctgttcttgtttcatgggtattatgacttctcttgtagcagagagtgttgtttttgtaatttgaattttgttttatttttttaccagcttttattaagccccaggtccatgtgcaggatgtgtaggtttgttacctaggtaaacttgtgccatggtggtttgctgcacagattaacctatcacctaggtattaggtcccacatccattagctattctttctgatgctctccctcaccatgcccttttgacaggctccagtgtgtgttgttcccctgatgtgttcatatgttaccattgttcagctcccacttataagtaagaacacgcagtgtttggttttctgtttctgcagtagtttgctaaggataatggcttccagctccatctgtgtccctgcaaaggacatgatctgattcctttttatgactgcatagtattccatggtgtatttgtaccacattttctttattcagtccatgatgggcatttgggttgattccatgtctttgctattgtgaatagtgctacaatgaacatacgtgtgcatatctatctataatagaatgatttatattcctttgggtatctaccccgtaatagtaatggtatttctggttctagatccttgaggaatcaccacactgtcttccacaacagttgaactaatttacattcccaccaactgtgtaaaagcattcctatttctctgcgacctcaccagcatctgttgttacttgactttttaataattgccattctgactggcatgagatggtatctcactgtggttttgatttgcatttctctaataatcagtgatgttgaactttttttcatatgtttgttagccacaggaatgtcttcttttgagaagtgtctgttcaggctctttgcccactttttaatggggttgtttgttttttcttgtaaatttgtttaagttccttgtacatctggatattagacctttgtcagatgcttagattgcaaatattttctcccgttgtgtaggttgtccgttcactctgatagtttcttttgctgtatcacagaattttaataacacttttttttaagtaaaattatcttgtgatgcttctctgcctttatttcctcttagtttctcttccccaccatcccccaccaccatggctccataccacattgttctttgtcttttcgctggaagcttttttcaaatggcacatgatctattgttgttaattcatatttagttgttattctccaaaaagattactggaaactctgtgccaactgattattttcacagtacgatgttcagattgagaactaaccattttggggaagatgaggacagagattggggttgatgatactggttttcagtctttgaatgagagataatagttgataccatgagagtagttgaggtattcagagataacgctatgagagaagatccttaggacccacaccttaagaagtatctgtattttattagtagcatgtggtataagaacatgaggtgttattaagattgttgtcggcaatataatcctttcttgagtatatttattgagcatctgctatgtcccatgccctgtttaagtgcttaaatactaatggtggaatgaataggcagagcccctgctctcacctggactcttatatcatgttatcagcaataacatgaaattttgcctctaatatgtggtgagagaggcattattttcctctgagaacatttatttatatttgtctttacttcataggatgaattttctcaggcaaggaaagttctagccaaaaagaaactaatgcagtcaggatttatttaatcacattcagacagcctgatcattatcattcagtctttttctggaagggcatgacaattcacattcaatgactatcaaacccatccttacctcatacatgcccagttaaataaaaggagacctaccagggccatctgacttccaatttaattgacactacagggtggcaggtctttctgggtgagctgaagtcaagataaggtttacaagcagtggttaactctaatgtccttttattacatagctttggtcttacaggacttaaagaactctacctatgtaattattgccataacactaattttataatgttaagcgaagtttatttttaaaattttatggtcatttgagaaatagctgttaccacacagtgattgacaattttaaagccattttcaatgactgaatacagttaaaaagagaaatttgtttgctgggcacttaattttttcatgtaactaagtaacttaagagatactatgcaaccacatttcagatttatggtattttgtgttaaattgtatatttgctttctgaatatttttgacataactacaagagacttggcatttgattttattatagctgtatataaagttggatttttccaaaacgccattttggaactaaattgacagggctgactacttgagagccatactttacagaaacacactggcaaacaacactactgtcccaagagagattaaccttgtaagcaagttatgcaggtgattcaaatcctgttaatctcacataaaaaaatgttaattgcattggcaaagacattgcctctgatcactctgcagttatataattagagatcagcccattcagagaggctctgatctaattgataagcagtcagcaaacgacccttgagatttcttccccgtttttcaatatgtggtcagacataaggtattaacatgaaaaaatcagtgaccttgttttgacatgttttaaaattaagtttgcttgttattcaatagtttaagattttcatgcatacttattttaattgtacagagctctaattgtccaaactctatggagcattaatagatattgagtgtgatcacttatcaatgtattggatggttttattatcaacttactttctaatccacctagcttttcatttttttggagatgattttgagtcaaaaggggagactcaagttacttccttataatttttaaaatttgtgtctgaaaggggcttggctttgtgtttggcttattgtaacggttgccactgcagatccaacgcatttgaaatacatttttggcctgtacaacttctttagtcttcatatttatgtttctgattctcagattttctggaaataaagttggttaagaaaagtggaaaatagttcttacaaaaaatttcttccatttaaataaatgttaggcaaacctacagtttttaacataatgttttctgtgggtaattatgaaaattgcaaagcagaaggtcagtttagtataattaacagaaaacaattggaataatgaataacacagtttagagataattgttagaaagggtgctatggaaattctcagaataatactttaaaatatgtgaccaagctccagtatctcaggaatttcccatgtcacatgttggacagcacatcctaatacccaggtataaaacccatgttgatgtgtcatgtatgtgcaggcgactttcatctcatttattctttgcctttgttttgctttgatttgtttttctatccattgaattacatttttcaccatgagccaatgtcagacttccaaaaattgtataccacatatgctcctgtggttatccagttgctaagcaactggactctgcttgagggtagcagggtagagagaaggttcattgtgaagtcctgcacccctgctgagttcatttgaacagcagcagggatcctgtatcttgattcttcttgaaattataaatcaagtgcctccacgtgtctccatataaaacaatgaggcttagaacaagtaccatgactaaaaaacccttagggatcctaatggtatccccttgaggaagggacagcttagttttgagacatctctgatgtaacgtttgccatttggattaattatatgttgtgattttgtgactgttagcatgttaaggaaagcatacacaaactttgcctgaaaatataagtattttaatggaactggtctcacatattgtttttcaatttattttatacccagcataatgtcatgaaaacttttcatgttagataggtagatagttttaatattgcaatgacttaacagtttttcaatgtataagtttgctgcaatgtatcctaaaatctcacattttccaatattgtcagttttgctgcaattatcctatggacttcttagttttgttgcagttatcaattatcgaagccactgttctgcattgttatattttgcagagtgtctgcaagtaatggtggctttggttcttcttcagggctcatatttcctttttcttactgatttttaatgtcggcatgcccgtcttgttccggacttcaatgggcatgacttttgtattttactttttttttttttttttttgggacggagtctcgctctgtctcccaggctggagtgcaggggcccaatctcggctcactgcaagctccgcctcccgggttcacaccattctcctgcctcagcctcccgagtagctgggactacaggtgcccgccaccgccccagctaatttttagtagagacggggtttcaccgtgttagccaggatggtctcgatttcctgacctcgtgatctgcccacctcggcctccgaaagtgctgggattacaggcgtgagccaccacgcccggcctgtattttacttttaagagaattttggcatttaatttcttgcaaaatatcttcatcacgtttaaaaagtctgtttgattccttctttatttagatgatttgtaatttgatagctatatctacagatttgatcatatttatcttcatttctcttcctattatataagtaacctcctttatctcattgaaaatttatttggcttcaagtaatataaatctgccgaacaatggcttaggcataagaggttcatttttctcattcttaccatttctatgatgaaaggagcttacacacacaaactcacacacacatgcccacactcacacacaatccatgttttacctgccagtctgtttcaatttgctaaatgaaaagttgagacatttccttgagtttccttttcaccctatgcgtctgactgatcacccagttttgatctctcttgtctgtccccttttcgacatcctatgaaccattgtgtcagtttaagctgaaataatttcttacaagaacgctttgacctaattcacgactttatgtttctcttctaatttatctttcacagacataccaacacgacctttttcatatgcttattcaacaagttgcttacttgcttaaagtccttcaatagctctctatcaacctcagggcagagctcacagtccttgagtggtgaacagggccttcatggtcttatcactcactctctgtctagctttgtctctcaccactttccccaatgtaactaacctgctcactattcaccagcttgaccacttagtgaaagcctctaggagtgggtgcattaacatgtgctgaatgagtcagtggatgagagaaagacttctctagcttgttcatcccagtgtcaggatgtagtatgctactcccactaaaatcaaagggaacaggaaaggtctcctcttgatgaatcatttttcaatctggagtaatatcaatagtgtctcaaacctctttaacattgggttaatgtagtttttggatgaatagctgcgcctgatagcacagaagaagtcgatcccgcttcctatgtgaatgatttattttttactattagcatttgggaccctcataaggatatattaatcctattgcctatttaactaccagaaatgatagctcaataccaactatgccagccccaaaatagctgttttgggcacatagtgtacagagttgaaaaaagtaacactaaattattttatccgacatgttgtctacagggcacaatttgctgctaatttattcagggcgtctaaaatctttagatgcaaccgtgtttttctttagtttttatggatcgtttgtcaattctgcatttacaaaatttttcatgatgaaattctatttgtcttgttttattgcttgggatttttgagtcccagagtacggatactctagcatatgcagaaaattttgatccctactgtcaaattctctggagatatacaatagtcttccttctaaatgccaatggtagttggttttattgcaataaaatatttatcttgcaacttacacatttgttttataaatatggatcttgatttagtcaataaaatcaaatactcttatttatactcttaacatctattatttgaagtaatttattttctttgaaggtttcctgccgaatacattttagtttttgtgccactgtatacaaaattttaaattagaaggtttgaaactcaagttctaagtggctaaatatgtccagatggccagaaaaattgtgtcagcttcctacagatctcatctttcttttccttggcttagttctctttctacctcagtaagtagcaatattgaatttgtttgtgatttgcagatatgggctaataaaatttaaatgacaatttttccagtctcagaccattatccaaaagggaagaaactggacaaggaatgccaatgtctggtgatacataaaactactttttgatttgtatcctcagaggctaagaatcttatggataggaaaagatttttatggatacagacttatttttctctagccttatgtagaagagtgctagaatacaatttaacagtgccaaatacagattaataaaagaagaaaggatgaaaacagtaaaacagattactgaagaaataaaaaacataaaattaagtaaaaaaaaatgggtagatatctcaaacacttaagagaagaccattggagaaaacctcaaaaaattgataaataaatagtttgcaacaattaataatgacagtctttgtatttaagaaaaaaaatcaggtagacatctttccatacatgaagttaaaataatcatgggaatattgagtccttatcaaatcatagcttaagtgggaaaatctaggtaatacatatgtgtgaaagtacacattttttggttttctctagcattcttgaggaatattaatatttgttttttaaatgtttttatccctttcaacttttagttttcccactttgaaccctgataatagattattgtaatcatttttaatctctctttttcctgtagaattcagtgttctgattttttatgataggatccacctgatttagctcagggattcactgaaaaatcaatttaatatttttttccaaaggttgtatggtcttatgtgcaaactgtagctattcctttgttccaaaatatcttattttattgaatgacattggattcacaaggccttattaaaacacagctgaggtacagagttaggtacctgtgtaccaaaagtaaattaggtttcctttgcttttttcataatgtacttaaagcatgcataatagtttatctcattttaccattgtttcattttttttttcaagaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtaagaccaacatatggatggaagattgttagataaccaatgaataattagaaaataaaaggacagctacaatgccaccaccaaacactcctatgtcttggggtactttcactcatgtgatttttacatatgcaagccacatatttactgtttgtatgttaaagtcctccaggctttcaatgtcactctttcaatgagtatctacattaatgcttgattcttcattccacctcttatccccagataccaaggattcctgggtgccttctttcccctggaccctttgaggtataccattctgttcctgcagaatgccccctgcaggcctccatcaatgactgcccgttcccatgcttcatcccctctggataccctttgtcacctctgtggcccaaagcataactaacaaaagactattgcatgtggctgactgtaagtcctggagtaaaggaaaggtcagcataacactgaaatggtagcaagtagttggcatcatttttcacataggggatttccaacacagagaccttctgtcactttcttttttccatctcttcatggagaccttctcttccatctccttcttattgttcttatcacaaaacccccaaacccaatctctcaaactctaacctgtattcaaaaatgcttttcatcatatataaaaataattttgacttgttgttatagaaatttccttaaggccttgccatttagaatgaaataagtaattcaagtgttttttgttgttgttgttttaacacaagtaattttatctttaagatttgttatgccttcctgctagttctacctgctgatattataaccatcatgcattctccaattactgcctgcataaaattgtacaggctgtgtttttctaatttttcttttttttaaaaaaaattttttggctgggcacgatggctgactcctgtaatcccaacactttgggaggccgaggcaggtggatcatttcatgtcaggagttcaagaccagcctgacaaacagggtgaaaccctgtctctactaaaaatacaaaaagttagctgagtgtggtggcacatacctgtaatcccagctactcgggaggctgagtctggagaattgcttgaacccgggaggcagtggttgcagtgagtcaagatcgtgccactgtactccagcctgggcgacagagtgagactgtctgaaaaagaaaaaacaaaaaacaaacaaacaaaacaacaaaacaacttcgtttctttcaactgactgatattaaccatgcttcctccgaagctgtataccttttatgtgctttcactgctatcagtaatttcctaaatgtaaacattcatttcaaaatctcaattttataaatccctagatatgattggatactttacttcaaaaggcatgtcactcatggattgaataaactggattcaaatgcatcaaccatttataatagttactgagaggttctttacaatctacaggaataaaacaagtgaaaacattaattcagttagtttttcagcctatgtagtggggaaagtcatcattgtgtttgtttcatcattttaatgccagacatctgtctttaaaggaatggtattagtagaagaggtttgtaaatgtgaggcttttcatgccctctcattggagaagcaggttagaaaacaaggagagtttacactattgaattgttactgtccatcctctatatatagtcagcaactttcttcaaatttgagagcatgtagtgaataattttaaaatattaatgtaaggtgaagagattaattctatagtaaaatttatcctagtgtaaacacaggtttattttaaataactgggagtatatgcccttgtgcattgaaactttaaaaacctttaattttagaataattttgatttataggaaagttacaaaagttagtaacagagagttcccatttacactacacccagttttccttattgttaatatcttacatgacaataaaacatttgttacaactaatgagcaaagcttgataggtaataattaagtaaagtgtatacattatttggctctcccaggttttcatcattgtcctctttctactccaagtccagttcaggtaattattgggttgggtatcatagacttctgcatttgttctcatatctctccagtctcctccgtcctgttacaggtccttagtttttctagttttgtgaccttaacaaccttgaagggaagtgctggccaggtatgctatcgaatgtgccccaaacttggattagccggattagactgcgtttataggtttttaaaaagaataccttagaaatgacatgctcttcttagcacattgtatcagggggcacattatatccatataacagcactggccaccctgttaattttcaaacactgagcacgagctagttgacaaaagtattaaaaatagagaattgtaagtgtgcattgcattttaacatgtctatgttcctgaattaagataaaataaaaatgaattgagcctagtttgattatttccagcttaatgtaggtgttaggtcataaacctgacaacttaagctgctacactgttctctaaatcttgccaaattcatttgcttcaaagtacaaatgatacatataaatcaaacaacagcattaaagctacactatcagaaggtatgatatcaaggccactaaacaacaaggttgaaagcatgagaaatcttattttcactaacttcctttaaaacattttcatagctttggcctctttattctttttaccagcatattatggtagtactttgtgtaaccagttaaatattttaaaaatattagacaaatggaagtgctgtgtaagctttaaattgtttttgttagaaaggcttaaagcaaggataagtgcaatgtagaaactgaggtcagtatttcatcatgaaagaagcatgtactttttcttgaattcccagtctttaagtgatgtttcagaggagtttattcattcctcgatttgtatgtattagcataagcctcacttatgcataatgagagagaaagacacctctttccttggtgaggaataacagtaataacttttagccaaccgtagactaaatcaacaacattgattctattacattatttaggtctcagactagggagatggccattgttcttgtataagcaattggtgtggtgcatgacatttctttggcttaacatttaatgaaatttgaataaggtttgtgtagtggttcatgcttaacacatttatacgaaagctttgtagggcagctgcatagcctgtaattactatgtaagtaatatgtgactatttttcttttggagacaagaaaagcttttcaattcaagtttaaatttatgaaatgctgtgagagctattaaaaccttcaacacagaagaagatatctgtgccaacctttcagtaaccagagatgagttaagggagtattttttccccttgccttgaaaatattttttaagtagtactgatatgcctctttcttttatttagtcttaaactcctgacctttctcagtaactacctttaatgaaattacaacagactcttagtgagttgtattaaaacattttctgaaaagatgaatgtttcagtttggtaggaagcatagcaagtctaacaataacccttatgctcaactagggaaaattatttatgtggacattttccatgcgaccaagggacaaaatggaaaggagtctacattatacatattagtgccaaactgttaattccttgcagagacttctgaagatattaccgtttcacaattgagtatttcaggaagcatactgattctgtgccaagtaccaatactgttttctagaagatttcaatacatatgtgttagggacaaaaatttcataacactaacgtgagaataaagtgagtaggaggaacaagcaagtgaaaggcattttatagtttataatgattatgatttttgaagcacatttttaaagcataatttaaatagaagaagatgcacttttgggtttacctacatttagtgagtgcctactacatttgtaatgctcattgcaagtttgaaaaagtaagtcgttttaaacaaggtaagttaactgttatcagttctttagtttttgttttatattagtgagattgggtgacgtgggaaagtatttacattccaaatacagtaaagaagtaaattggaacagctctagttattttcttgggtactgtctgtcttttgcaggcaaatatccaacattttgcttattagtactgtcttgatagagtgccttcaatacatcttttcacaaagtgttttatgtgatagaagttgtcagtatttataataaatgaggtgagtttccatcttatgccatgttccctcataacataggtttattgtatattttcgttatataaatatatttatgtgctaaagctctgtaaaaaagtatcacatgaagaaacattaacataacacaagtaacatgccataaagaaacagtataatacatttgtaaccaaagatataaaaataaattgaaatatgacaacactacaatattctgttcaatttaatattaatgagaattttaaaaaaaatccctctcagaacttgggtaagagttagtgtgattaatctaattgtgaattcttatctgtgcatgtcagcagagtttgtatttcatttcattattagcagtctttaaagaactgtaaacaggagatttaatatctctcatcaatcatataactttcagcatattaccattacctcctttatcttttttatttcatttttattttctaaactaactctaaagtgacactaagttcctcaataagaacttctctcttccacagccgagaaaggaatgttcataatagcttgtcagaagaaaaaggaaataaaatatgccatttacatttttacgtatgcctgcaaattctaaatgcagttgatggcttgcacatagtggatataattaatgaatatttcataaaatagaaaagggagtagagaataagagtttcaagatatatggagcaaaattctatcaattttccttaacccactgacaaaatttccttttctaaagtgcaagtctattttaagagagaattttcagagtttttagttccatgaaatgtgagatttgcataagcacatgattctttaagaaaagaaactgaatggaactacttataattcctttttttttttttggatggcatttttatacaaagtggctctttcttcttagccctgcaaaatgtgtttagattaattgtttggaagctctattgtttagagcatgtgcttctgggacacagagatgctgaacaggtgctcagctacccttaggaggcaatgggccttcttcacatacagtgtatgcatcaaggacatgggataatttgagctcctgataaataaccacactgattaggttggctggtaaagactgggcaagtgaaatggtcttagcaaaagaaggaaaatctaagaacaggagaaaagcaatgaagcaatgtgtacaaaatattgtaaatgacatctaaaaaatggactggttcctaaaagtcacaaatttaaagaaaaagtgtaaatgaaaaatctttattttttatgctatacagatgtcttatccatgtctgtctaaaaacaattggaaacttcatgagcaatgactgtgggaccttttaatacaaattacaataacatacaaatatttaggccattgccaaggggttttagactttaggccttgttctgctactgtttgatcatttagtttatttacactgccgttttctggaaatgatagttgacaaatttctctactgcaaactaggaatgtgatcttgaagaagctatttaaactctatgttttacatcctgaaaatatggcccagcaatgtggtaggactggtgattaacctatatttttactgatcttatagggtgaagaattatgccatccattctaactcaaagggctattaaaatgatataaccatttcaaagcactgtaaacattgtacaatggatgcacatacatggtgcctcagttttacaaatccacctgattggtggcatttattaataatgcagttaactacagggaaaaaaattaatgctaaaaaaatataaaatatataatttgtatataatgacacattttcctatctttggccatatgatttccatagaaacatatacaatattatttttaaataagtatcacttacgctttttttttttttttttgacggagtcttactctgtcacccatgctggagtgcagtggcacgatcccgcctcactgcaccctccacctcccgggttcaagtgattctcctgccccagcctcctgagtagctgggactataggcgcccaccaccacgcccagctaatttttgtatttttggtagaaacgggatttcaccatgttggccaggctcgtctggaacttctgacctcatgatccacccgcctcagcctcccaaactgctgggattacaggtgtgagccaccgtgtctggcctgcttttaaattatatagattcatttataaatgtttctagtgactttgccaagtctgaaagttgcctgcattttctacctttagtaagctatacattctcctggtattgtgtgccacctccagtgcaatcagtcacctgggttgagaccttcacatttcacacatactgttttgtttgtctgtgagtaataagcataaaaccattattataaaaagatgtgtaatgttaaaagcaagtatttagggaggacttaccatgtgccttacaatgcaataaatgctttttacatatgttaattccattatttttaaagcatagtattacagcataatattactcctacttgagggttacagaaacagaagcttaaacaagttaggtttttaaggccacatattaataagcattagggccagaactgaacttagaatctgtctagcatgaaatctctattttaaatgagagggcatgataattatatgattattaattatttaaggatttgagtcacctatgaattttatattttagatagaaacttagataattggttagaaatactatattatgaataactaaataaacatagtatacagcaatagagttaaggtaatttttagaccaacttcgtaagccacacataaaatgtcttgacattataaaaatttaaacttagaacagttcaagtttaccttcttggaaactgaagatatagattttgtttttacaaacaggattaattgacaactttcagagggatgacagaattgtagttttcctgtgttttcatcaaataggtgctaatagttgctgttaacacaaaactaattgccacctacggtggggagtgcaagttgcctagtcctgtgaccacattggcccatctgttaagaatctcagcttaggaacaatgctggaactggcatccaatttgggttctggccagtggtcaactaacaagctggaacacacatggaatatgaaatgccttgaagtcagagatgctctgctgtctgttaactgacagctcttgtgtgtgtgggcagagccaagaccaggtgccagtatgcagagcaaaaggatctgtctgtgtgccacctgtcattgccatgtgcgtaatgtccaaacaggagccacagtaggtgtgtttcttccatcaaagtgtggttgttagagcattcagttaggctgaggtagcgactagggcaacattttaccttaaaccaaactataggacaagccagaggcttaccagaaggtagctctcatatcccgccatatcacacaagtggatggagatttaccactggagacactctcccctgtacctaggttcttacattaactctaagcaaaaggtaaaaaaaaaaagttgtttaattaattatattaacacaaatacttgtgtgcacaagacaatttgtggttagaatcatgcaaataagttttaatcaccccaggggttattctaaaaatatatttctaactgatttttgttattattcttaataagttgaactgtaacataaggctgaaaggtataatagaatttaagagatcaatgttcttatcccagctctgccataattcatcatgttattttaagcaattcatgtaacatgtctgagtaccagagtccacatctgcaaactatgttggattgaatggtttcggtgctgtcctcaaattctgaaaaattgtataattctatgtcaatctctcgaaacaattagagaatcacggcaatattttttttcaatagaagaaaaaaagaaaccagaaaattgaaatagatggacataaagaagaaaattaatattacctgtgtatctattatccagtgacaactacattttatgtatagaaggcatcttgtaaacttatttatattttagacatatttttcattcaaaattgttcttgaccctgaatgcttacttaggcttttattgttaaaaagccggtactgattcaaaatagctgtttctgactgcattttcctttcccataaatataatattaataaatgatatttacacagtgcttactgtataccagaaataatctaagcattttacaatagtgctattttatttttagaaaatgctatgatgtaaacattattatacctataatataaatatcaaaactgatatgcagagagggtaaatatgccaacatcactgactatgggacctaggatgtctggcttcaaagtccacacttttggctactacatagtggtgctgagtgggaagaacttttcttcattttttatttgggattgaagataaggaaaagacagcctagcatatgcttgcctagaagtagaatttttatcatatagtcacagaatacatctatatagaaagcacatgttaaagttttgaaaatttttattataaggacacttatttcccataatatatgtttattatgtcaaataaagaagtttatgtcttttcctttaaaatcattattttatactacttattgacacaaaatttaaaacaaatctattttttctcatggaatgttttaacttgtattcttttcttctcaacactatattgggtaagaaaaaataatttcactggaaacatattagaagttaaagaagtgcttgctgaaagagtcaaatggtgtgagtagggtgtgattggccctctccatctatgggtgccacatctgtggatttaaccaattctgataaaaaacattaaaaagcaacaataaaaataatagaaataaaaatacagtattacaatgatttacgtagcatttagattagatatgataatctacgatgatttaaagttgcaggaggatgtacataggttatatgcaaatactacattattttatataaaggatttggacgtcctcagcttttggtattttcagggttgtggggatggcagtcctggaactaagccccagtggatactgagggaggactatgtatacatctagaatgatgaactcttctagggtattgatagtttaattcatctttcacattcactgtctaacaaagttctcagaccaaatttaagtgtactaaaatatggtaagtatagtcaataataacaattctatattttaaaataatttaaataatggaactggattgtttgtaacttgaaggataaattcttgaggggatggatagataccccattctctacgatgtgcttatttcccactgcatgcctgtatcaaaacatctcacgtaccctactatgtacccacaaaaaattttaaatataaattaaaaaaataataataatataaatggccaggcgcggtggctcacgcctgtaatcccagcactttgggaagccgaggcgggcagatcacgaggtcaggagatcgagaccatcctgactaacacggtgaaaccccgtctctactaaaaatacaaaaaattagccaggcgtggtggcggcgcctgtagtcccagttactcgggaggctgaggcaggagaatggcgtcaacccgggaggcagagcttgcagtgagccaagatcgcgccactgcactccagcctgggccacagagagagagtccgtctctaaataaataaataaataaataaataaataaataaataaaataataataaggctatttggaggaaaaaagtttcttcaaaaataaatcaataggtactaagagtatgatttttgctaatttcctgataatgtttgaatatcaatagttccatggatggttatgagttaacaggtaggactgagttctaggctatatattttctacccaataaatatttttttcatttttttaaaactatgtaatggtccctcaggaaaagttgtaatttgatactattattttaattaactggtatgaattaaaagagaagggataaaaaagaataatttctgagatccagtactacaattacatgaacaaggaacatatctttgttagtgtatgaaggagatataattgccaaatataaggaatgggaggacaaatagtttcaaagtatttcagggtataccctgatccccttcagtgaagtcatttttggggggatctctgttttagttgttacatagtataactcactggcgcttcattttaaaaggccatatttggaggtgggaggttagccctagggctcagtgagtccttgccgagaaattagaagtccctctgagaagtgattcatcatatagacctatgggataacatcataataagatctcagtataaaaattctgccagttattcttatgagcatgatgttaaaattacaaaaggtattgtaataccattcaactcattcatcagtatagacatttgaaacctttataaagatgatctggttgggtatgctatatcattgcaattctttaaataaatggcagttgttataaaaatatgtcctatttctgacacatggtactcaccagttaagacattcagtgcagtgcttctcaaaaaaaaaaaaatgttcaattaaacccataaacattctaacccactaactgacattttctaacagtttgtccaaatatttaccaccacaaataacagaaacaaaaaagtaaaagagacctgttatctttatttgagagagtatttaaaagtgagaaagaaaatgcttttgtcttcattatgaacataatttatagtaagacatatatatagttgattttctcaaacgtaaaccccaaatcgccagactagtcaaatattatatatcaagaattatttcaaaaataatcccattcattgaatattctgtgttgatatttcaaggaataaaaaaagatgagattgttctcaaggattttagtaggtagtgtgagatatgcataacattattaaataaggtgaactatatacaaactatgatatttgaggctctttatggcttcagaaaataaaagatagtctattcctatatgaaactagagataggtctgaaagggaaaattgaattttcataagtggaatagcaatggctatttcaaaagaacgaagcaggatgaaaaagctttggaaagcgtgggccaacaattagtgattcggtttgcctggaacatggaggagtggcacttaaggccacaaaggttagttgtggttctattatgaaaccctttaatttcaagtgaagtgtttatatggaatacaccataaaatggggattaattgaagcacattgaatagaaatgcatctttgtgtccacctttagaaaactgattctttcatgtagagtagcttggaacagagaaagtttggaagtaggcacacctggtaggaagctgaaatatagtttagggaatacattgagtgtattgtgtgagttacacaaatatggacattaatacaagtggtcatacaagaaaacctttttttttttcaattggcaaataattgtatgtcagagttattggaaaaagagaaattaaaaattaatgctgagatttgtaacttgggtgcctggtcaaaaggtggtgtgttcaataaatagagaagtcaaaaggtattattcagtctcatcatttttaatcatgtaatagtattttctatcactgaatccaaggtagaattgattgtgagatttagtagtattttttctctgagttaaggagaggaaaaatgaccaaatcaactatgatatgccatctatgataagatgattcctaattctggaggtgttaaaatataaaaatgtgcatcttaaaatatattaaatatgggagtaatagctaatatttacaagtgctttccttagaaataactcatttaatcttctcaattttcttatgaaacaggaactcttatcattgttatttgataaatgaagaatctgaggggcaaatataaatgagagagatttgaatccaaatccaaatccaaagcccactttcttgactactatatacagtaatttatttctagtaaaacatatttaaaaataatggcataaactaattttattttaagggctcactggctttctgcttagtggctacacaatatttttaattaatgcttccagcagccttaaagtttgagtcccttctttaaacagaggagaaaactgaaggttagagacagtgaaaaacatgctcaaggtcacaggaaacatggtaacaaaactggattcaaacctcaggtctctctaatattaaaagcttgtgctcatggcttatgttggacccaggacgcccttcattccatgtgttagtcaatggctggtgacattttgttttgtatatttctatataactttctaacttgaacaaactcatacagagtccaaagttcagtaaacagaaaataaagtgattcttctgctcaaaatatactgcgtggtgtcccagtgtctccattgtgcacacttggaacaactttctaagagaaagtagtgctcagatcatcattattataattatttctttatctccccaactccctttgccttatttatgtttaatcctaacaatcctaaatatccagtcctatgactgtcacatggtgctcacgagttagtcctttagtgcagtgattctcacgaggggcaaatttgcttcccccatttcctgatatacatttggcaatgtctggagacatttttgattgccacatttgggagattgggtgctactggcatctagtgggtagacaccaagaatgcggctaaacgtcttactatgcacaggacaactcccacagtaaagaataaataatctgacccaaaatggcgatagtgttgaggttaagaaatgctgatttcatggaaaaaatcaatctgggcattgctcaagtagttattttatgtaatttttattttttgtttttaatgttagggcaaaaataatagaatataattcactgaaatacacttcgaagataataatctttttttgttgcctgagatatgatggttatacaaaatgagataaatgaataatatcataatttggtttgatataggcatgtcatcatttaacacaagaagaggacctgttggttttctaatgatttgagatgaatgtatatttttgcaccttttctagaatatataaggcagataatttttcttcatattccttgcacatcagatagttgctgaattggcgaaactagtaaagaatatcctaattagagaagtgtctgaacctcattttcaaatagacctacaaacccacaagttatgtgaaacatttaatgatcagaagtgttcctatgaggttgtatggaattcatgaattattccataaacacatttcaagaggaagtttctcttggcaaaagaaaaaagaagaaagccttttgaatcttccacagcatctcggactgaacatccctctgataatgtagtcacttccccagctagttctcagtttgaacactgatgaaggagacttcttagcatttttccaacaaagacagcaaggtcgccaaatagatggcacattcggaaatacattttaccaattttaccgtgaattggctgtctcttatcacagcatttcttcttgcacacagaagactgcaagaatgggctctgcctatctaaaaacttccagtctgagctgtgagctctgtggattcttgtggatgtgatccctaaagtcctgtcctgaaaggacttaaagttgggttaatttctacccaaacgcacaactatgagctatatctacttttccaaatctaataatgcaatttctagtcctattgtaaaaccagttttgaaagtatttaatccagtaaaacaattatttctaaatgaaaggataacttaacttgcttccacaactttatttgttccagtaggaacaaatgttcttcttagttgttcttcttagttgtaatatatttgtatttttaacagtaaatttccaagttctacttattcaagaacttattgaaaataatacctgcaatatttttaaagtatttaaaagtaataaattcaggaagatgcaccagattttatttaaataatctatgaaaagttactggaaaaattgccaaaagagtgttgcatattaaggacaataatgaaaataatgaaatactcctttctgatcatgataaaccaaagaaaccctttctctataatctaatctctataatgctttggatttgatcttatatgaatgtagaaagaagaagtacatgatttcacaaagcacatatgtatcttgttctcagaactgcagggagcttcaataattgttctgattttcactaaattgaaagttccagccacctctatatgtctttctcaaaatgttgcaaagatatctttatatttgaatctctaatctttaaatatgtatttatatagtatatatatttttaaaatatatagtaaaatcttgaacgttttatatattacaaaaatttatataaaacatatattattataaaatgttgtaagctatatagtgaaagcattatatataaatgtatatattaaaggtttagagatttctatatatatgtgatagtataagataaatatatacatattaaatatataaatatatttaaatctctaaatgtttaggagttctcaatttagtgaaaactagaatgactgtagttgatattaaagttctctgcatttttgggaacaataatgtcattgttagtgataggtcagtgcactatctgcagctattcatagtgtaatgacaaacaataatgaccaccatgtcagtgatttaaaatattctaagtaaattctaaagttgtggcaagttctttgatgttaatatttgatataaatgaagggtttatcaataatggaatctgtttataatttttatcatatgctttttaacttaaacttaatttttatcttaaaatttttttaaaaaacaacatttagaccttgctctttttttaccgctgaagatcaaacttcggtttcttcatctaggcaacaggggtgcatgtgtgaggggagaaaatgtatttttttctcaactctcataagtttgtagttgggatagactgcttcaacaaaacacagattaacaagaggaagagcaaacaggtttattaatgagtgtagtgtatgtcaaaatgagagaggggtaactcaaagcagtggtttacaagtctggtttacatattatcttcaacaaagaacatcaattttagaaaagtgacaagacaaagtagtcgtaggcttcaaagacaggagaataggaaagagtcgtttgctcctccggtgccatctctgagctgatgaaggttgcaagggagaaattacagcctgtcttcaggtgggaaggtaggaaggagggtagaaaggccttttgtatttgtaaatttctgtcctgacttcagcaaacacaaaggaaaagcagcaagttcccctgcatcttgtcttccccagcttaacaatcccgcatacattagggtatggtttccttcataaggttttcaggttaaacaatagaacaaagacaggtgtgagcaaggatattctatttaacttatatctacctcgaactagaggttaggggtggctcctgggtcctgtgaaaaactgtgttaattgtgttaatattcagaattgggagggattggacatagagagaatatttgaagtggaaaatgatgaatagaagatataacttgaacaaacttagagttcaaagttcagtaaacagaaaataaagtgattcttctgctcaaaatatactgtgtgatgtccccagtgtctccattgtgcacacttggcattttgtcatgagcaatatttgatgccgatgagagactataaccttccccttcctgcacgtgtacagccttcgtttattccctcatcaacaaatttgtcacggctgcctactaggttcaagtaactgtactaagttctgaggatacagctgttaataaaagtgacagggtcatgcttttatggagattgaaatctagaggtataagtagatattaaattaatcccgtgtcagcataagcagaagtagttgggctaaagggagagagaggtgggaggtatggggagtgggccagatgtgaaggctcagcatatgcagggatgcaagagacagcccgagaattctggggtatagttgagtgctcgagtataggaggggactggtgaagtggccagagaccaatgaggatgtcacatatagactgagttcagaagtttgaattattccctgagccctccagagagccagtcaagagtgaattggagtttttattaatctactgtatatatttaaagaagacagtaaactgttatattaacataaaattggggttttgccaggcaaatggaacattaaagctatggaacaagataactgaagatatagacaagcaacttatggaccacgacatctaagcagggtagagaaaataaagaagatacaaagggttgatagacatggaggaagaggttcagtctgtgaactgaataagtgaggaagacacaaccaagattatggcaggatccgacatttgaacctcagatttcaaaggcagagccatttcaaaagccagagaggtcagtggccaaagagagatggagacaataatatcactggaggaggttataagaatgaagtgagttcagctatggaaaatgttaggtgacatttattgaggatttactatgtgccttgtgcaaatctcaaaatgtattgagtcattaagttcttataacagccctgtgagatagggcctgttaattatcattttaaggaagaagaaattctaaatatttcatttgaaaactggatgacatgatactcaatgaagctgaattttgttttggtttgctgtattttatatgcacggcagaaaataaatatctcattcaagtaatatttattgagtaattgctctatgtcagacacggagtaattgcttggaatggttggaggcgtggtcttcattttccttcttcctccgcctttactccagagggcaaaccctcagtaaagacccagatttgcattaaggcatgaagaagaaatatctgagaaagacagataagaaggacacttcacaaatcaggaaacaggtagtttagcaagcacagtgaaaaatcctcatggagatgaccacaaaaattttgtgaggggttattttagaggagatgaaactcatttcagaggaaatgaaatacaagagaatgagatgacaggagaagatggaaacttgggcgatgaacaaaaacaacgagctgggaactttacagctggccacaaatttgccaagaaaattaatccctggagcctcccatgtctaccatgggaatgtaagatgggagagacgggcactcagaagacagccacaggctacactggttaaaacttgaaaggagttctggtttagggtgagcaggatgctttgatgtctgaaagagcccagctgaagtttggtttcattgcccacactccagagagaggctctagctccaaggtggtcagtacccaaattccttggcatcggttcaagtcctagtcttttgggcctagttaccttatgagctgaaatctgcacttcattaaatcaactattgtcctgttgcggtgaacatcttttttgtttgtatgtcttcgcttagttttttagctggaaaatgccttgctctctcagctgtgctaaaggaagattagcataggggtttgcgtttttcagtcaggccgaagagagagccagtggtcactggaggatgaaggtaagcaatggtagaatatgggaagtcaagagaggctaaaatattgtttggtttggctaattaagacaagataaggatgccatcatatttcaagtttcattttggttttctgtagaggctttcagaacagaacagcaagtacacttgaatgataaccttgcttcttactatttccctgcaagtgtaacctcccaggattttttctttctttcattttacaatgaatgctgtgaaaatttttattttcttaaaagggtatccgtctctcatacttctctaaggtgccctgcccagaagttgcttgcaacctcatccctaagagaactggcaaatattcacctcacccaaactgtgaacattagcctgcattataattatagataaaaagaaaagtgtgacctgtggttgtctaaagattaaaaacatagactcagtctgtaccaacaaaataatggcttattgtgttcgttttggggtcttagacctcaaaggtgatttaagtaagagcttgcctttagaatacaccttaaatattgaagattaagaaagcatcatatggaattagattgccgagaagtgcttatgtgattcttaataggagtttcaagtgttgcctgtgcaaagatattacttgaaaaattgtgaatggagagagcattttagaaaaattgagcaacttttcctattttcagctctcaaaattgaaagaggtaaaagatttaagtttctgcaggaaagtttatatttcatagaagcgtgccttgaataaatttgtgagttactaaaatgcatgttttaatgtaattgaataacactgtcactaagttctagatggatgtatctccatgtccataacatggtacagtggaactgattagttagtttgtatgtataaaaaatcagtacagggttccataagatgaataagtgattttctcctaaaaattcttctgttgaaagtaagacattacactatgtgacattttcatagaaagctccatagtgaaattttcttgaattatggaactatggaatgcctataattatagacctttactttctgaaagagtctgaaaggtataggttgaccttcggctatttgaattgagtggaagtgtttcaaaaattgaaaacaaacctttcaagtctccttaaagggaaagaaacatttactcatatagacattaaatgtttcctggttcaattcatagtttttactattggccaacttaacgattaatacagcagatgcataataaaattttaagtgctaattcaaaacacttgttctagaattggagccagaaatcttataataagaagtagtaggtgatttcaaaaactaaacatgttgagaaaatacatttccttccaagaaaaacaaaggtgcttttgagatgagaatggccagtcaggaagttttatagagtccttacataattcaaacaaggtgatgagatacacaggcttgaactgagcatgataaaattccagttggtaataaaaattttaatttatatttcttaattttttcctcctcctaaattctgtgttcattgtggaaggcttgggagtccctaaattgtctgaattatattcttaaaagctagaaaatcatgagaagttcctacccttgaggcttaatgtgcatcaggaattgcaaagtatgagtaatgaatgaaatgtggttataaaattttgccagttttcaattcctgtttgatattttaaaaataaatttagccatataggaaatctttccactaggtaggaaagcaggtatgtttatgaggaaaaaataacatagattcttttatttaaatttggaaatgattttagagtgtagtactttttttcttaaaacatacttaatatttctcttttgaagtgcttttaagattattcatcaaatataagatcacacacaaacagaatgttgcatgcaaactgtgggttttaagtattaaaataaatttactttgttttgtttgttattcagctgaacagatggtaatgattttgacacaattcagttttcgttttctttttttcttccttgagaaaaaaaccctgcaaaaacacagagcttcttttccactttgtcacagctggttaccaatcaatctcaattcacggtacagtgatgatagcacacgttgtccaggggccaaatctgattgggttgcatttttcagcagtgtttcatatcagaaaaaataaggtatctctatggtggggactgtcggcacacgattgtacaactctcattaatcaaacttggcaacaatgactgcatttatttaagtcaaagactagcagatttcaaaatgaaaatcaccaaatttctgtttgaatttcctcatcagtaatgttttttcatctgtttctttttttcttggttttaattacagccaatgataccttctacattgacactgatcattacatatgatcaacctcctgtgttgatcatatataatataatattataccatgttacaaagtagctgtttcataccaaaataaactccacttattgaaaatttattctagacttcttaaagaatgctaaatgcaattaaaagcaaaatataaatacctttgattgtttaataggagaataattttaaaggaaatatacatcaggaaaaacatttatgaacctcccagggttacatttggtgttagaggaatattgagaaaaaatattgataaagttagtttctggaggttttgaaactgaacacaaagtcggcagtacataaatacctacttgcccaatgcaaatgcacacagagcaataaacacacacatccaatagaaaatgcatgctgctgtttgttagaaaaataaatgtacttataaagagttccagtcacttcataacttgagagaacaatgtcagcattttctgtaaaattgtgtttggaaacagacattttctctaagttatttactgctgtgcaattatatgtaaagccctgttgtacactataaagatgtctttaaatgtaaggaaatattatttataacttattgtatcactctgtcaatatttgctttgaagggagaaatgcatattttcccaattttccaatgtaatggttacaatgacattaatattaaacatggaccaatgtatcttgaaagaaatctaagaaataaggccacatctgttagacctgggaaaatacttgaaacctattagttttagggagcaaattattgtcttagggaaaccatgacccatgagggaaagcagagactggtagtagatagtcacaagagttttttccccaactataactgcctccatatgtggttttgggaaagaaactttgtcatgttttgcttcagattgcctacatgtgaaattagtaatgagccaactatttacattctagattttgaagttacttagacataatttctttaaaaatagtctttatatttcttaagcttttgcagataggagttaatctgatcacaattacaggcctatcctttctctgacctgagacacttaaggtaaatattcataaaggtatcataatttgattgagtcttccgggatttttgcaggtgcttagcgactgccatagtgggtcggtgatgttgggaggaacagtagtgtctgcatggtgtacaattgtattaggtttgttgagtcagcagagtgaggaagccgaaagagcttgtactttggagtaagacatcttgatttgaaaattcaaatctgtatgttaaaaatgtccacgttttaaattatgtcaattgtttaaataattttaaaatattactaggccaacacgcacacacacaactacaaatttatacaatctaagataaacttcagtacccagaccatgagacctgaattctagtaacaacagccattaaaagcttaactgtgatgttaaccatttattctttgaacccattaggaaaaaattctgagaagcagctactcttttggtagtatatcccctgcttactttaatttccttatatggattcatacatcaggatttttaaaaattgaatgcctatattgtcccttggtaaaaagctgggtaaaaatctttgtaatatagttgatgaaaattgcgccagaagacttagattccaatacggtctaaacctttgctaccgatgaattccagggcactggataacaaagaactatttttctaatattaaaattaggacattagactaggctcaataattttgaaattctttactatgtctcagaatatatgatctgttggtgtcttgaaataaccaattttcatgtattttcttattattgcataataaaagagtatttttatctattatcatagaggtactttatttaggctccatatgttctcttttaatatgaataatattggattagctgaatattttcatgttcactcattcatatcttcatggttttctagactttaatgaagttctttgaaattgttatttttacacatgctataattcctttgttaagaaacgaggaataaaattgaaaataatatcccaatttgtgctatgccagattttataaacatctaagaacagctatatggtttgctttcaggttgaattttgtatatgtacattttctaatttttaaaatgggggaaataatagcttcccactttacctaccagaattgttaaaagtataaatgaaagagtatatttgagaatactaggcaaatatatttttattgtcatattttattttcataagacatgtgacttgaaagctccctgccaaaataatgagcttatatatttgaaagcatggaacaaaacacaaagcttacattgttttctctcagtcttcacatttgttttatacattctgctaaaattatttcatttattttggcggagagagagaaattatttatttgttcatgttactaatttacagagggtaatttattaatgataatatgtaaaccatatgtgtagattgccactcaaattgccaagttatctccatatagctagtagcattaacgaattaaatattccaagttcttacattttcagtatcatatcaatatgaatttaagttacatttcagagctaattgctggtatataaacacaacattactatgcttcttgatacaatatcttgttatatttcaaattagttaatctctcagtactgcatataattgttgcactggtaaccatgctataaagaagtagaggagaatttcaagcatttgctgatgcatcatgatattttcaataagcattcattgaacgcctccaatatctcaggcactgtttggttagacttgggctatacagtttaaagcaagagagaaccagtcctcattcccatggaacatacatgctcttggaaataaagaagacaagaaataaggaaacaaaagatgtggtaaagatatgtgctttgaagaaaataaaacgtattaaaaagtgacaaaagaaagatgaaagcaaagactaaaaagaaagtaattttttaaaagtaactggattggtggatagcaactagaattcttaggcaggaaagacatgtataagggaatgatatttgggtcatcctgaaattcaaaaagggtcagccatggaaaacacaagggaagaacattccaagaatttgcaaaagtactacaaagacacagaactggcttcttacattgaacaagtagaagagaagccatgtgactggaaaatagtgaacatgaagtttgagagggaggcaaggaccagattatctaaaactttaaacaccgtaaataaataggttttattctgagtgaccaaatgagaagccattggatagtttcgaagagttcagtgacataatcagatttatgtttatcaatcagtaaatctgtactgaagctcttaattccctttgaaacccttacataaaataactgctgttacagtcgtcccttctgatttgcagttttgtactttctctttgtggcttcagttacccttggtcaactgtggttcaaaaatattaaatgaaaatgtccagaaataaacaattcatcagatgtaaatggcacagcattctgagtaacatgatgaaagctttcactggccagcttcattccaccaagacacgaatcacacctttgtccagcatatccacgctatgcacactaccttccagtgagtcacttagtagaacttctcggttatcagattgactgtctcgtgtagtgtatttgtagttcagtgccatctgtggcttcaggcatctactaagagtcttggaacattttccctctgaataaaggggattattgtacagtatatggttgctgttattaggaatagttgacctgaagatgagataattcataagaaacccaaaattgaaaaagctgtcttgtaggagagagagtatacttttctgtttggcacaaggagtagtactatcagtagtaactttgggaagaaaagttatcatatgttatcatatatagaagatcttctaatagagatgttcaaagatagaatagaccccttgtcacaggagcaagtgggaggactgattggttgcatgctgcagacaggattcaagtgttgatggacagttgcagaaggtgaacttttaaagatttcatttagcctaacgagtcaatcactttatatatattcaaagtattctgatataaatacatcacataaactgctgataatacttgcagactttcctcaggcaaagattcagcgagaaatgagaatttaaaagattgtgagcatttcaataactaagtactcaaagtctgtttgtttttaaattacaacatcccaatgtgatgggacataacaagacatgtattgtagcatttacttctagttggagaaagacaaggcatggccctgggaaatgtgtgttagctggagagagccaaggaggtagctctgatctaccctaatgtggagacatcatttcactaggctctgaatcctatcaagttgtgtatccccaaattttggtgcaatgcgtagatatgtcatcagcatttcttgaataaaataatgaaatgtttattataatcttttccaacttcagtgatcctcaaggagaaattaaaagatgacaatgataatgagcatctactaattcctaggaactatgctgggcactgttataggctagaccgttaaaaattattacccaaaacttctttttactccaaagcatacctatctcattgggaatggatttagttactttccgtacttacatgttttctaacaaacctggcccatgtcaccagactattggccttggccatagttttacaatctgtatctgaaaacctgttctataggtagaaaaaaaatagatttgctgttttattttaatggcacagtctctttgaaaggtagtctcttttattaattgttaagattaattcattttattcttcccaagtaatatttaattttaacttttcacaaggaaggtaatatgcaatcatagaatgcacaattacttttatccctgatcaacgtaccattaattaaaaaacaaacaaacaaaatcttattcctattcttgtttccaccttcctttaaaatgataaaaaaatctcaggaagtcagatttcagacttagtttgggttcaaatattatgtatttagtaatttttaaataaaaacttttaattttttttaaatttcaacctttattttagatttggaggtacatgtaaaggtttgtgacatgggtatatagtgtgacagtgaggtttggggtacaaattgtgccatcacccagaaagtgagcatactacccaacagatagtttttcagcccttaaccccctccttctctctttcctctagtagtccacagtgtctattgtttccatctttacatccatgtgtacccaattttcaccttccacttataagtgagaacatgatttccttcttttttatggctgtgtagtattccatggtatatatgcatcacattttctttattcaatccactgttgatgggcacctaggttgattccatgtctttgctattatgaatagtgctgcaataaatatataaatgcttgtggggttttttggtaaaacgatttattttcttttgggtatatacacggtaattggattgctgggtcaaatggtagttctgttttaagttctttgagaaatctccaaactgctttccccaatgtctgaactaatttatgttctcaccagcagtgtgtaagcattctcttttttccacagcatcatcagcgtgtgttattttttgactttttaatagtaaccattctgactggtgtgagatggtatctcattgtggttttgatttgcagttctctgatgatttgaataaacaggtttttttcttttaactaaagcaggagatcacttttacattttatttagcttccgtgttgtcttctgtgtaatgaatgtctctaatgtgaagtaaaattttgtcatatgctataactaaatatttgctgaatatgaaattatttttgtccaaattatgtacttatgtgtcttactgttttaagttagcatttaaaaattaaactattttcttgcagagaagaagtacacatagaatgagaaaagtgacacattcagagtcagggttttaattctggtttttctatttattgataacatgactttgaacaggtcattttatttgcctaagtgtcagttttctcatctataaaataacaatttctaattccaaataaggttttgcagatactatgaacaatgtgtgcaataattttttttaactggaggtaacatacaatttttttctcaatgaccaatcgaaataatatacaatataggtatcttttattaacttggaatcatggcttcacatatatattgatccagaaaagactttttagaccattaactttatctcccctcttgtagctcttgaaaaaactcagctatagggcaatgtagagacttctgaaagtcagacaacaagaataaatagctaaacagtggtcaagaattcaatgtttttagatgaattggaaatggctgcaaaatacagtatttaaatgtttctatcttacagctaagcatgtcatgcagttcataggctaactgtagaaaagattatttttattagacatcaaatacatcaccagtaacttttctgaggccattatcaaaataattgtttttctcacatttttactggcaaagttaaacagaaagtgtttatctgcatgcattttagcctagtacttgctctaaactatactcaggtaaagtaatttgaaatattgaagccattcacagttggcctttatatcagtaggaaacaagatatgtatcatgtattcaccactagtgtttcttgagctcctagtagtggaataataatagctaacatgtatcgtgctttttgtgtgcctgttttaagtactttatatgtcatttaaagctcacactcactccacgaaatagatgttatctttagcacttattttgctaattaggagatagagacccagaaaatttaagtatattgccaactcttacaagcacattaagaggccaagtccatgaatacaactctggccattttgctcctgagcctgtgctcttaaccacttgattttgctactggatgttaaaaactctatgtttgggagtgtggatattgcagtgagtgaagcagacaagatgtctgccttcatcaaaatagataacaatacaaaatgtaactaagtgcagaattattgctgtagcaataagttttcaaaaaggcagtaattcgatttttatagtatggtaatggatggcttcacaatgaaagtagtggataaaaaagtagtggataagttttttccctaaccacttatgacatatttaataagcagaattttaaggcaaaacttgcagacagaaaagtaaccatgataattaaaggatggaagagtaagggtagttaagtttagttggcatgattggtaaatagacaatgctttttctcatgtcaaggtctataaattaggactgtattagttcatgccttagcctctaataaaattaagctgggttattcttctagctaaatctagaagtagaagacatctggttatggcagttttaaatgcaagcctaaaatgtttgtatttgtcctgaaaacaataggaagtcacagctagttttgagcagacacaaccaattaaaatgatatttggaaacatggatctaactgtggtatgtatgaggaagagaagcaaggtggccaatcagaaactattgcaaaatgtgtgtttgaaataaaaaccacaggtaaatatcaggaggaaagatcacatgtgaaaaaaatgatagctggattatttagtttgtgtaattataatttcttagaattaaataagaacatattctcatgcaagtactcccaaattttttggtgttataatgttttctgacccacttttttagtctgtttcattaatgaaatggaggtaaaaccataaatgcacgtgaacgagctgaggatgtgcatttccaaaaatcactccaaggcatgttgatgtttcaggagttaatattccttatttaaaaattgattacatacccttaattcttttaactaatgcccattttgtcaatttgccaacaaataagagaaaaattttgttctttaatatatttcggctctctaatagccaaggtgcctaaaaataaatcatagtattgaacacaatgtgactaacaaactaatgaaatataactcaccaagaaactgagatgtatactgttttctttagcagtcaagagctacaaaataaaggtcaaagtgctaattatgcctttgatagttgcgaagtggaaagaattctatacatatgtgaagtataggtaactgacaaacagctaaagatcagatatgaaattgaatttattagcaatatctttaatctaagtaattgcactttgtggctgatttgtgtgtgtgtgtatttgtgtttaggtaaaatacagtataaaaagaaaaatgaagatgaatacttaatgttattatccgtatagctactactatttaataaaaccagttcattttctacacaggtatgacatcaaagacgattacacactaagaattaaaaagaccatgagtacagatgaaggcacctatatgtgtattgctgagaatcgggttggaaaaatggaagcctctgctacactcaccgtccgaggtaagagatttaagatgtcaaagataattgaaccaggagactaatatttggttaaattggtaagtgaacttacgatcaaaataatgaattatgctgttttgttgtactaaaatgcctagattttgtgtcctctctatcattagttgaaataaaattactttcaatatttggttcccaatgatgataatttaaaaagattaattcttatttaataaattgcttatatggtttaacgttaatagtttatatggcttaaaagtaaatcttaaaaatagaaaagatctatactactctttcatttccattgctttcaactacttactgcttttaaatgtcatcagtttcaaaagtactctcatgctttctgtttactagtttgtcactttatactagtagcatactgttttgaagtcctttttaatgtcagcattcaaaacagcaatctgaaaaaactagcaatgcttccaaaggtgaaaatgaatacagaggagctctccagccttgagataatctgatttagagactgatttgtgaagttcattggccttaaataattgaaatagtcagtgctgctcttgtaataactttcactttctgggtgtcatgcacttcctcagtcatggaataatgttcatttatagactccctggaattgcttataagtgaaagaaagcattacttaacttcacagtgcactagaataaattaactgtcttttcagtgggacttgttgatcacgtgagggaaattacatagttcaaggtaccaagtagtaccaagtagacactcacactaattcttgaaacagacattagccatggcatcatctacactcctagaaaatcaaacaaagataggcaagcacatcctttctcccactgctaactgtgcctccttctctcatccttcgtgataaagagattggctgcatgttttcatccaagtctcagttacatcttaccccatttagtcatacctctgacccttgtgcagctttgctcccaaagagattcagaaggttaggaaaaaggttcggagaagtttgaagttgcaggaaaggtgtgagggattctcaggttagtccttcgcgtggtaagaaaaaggatttttaccaggtttatgatttgggcttcaaatcatacaaaactcaactacctccaggttattattaggagacaggcattttgggtacctggaaaaatattggtgcttttcatactactcaatatttcaccaaatccattttttcttctgtagatattctagtgtgaatttagatacaaaacatatttagacaaaattgacagctagttgcataaaaacattttcattcttcattagttaacaggtcataaaggactatgatcatatatgaattgaatatatatatatatatggattatgtaggatgaaaatctgataacctttgtaagccaatgaacacactttatttaacccacactctacatggataacttcatacatttgtcatatgtttgctaggcagctttttgcaaaaacaattcactagaccaaattatccccgaagttttctttttctttttttctaaagtaaatggaaaataataataaacaaccaaccaataaatgctccatccgaaaaatatttgctgactaaacaaatggtgagaaaacgtgaggagttgtttgtttgtagaagcagcagggtttcttttatacttgaatgcttggatgagtgagacttgaagtggtctgtttgctttaagacctttcccagctaattgttttcataatttgctgaaagtttcaggcttaacatttcatttaacaaagcatgctcctcatgcggggatgtttgaagctaacttacaaaactaatagagagcattgtttgttttcaatagttttttttttcttaaatcagcaaaccttaaatagcctctcccctaatctgtatactgtagatggattagagtgtttattctttgtggtatgaatttatcacctctctaagactgaaacctcaaaaactgggtttaaaaaaatctccttaatgcaatataatgtagagtaaaatactgtttaaaaacatttattttttaccattaggaaaagcatttgggttttctcatgctaagagattaacaggaaaaaaaagacaacactgttatctacgacttatttttttttctttgctaatttttctatgcacataaatgaaatgtgcagcctttctttggatcgttttattagaacagggtcaactgacccaagaggccatgcccattttcatccatttaatgcagagacacagttgtgtttaatttgctgattttgaaaacatccacctgctgtttttttttttttttttcaagatgaaatgttgctaatgtaacaaggacaaaaaaatgtattgtgatgtttctgctaaaattttatcataacattcacattagccaattggggaaaaggtaagagagtttattgtcaaaatttgaaacagatctactcagttatttcccatttcaaaaatatgctttaaaaaaaaaaactataaattgaggctgaacatcaagaagctccctttgctgacttggcaaatgtaaaattaggaagaaataaagccagtcaacaacaaacctcctagcattttcattctaatcaattaatttattattaataaaactttttaaatggcttaaaaatgacaacacaaactgcgtatttgtaagcacattttacccatttttaattttttaatttgctttgcataaagatctcattggaaaaatcatattgtttctagagcattaaagccttaattttttggaattattctataataaaataaaatagaaatacattttatttgtttaaaacatgatttctcaccacagtttcttttttttttttcttttgtcaatatcctacactcaaaacgcctttttgtttctgaaggaaacattatgttttaaattcacttgagatggcaagctgaaaagtagcaaattcaaagatgaaaaacaaagttctttttctactggacattttgcaaaattaagagaaactccatctgttagaataagccacaacttcacattattagtctgttatctctttttgatagtcaatcttgtattctgcccctcactcccctgcaaaaagaaagaaatcgtggtacattgggtaactcactcctcttttcctctggctatagcaaacacaccctatatgttaggccacattagggttccactaaaccaggcttttcgtaccactgctacaattgccttattgcctatggtctgaagcttccctgttttaattgtgaataatattataagaccatggctctcatagagatggattgcacaaagctagtattacgatgtatctgttaagtgaatatgtgtaaatatgttttcaatggctgttcctatcttgcccgaagagccatcatcaacacgaaactattggtatgttccagagtcacattacatatgcactagagctgtatctactaaggtatgggcgaaacactgttgaagaaattctatttttaatgtcagatttcatgaaatttcatatactactaagcatattgtttcttcatttggataatgggatcacatgtttcacaatatttgtctattgcttttgtataaaatggtttaccgtctaaattgatagcgtgttattcatttttaaaaaaggattatgaagcccatgtgtatctcttacaatttatttgcattaataacaggggcagcctattaccactgattttagtgattgaaagttatggtataataaaaaaatgataatttgttgaagcagcagtttgaaagccgttctcagtgtgaacaggaatcaacttgtcagtcattgtttcctgccctctgccagaagaagaaaaaagcttaacagtagttagggagctactgagttgaaatctctaaggatgttccaacctatctgttatattttcatccaccctgtccatggatgaaaagtgatgtaatctcaacttattactgactgaaaagcagcgtcaggggcttttctgcagtccttgtaatggttctgactaaccatgcttaaaatccaattgctatttaaatcagacagcgaggccttcttttattgacatgacatttgctagtctgtgacttgaatagttatattcatcaggtttttaactttggggtaacacaagactgtttaactcaagatctttgaaataataactgcagtaagtgatgatgataagactttacctaaaatatctctcaaattgcttacagtcagttctcaaagtaattattttcctagaattatatttataactctcaactttatcagactcagacatcttggtcatacttgaattgtgagactagaaatcactctattgtccatacttaaatgtaacattacacatcatgcattctgataatttttctttcttttttttaatttcttttttatgttctcaccacaccattgtaatgtctacagctcgccctgttggtaagtagccatccttctatccactaagcatggctttgcacagtgcttcataactcatgcatagtaagatttgacagaatgaaatatatttattttacccatgttaaaataatacttgagactgtatgctgtaaaagttgctcatgttttttttactcactttgataaacaattttgtagtgacttttgctacatagcaataagtaggtaacaatttttatgtaagagaataaatgaatgataaatgtttatgaactgctagcttttcttataggagaaaaatatattgtattaggatacaataagaaagcattgctctccttttttgtatgtataaaataatcaattattagttatgtttgatgttaagaaaaaagttatgaactaaattaaaaaattctacgactttccacacttcttttaagttactccgagtcccagtattttagggatatttttagctgctgcatatttattgcctgcatgcctatttaaacaaaattaagtaaaatgttttaagtagatgcttaccctaagtgggggagggatagtggagctgtgttctttggcatgaaatctgagtgtttgtggttttaatatatcttatttttcatttggctttgtgaaatctaagtaagttaacagcttgcttttgcagatatttaagtggtaattatttgtaaacatttggaagataaaatttttcaattcattgacttagtaagctttctgcatctcttttaagcttaagtttaattcaccaataactatgtttaaataaattttggtaattgtgttacatgtaaatgaatagatggatgcataaatggatggatgaaagagtgaccaaatttagtacactgcttctttaatataacaaaaaggtactttaataacaacttattcaattttgagggctttataaattgtccatctagcttcaaaagcttccttcatgtaccagcttgacatcattgacacctgatatatatgttggttcagactcacacatttttcccccttcggttgaaagagtcatggactttgttgctagacagtatgtttttacattgtcagcaaacacggtaaatatactttggtttcccaatctgactttctgatctggtgtttctgagcaatactcccttttgattagtaatttaatatcccttatcctcagtgacctcctctataaaatggagagaataatactgacttatcaaagctgttgcaggaggggactgagtttaagattgattttatatgtgaaaggcattctgtatgccaatgttggtagctatcgtatgcctagtttctgaggcatgacttcacatttcaatattttttaaataaagctatggttcacaattaattgaaacataaactgcagggtgttttttgaaactgatgaaatcaattgtggtttgtacaattgatgtttgaaaattgaagaatatattgtaataatttttaagccttattttcttgtatttgtagggattcctgttaatgataattttatgtatcttttgaatgacacacaaaattaagaaaagaatgagaaagaataagatgatgcagcaacagacaaagaaagagctgatggtagaatacatgaccactctcagatttctttttctcaacatctgtgagctagttttcaggttcagaaattcactcatttatgtgtcaaataagaaagcatgttattacatataataaaataaaataagtggaaagatttatatataaattatatacaacaatgatatagattatatataaaataaaatatatgaagtggaaagattgagaacgatctgacactttttcagatgactatggaatacaaaaactttgcaaccttatttagaagttttttaaagatattaagcattacagtatttataggagatatgaaaatagatgaatgattgaaaacatttctcaatagaaaggatgacagtaggtgttaaaaaatacaggttggttttgcatcggcagcagttgtacttataagctaatgacttttcaaatgaaaaggaaaaatcaccatttaaagtacagatctttgtacacagaaacctcatgccaatataccatgagcacttgatttatgttatagaatagtatgttaataatttccaatatatttaaaatctttaaatgtaggaaaaagtacattgatttgaaaatgtgatatacacagagtattgagatgtatctgtcatctgcaagatgtttccaaagttatttccattttttattcccgtttgaaatgatttcttaaattcccattggactggaactaaagaatagcttcttgacacattgtactttattctggggaagtctgtcatttcataaatctatctcaaatgacttatgacaatgttcagaaatataaagaactatactttaaacttgacaactactattaattttaaaaactgaatgttggatatgttttaattggatttccaaagaagacacataataaggcaattagcctcattttttttgtatctacttcttacatcaattttaattcaagaacatagatatctgaacatttattgtatggtcaaaaagtataagccaagtaaaataatgattacatattaaaatcatagaaaaactacattattatttatatttgttaatgcactaaaaagcacatttttcaactttgcagctcttagcaatagcataaagggcattctgcaaggtagaggccacagaaaggggagaaaaaaacagcttgtagttccaatataaattagatgaagaaatatgtaccaagcatataacgtttagagaaatttcagatcatagtttctgcctagagcttttgaatgaaaattagcaatcattgcagattctggaatacttagagattcagaaaccctcactacattactcactggatgaaacttcttgatggtctgtgtagaaagccccctttagaaatcattacaaacccccaaactgagaattttgtctaaatggatgactcttgtgcgatgcatttgtgttaaagaatttgcaactccttgcagtcacagttggaataaacacctctggcctgtattcagagttttcctctaggtgaacttagaggatgctctagtgtgggaggtattactgaaagcggacgttcatatacttgccaacagaggaaagtgttttacagatttcacttgctcatctgcagtgtcaccagtgggtcagaaagagctctttaatctaacgttcatatttgctggttgccacaaaatctaggcaactatcactttaataattaaaaatccacaagcccttcctgtggttttgacgttttactattccaaaggcattctttatatgaaaagaaaagtacatcgtaggatgtagttaactatgaatgctgaaatattcatttgtttatttggaaaactcttctgatgaggaaactgacagaagaaaatggtctaaattgggaaaaatatcttgcttcctatacccatctgtcttatttttctattggaagcctctcccaagcctaaaaataaaaaaagaacatctattttggagatgggcaccacattttttcccagcagcaactcaaaacatgatgagtaatttggaaaggaactgtggaatctaccagatgccttgcttacgaagccgtcctgttccgtttggtgacttgtataccatatgctagatgctgattgcctggagtataaaactgaaagctgagtacttcacgtgaaacttgtttaaaatatcaaaaaacaaactgacaattcacaacttgatggaaacttctaagtattttctaacttagtgacccaaaagtatgcttccttttgatggaagaatgtaattggccacacaagaatttagaagtaataagaagtacacatgctttttggcaaaattcaccatttaaaaattattttttaaaataagcagccactactctaaacagaaatctacagggacattttttttttaatgtttcaactgcttaaccacagtaattaaatatactattttagaaagttctgttttatgagtcgaagcaaagttttgttaaagcatgtttgaaagcagtctattctgaggccaccaagaagtccaaaaaaaaaaatggtttgtgattgaaaaattcattcagcatgaattataaatctgacattacttgaagaataatgtaacaaatattttgatacccccatctcccaccccaacttgaaatttggaaaatataatgtgctgtacataattggatattggaaaatcacagttttttaaaataagaaaacttaaaggtattatgtatgaaccttttcatgtttggatgcactttttgcaaaagatgttctaagtgtaccttgaaaggagacctagaattttgtttcttgcatcccttttctttggacaagctgttaccccatgacctgaggtaatcatctccctcctgagagctcttaatgtttcctgcacctggcactaattagctactttatgcagagtcccatttacttattattaagcatcaggttttccgttgctccatatgttttgattaaatggtaagtttaaaaaaggcattctgttttatcttctatattccaactgagtttccataatgtgaaacgtttaaaatatcttaagctaatgttcatttctaaagtgaaacacaagcgcgggttacttctcaggctgagctggttctagccttgtgtacttggcaatgtctgtccattgaacaggaggagaggctgggtcttaaattactctcacacttctttctttttttttcctctcagaacttggtaaaaatgtcctattgtcttggtattgaatggtattatagtgtagtctgaaacttaacaaaaaatatatttttttcttggctgggattttcttttaccatatgaatatgcatgtagtcctttctttcaagtaactttgctcagttatatcttggtaatgatcatcctgtaggtaatatttctaggacgcaacaagccacttgaatctgccagttctatgctttaacttgctttatttcaataaccttttcttctgttttatctttgaattttttttctgttttactttctcatttcttcaaattatatttcttcttagttatattggctttccttagtctcaatttcacatttatcaacttctctataataatttcaatcatttttatttcatattgtatgatttctcaatgacaatataccgcgtctctaacttttaaaattgcaatcattatatatttcttatttctaaaatatattctaatttttttgttttttgttattttcttgttaagctctaatataaaattctttatctttacttgtcttttagcctttgtaacccttttttcgtttttaaaagagagatttcattgtatataatttcatttagacgatgcctaagttatttgttttaaattgtttctgtgtttctttgagtaattcttggaagacacaggttctttatctctctttaattaattatgttcattttctgtcatgaattaaataagtaattggttaatatacaggtttttgttaaatttcgttttgcatagattttgttttggttcctatctgattattcattttctggttagctctgaagactagagtttgcatatttggagaagagaaaatgtgaagtagcagggtaattcaataacccttatttagaatgttgttttcaatatcttactaaaaacatactatgttcttctcagtattgtactaggcctggtgatacagaatcaccctttttaagttatgaggggtgtgcattttcctataagactctctcctcatcctcctttatactccctgcttcataataaggatggttttcaggtgtgtcagttttctattgttgcataaaaatgaccacacaatgagcaatttaaaacaatgtcattctataggtcccaaatgcaggcagtctcaacagtgttttctcctaagggtttcacagaccaaaatcaagatattggccaggttgcactctcctccggagactgtccagaggaatccacttcaaagttccttggggtgtttttcggaatctggttccttgtggttgtaggactgaagttcccatttccttggctgttggacagggtgactcactgtgttaagtggctgctcttcagccttcgcacattgctgccaccacaaccttcatagccagcgggggcaccctgaattcctcatgtgctttgctttgtagctctccgaggcctctttctgatttaaagatccagagtattaagtaaggcgcagctgatgaatcaacccattctgaggtcaactgattagtaaccttaagtatatctcaaaatattttttgtaacctaatataatcatgaaagtatttccaggaagggcaagcctgaggtcatggggcctcagaatgctgccaactacagtaggctttttttttttctttctgtcaatacttctttctccgccttctgaattttagcttattttctacagttatgtctcatatttcccatgtctcactcttgactttaagtatcatttttcccataaaaggatcatgggatgggctctcacaatgatgttagataatttttgtgcaactggtattgataaaggattaaggctagttatgttggtgtccagtgtgcatcctcagctttcttcaaactttgctgcatttggcaggggtacttcataatttgtggttttggggctatagtagttttttcttattattcatttcttttgttgtactcaatacaggaaagtgaagcctttactcaattatcttaacctaaacagcaaaaagtttgaataatcattatttttggagcctattcaaataagaataaaataaatattaagtatttctaattagtacttaaaattaaagtactataaatattaaatatcagaataatataaatacttaggcccaaaacggtatgaggagattagtattaagaagtttcactggctgtgtccagaaaaaaatcacattaactttgaattatgtattcgaagaaagtcagaattttcataagttgctgcactttgtagacagggatgtcatgatacatatactgtaaaatatatcttatgatgtgtgttacacctacatatgcatgatatttgaattgctacactatttgcttaaacatattaaatgtcactcaagggaatagtacataattagatttattaaaaatatataaactagcaaactatattacatttttatttcaaatatatctgaatgccttttaaaatctcacttatggcaagtattgctttccagatttactgaggttattattttcatctcccctacaaaactgttagctctttgtcagtaaatacattgttatatttatctttctgctgcctctaggtctagcataacacttacatgtggtgggggcacacaaatgttggtgcagttaattgatacacgcatatgcatacataggtagtacttgcctagaaaatgtttatgcaagcagctttaaatagtgctataaaaagattaagcaacattaatggtaacaggccaatcacatattccccattctgctggtagcagataaaatacaacaaaaagaaggcactaatgagctaggatggtgacttactaagcgtgtaattaatgttattaagaaacattgcagttgcatattaaaattccgttaactaagcaacccttcagcatcagtacatttgttccttggtttcaagtttttctttttctttttctttttttttttttctgattggcatcttcatgcaatctttctctaaaaaatgagataatgggatgtgatcagccctcgtggtttagctggagtgctgacatgacagttctggcaagttgacaggttaagtgagtgaaaatggatgtcttgtctcaccatttacttgaagagccattttaagctatagtttccctctctttactcccacacttacaactccttctatcccaggtatgagaagtcaagttttcccaatttaggaatttaggatcttgaaagaagtttttcaccactttaaactagtcttcttctgctggtcaaaaatgagatcatttctttacaaacaaagagttaatttctctaataatgaattcgtttttaagttaatagcactttttatttcatattaagagtcccttaaagaaaacaaaattttattgttttatttttagtattttaattataaaggcaggtagaaaagcaaagctacaaacgcactggtaaagtacagaataatatgggacaatggaatttaaaagttcagaacttgtttaatattttgacagattttcctagggatctctcaatttatacctatgtataatttaaaagttctgtgaaacttgcatggcgaatctcataatgatttccacagttacatgatttcctatagttacctataattaaggaaatctattttagtaatctgaaatataataaagtttaaaattacctgcaaatgtacccaccttatttacagtgtgagtaaactattactattgattgcaatgtagaaatatttaatatgattataggattagagtggacttgctaaacccagtaaagaccatttagatgaaaaaatacatggttccacccctacaatccctcagtttaatttctgcctggcaaactcgaactatgagcaagttcatagtcgaactatattacttgccggaggccttcaaatacctaaactgactcaaggagcacacccatctagactgccacaggccacaaagaagcaggtggggggaatgtgccttaaagcagtctgcaaaattcctgtctctaacatactgcctttgttttcccctctgggaggagcactctcccacccttccttcctttccaacttaatctaaaagaacaaatcaaatttgtttctctctctctttccctctctctcttcttttctctctccttcttttcttctccctctctccctccatctctttcctctttttcttcctctctctctttctctctctatggtttctccagctgtagaaggccaactgagtcaagttactcttttgcttagtatgtattgtattacaaccttcattgtattgtaacatgtcacaacacaattgtaaaatgtgttgtaacatgcttgattgtttccaggaatgtctcttgtggtaggaggtgacttccacaggacagagatcttagtaccctctgacagaaaagaaaaccactaatgttgtttaaaaaaataattggatagtattatgaattgaattgccatgcaacatctgaattcatttttgtagaaatttattactgtggtacgttccagtaatattttgccttcaaaaacaaaaatataagtgtgaaggcactggcccaagtataaaatggctatgtgcttatagctgttcattacaacactgtttttatgtgcctgcttatgagatctaaaaatgcaagacattttgaactgagttaactcttttcagaagcattctttccattctagattattgtagaattatttcattttgatatttacattgtggcatttcaggcaggagcacattatgtgtgactctaagtgaaagcaaatggtttgaaccactttcataaaacatatacatattttgtggggggggggtgtattacacttaccaaaataaatccaatgcctccttggaattgcctttacagttgcaacacatggcaattcagaagccacttctgttattttgtcgtcatactatgtaattattggctgacttcactgcctttttaagtaatcagattttgaataattgagagttttttttgtggggaggaggttctgatattatatgaaccctccaaaattaatctcaccatcaacaaattccaagactgtttctaaactgtaaagagtaatagctgcataatagtaacatgttttgctcatacaatgaatgaatgtaatttgtatgtatatgtgagacctctcatgggtgtagagtagaatatgaagtctaaatagatgaggaatctaaggattatgactcatggtagtcattctattctctttgattattttttcatatttatgagagcaatatatcatttagtgcttttccttttcattttgacattgaagaagcacatacatatatatgcttattgttgaaagaaaaggtattattgtattagtctgttctcatgatactaataaggacatacccaaggctgggtaatgtataaggaaaagaggtttaatcgactcatagctccacatggctggggaggcctcacaatcatggcagaagagcaaggaacatcttaaatggtggtggcaagagagccctttgtgggggaactctcctttataaaaccatcagatcttgtgagacttattcagtatcacaagaacagcagggtaaagaccctgccccgtgattcaattacctcccaccgggtccctcccaagacccgtgggaattgtgggaggtacagttcaagatgagatttgggtggggacacagccaaaccatatcaggtatagacattggtattttactatggaataaggatttttattattagctacaaggaagtagctggtggcaaagaaagtgtatcactcatctaaaggatttattgccatggactcaataaaaaacaaaaaaaatagttaattagaaaggtaggtaatttagcaatttgatcatttacttttttttttttttttttttttttttgagacggagtctctgtctgtcacccaggctggagtgcagtggtgcgatctcggctcactgcaagctccgcctcccgggttcacgccattctcctgcctcagcctcccgagtagctgggactacagtcgccgccacgacgcccagataattttttgtatttttagtagagacggggtttcactgtgttagccaggatggtctcgatctcctgacctcatgatctgcccgccttggtctcccaaagtgctgggattacaggcgtgagccaccacgcctggccaatcatttacatttcttggaaatagtgacaaatgagtaaaatgtgattaagtagtctctataaaagtgattattttaaatcctatatttctaatttatattttctattataaatacattgcttcctctgagatgaattatgtgttaataagcttcaaatccaacatttccatggcagtgtgtatgcatttccaatattattaacagaaaatcttttgaaatcaaatgaagcattacatagtaaaaattaaataaaattaaataagttgaagaaacaatcacgtatcaattagaacccaaactgagttgaatataaattgagtaaacatttatctcttactactggtctataattgcattgcaaagaaacgatttctcactctctgtttcttgttggtggaggcaagcctattaactaatttttgcagaaactttttaattttttttcttctttttagagacggaggcttgctctgtcgcccaggctggagagcagtggcacaacaatctcggctcactgcaagctccgcctcccgggttcaagcaattctcctgcctcagcctcctgaggagccgggattacaggcgcaccctgccacgcccagctaatttgttttgtattttagtggagacgaggtttcaccatgttgcccaggctgatctcaaactccagagctcagacaatccacccgcctcggcctcccaaagtggtagaattacaggagtgagccaccgccccccggccttttgcaggaacttttaaaacccattgttacacaatgtctttatttgtctgtagtgcttttgttactctggaatgttggctactcatttataggctttgggtcatacattttcaacgttgtgtagcagcactctctacaaaagggcgtatcagaatcggttagatttgtattcaggtaacatacttgaaacaacacatatcagaatcgattagttttttttcaaatcacatatatattgttttcaaacactatatttactactgcaatagtaagtcactgtcactggtgggtatgtgtataggtataatggaataggtataataatgcagatatattattccttaggtataatgagatggaaaaaatattgagtatttgctttagatcaagaattctgttctttttaaaatgtactattccgaggcattcatttagtgttcactgttttgggcttttctaggtgaaaaaaatataccatttatatgctaaattgtagacagcaccccataccagtaaaatcttcaaactgaactaaggaagtcagacatataggctggggaaaaatagagaaggcaatgcaagcaagagcaagtaccttaaattggaaagaacacaagacaagcacaaggtcagagattgttcaggttaatcattgttgacaaagaggaccaaaggataattgatatcggggtgggttaaccacaagaccaagcaaatactagtgattgaaagtagactgctctgctgaaatgctggagctagtttggggacaaatgagtgtcaggattggaaaatcttagatcagctgatggaagccagaatgctacacggagaagaataatttgcaagcattgctatggtaagtattgtaggtttcactgtgatgcgatgaaaagcactataggtttatgaataaagagtgacttgaaggaagtgtgcttaagaaaggttatacttacaggtagtatagaaagagaaaagtaatgggttttatgctaccctaataataaaaacaatcattcagaagaaacgtaatgttattattttgcaaatctttgtagcatattggaaataatagcgttaaagttctatcattcttcttcgtattagatatgacaaatttttagttaatcagatcttggttcgaacggaaccaaatgaatctggcatctcagtgtttaagagttcctactgtggcattcgaataagccagaagtcaaacctgtcctccaatctaatttaactaagaaagctgtatttcttgcatgttgtcacttataagtggaagctgaacaatgtgaacacataggcacagggaggggaacaatacacactggggccagtcgggggcagtgggggcgcgcagggggagggagagcatcaggaaaaagagctaacgcatgctgcggttaatacctaggtgaggggttggtaggtgcagcagttcatcatggcacacatttacctatgtaacaaacccgcacatcctgcacatgcacaggggaacttaataaaccaaaataaattaataaagctgtgttactcatgccctgagtaagattcagtttactggttttacatcattatgatagtagttgaaacataaggcttttcaaatattaattgagataatgcctgtggagggtttaacacaaaccctagcacataataagctctcaatgaatgttaattattgccattctactaaacagtttgtgactaagtgaaattttaactcaagcatatgaaggaagagaatgcttcttaaatatgcttatagaatatgttagtatttaacaagtaaatatatgaaatagcaaaaaaaattctacttgagtttgtcaaaaaattcgaaatggcaattatagaattaaaagtttattcattcaggcataaaattatatccaaagaaaaagagtggctgagcatgactgtattcaccctgtgccacatatgaatgtacgtagctgttgcatgactctctccatgctaatgcctgccataggaagtcatattttcctgttaaaacaactctgaacatgatgtgattaacctttagagtcccccatcccctcatctcaaagcccaactcatgcacggcctgtgcttcctactcatgttcagccatctgatttccatgtcacccactcactctcaccagcaggcattagcataacagagctgcagcgtgactttgattgaagccagcttgggctgaatgcagtatcaaagcatcatttagcagaaatcaaatctaatttactgtgcattgtatttaaattctcaaaacacagtttcaagtgaactgtcccagacctctaatcttaattgacctttttatatttgggtctacttctctggaaatcacacaacatactttccttatagagctattgtttttcagcttgtaagtgttgattaaacactaaattgtgtcattctgtttgcttcgtctcatttctagttatagctgaagcaataaggtataatcacgtgacagattaagcaagtaggatattacatcatagttaacaaaagatttttccaatgctttcaggttttagacagaatataagtatatattttatagtcttctgtctcagagacatataggagaattgccatttttataacaggcatattcttctggagtttataactcaatctctttaattcacattgggtttaagcatgtgtttggaattgtcgtcttgaggacctagtagttttttttttaatacttaatgggagtcattatagaaaatctattttatgtatagcacactttgtgctattgtgctgtgttgataaaatgccacatctgtctactccctctctttggtgccatcagccaaatactgtcttttcagaccattttcactgccacctggcagagacactgaaactgtggagggttattagaagaattattgatgcagtttttcatttaaaacctcaaaaataaattccttcagctgatatcccttcacagaagattgcaatatagatctagggcagacagagagtctacaaaagtaaaagtgattgatgcaatttgtttctttggtccaccttcaggtgataataggaaaggatgtgtattttcacagacttgaatactcttcaaattttttgctttgataaatgtttccattttttcattttttaaaattaaaatatgattagatgattttagttccagcaagatcaatgtggcataagttctggtgacaatagtctattgaatgcatttgaaatacaacacatttccgacttggagtaaatgtacaatatacataaacatcacgtgataatatattttataggataaataacagatgctgacagttttttgttagtggtctttaaaataatccagtattgggtaaaagttccagaaattataatttcctgtcctttttagattataccatcagtggtaaatattatgttttgattttgcagaatttctttgtcctttaaaagccctgatgaaatggtatctttaggtgctactaaaaataaaaattctcaactggattctctgccccaacttgtgaagatttgccagctctttgtctttgctctttctctaatcctcatctacattgcttctaaagcaccctttccaaaatataaatctgattatatctttcttacaaaaatgtctttgaacagatctttagagttttcagaatgaaatgttacacttgtttagcagaaatcatctgtccctatctatatgaccactgtgacctagatttcttttattctcagaatcttttacatgcccctaaaaatccagttcagtgggtctctgccttatgtgctgcttctctttgtcccaagtcaccttaccactcttcgcctagtcagctcttagttgtcctccaaagtacagctctaatgtagccatgccctagcagcttttctctttttttttctcacaacatggcctgattggttctgttccactctttctcccccagtgccatctgcattttttctgttttcattgaaaaaaatcacattttgctgtttttgtgtatttatttatatatttacttgtaagcctctgccacagggcaagaacaattttatttggcttcccatctcctgtaccaaccagaatgtatcatcatttttcgtcaatcagtacattttgtgtgaataaatggatgaattatgtcttttcagaaaagtggatgcatagatgcggtcatttgccagtccttattttgaggactatattttagcagtggtgttaaaatcgtattatctggatgccaaaagcattttgcaaaatcactcatctacaaaaaaaatgtttcaaaagtttgaaaattaaattcttggaagtctgtacttctaaagtacacatggtaattttagtgatagagatttgtaattttactggatagatgaagaataatatgcttaaaactatgaaatacataaatatatgttgatatttcattgatttcatttgatgatttcaatcacgtttattctcagttaatatattttaaaagtttgtaaagaaggactgtatagagtatccaggactctaaggttttactaactacttttgtgaggtaatttaaattctttctggcccaaagcagtacaaattaactaatcagctaaataggtgatttttattcaaatcttttaagtgactgattttgaccaaactgagttttgagtttttaataattttcgatacatgctaaattattcaacactcctcacttggcaagtgtccatgttggcattattatttttctttataggatcacaaagagataactatatactcattcttaactttttcataacaaatataatttttctacaagattgcagatgacggaaacaaaccttaagtgtttttttttttttttggcacaaatacctggtggtttcacatttctattgaaaaaatggtcactgcagtgttttaagagttttctctaaaataattttttaacattgatttacaccatcatttctatgagaaaacatggaacaaaaatcaatgtatctgctgattcgggagaactgtgtggaaataacaagaagattgtaagaagcaactaatctcctgaaaatacaaggcaacctataccacgctctgttcaaacagattcataaatctgggttttccatactgctagaatgagtcttctgttaatctatagttatagaagaaaatgtcatttagtagatttatcccatctgtccctgggttatgcgttagatgcgttgaactaggaggcggtataatagaacaccaaaaaataagtcaatacaaatcccagggaattgtctggaaaaatgctgctgctttttctacgctaggattcttgtaaggatgaagaattggttgcgtgtttggggctgatctacgtttaccccattcttggacctgcacttcttttctcctgaaggactgaaatgatttccagtgacagtttttaccagacatcactcatggttagagggcattaaagtgccactaggttctaaaaattagagttgattttaaagtgttttcttggtctcagttttctagcctaagaagcgagttaaagtggatatagattattagaaaagtcatggaataaacactgtgttttctgctcaacaaaaatggattttggtagggagacgcccttgtgaaaacttccaatgatactgcctactgtctttcactttattctctctcaagatcattagaccaccatttaaatctgaactttcttaggatttttacccccatccctttcttttattttctgtcggagttacttatgtcttggtctcattagcttcacctgtaccattttactagcctcccagccagacttcttgttttatagactaagtggcttcctctccaatccatgctacattcatcagagggttaaagctgccaaaaattacttttgcatctgtcacttttcagcttagaaaaaaatcagaataaaatcctcagtttgacttctgaaaccctcctttgtagccaaaagtgtttacataacttggaccctccatcctgccaaattacacactgtatcctaagcttgttcttgcttcttatactttgctccataatctccttgtttggaatgtgttcatttttccatttacctcaaagctcccataatgcccattttctacacagagccttctgtaggttttacaacaccaagggatttctttctcctgagtcttattgtgtttcgtatatatacaataacttaaattctcttccactgtggtctgagattacctctaccattgcacttaccacagtcttagataagtgttgatttaatttcgtttttgtttttgtcattgtcattgtgtttttcatttcccttagactctaagctctttgatggcttcaggataaaagcttcccatctctgtatctttagtgcccagtaggggaacatagtaattacctgactaacctttatctatctaaatgaaataaattagattgagtcaaccatttcaatacatttatttatattgcttattacccttgtatataattcccatctcttcaattcttcaatgtctttaatctttcaactcttgaattctagatataagcacttttaagaataggggtcatattttataccctttggtatccctgtgccttatataattcttgcagtaactacaaaaactgccaatgcttataaataaattgactttagaggaaggagatggttgagtaagagagtgattcttttcttatctttatttatttaaaaagcagaaccaacttgaaaatccatgtttttccttaaaaatgttaaaatcatttaaaaatctaattttctatgcaagtatatgtaggccaaaggattacaatgtacaacatataaaatacgtctgctaaaaagtttgcttctttcctcacattggattgaatataatgtctttctttttgtgttttgagaaatgtgtaaaagtaaataaaaaactgtagtctctctctggcactgaacagtcaacatagtaccatattttctccttgacatatttttatttgtctatggttgatatttacacgctttcttttcttttaaattatagctcccccacagtttgtggttcggccaagagatcagattgttgctcaaggtcgaacagtgacatttccctgtgaaactaaaggaaacccacagccagctgttttttggcagaaagaaggcagccaggtgagtgtgaggcttcactgcttttctgaaatctctgaacttctactgtctctgctgctcctgaaagcttgccttgcttctcttgttctcaatgtttgaatttattttatttctgaaaaagagactggtgaatgtaaaaataagtaggagtcagatgttctagcaatagcattctttatttgctagtattaatcttttcaaaattctgtctcttacatagaacagcaataaagcagtgtaacaaaattatcgttaaaagtccaaccaaaacctctgtagctatttaaaatctgtgaaggtaaagctaattttgttttcttgtattgagatacgtggtgtgatagagtcaggacatatgcagtacttagaacaatctctgtgacatggaaaacagtcaaatatttgtttaattggcccagaatttcaatcctctctcttatatacacagcataaatgacttttcttacccttaattaaagcatgcttccatttaagagtaggataaatcttttccttctccattcctcctggattcatccatagtggggttagacaggaaataatacatagtacactagaaggaacccatacctgtcttgtctttgttctgccctggtttgtcctctccagggccctctctgggcaacatggcctctcagagtctctatggaaagtcaactggatacactagttttctcatttagaactctgtctaaagttggacaactgcttagcctctaggttcgtagtcaatgagtgaaatttccaggtaaaactagattaaaaattgtgttgtttgcaaaataatttatctgtgcattcccatgggacctggagatattttccttctaaactttctagaaacatgcactactaggcatattctgaggaagagacctactggtggtcttcctcatcacattctgttattactacatgttccagaagaatttccttgggaataatggaaatcattattaaacatctctggaaatctaaaaccttggccagagatgggaaatgtaagttgcattagaagactctgttgattaaagcttacatgtgtttatctgcaacatacatgtgtgcaaggaagcctgtagaagttctgtgcagccattatgtctaattgttgtgggtttctataaattcctgtaccagctcatagtgagcagttctaacagctcagtctggatggacaaatggccttttattcctcactcagctctccttggtggagtcattcctcttgtgatttgtggaatgtaaacgtagtgacgggaatgtaaggaaaggtgatggccactgccttatcccacatcagaactgttccaggccttaactctcaaatcttctttctaatttagtaattacaaaacaggtttctacacatagagttctttaactgtttgctttaaaattcttttcagatgttagcgtctcagactctaaagtaagtgtaaggcagcatgacaattaaacacatacacacacacttagacacacacacatatacacacacatgcagagacagacacacatatacacacacataccacacacatacacatacgccacacacagagacatgcacacatatacacacataacgcacatacacatagacatacatgcacacacatagacacacataaacacacaccactcacatacacatacacatacatacacatacacacacacacacacacaaaaaggagagaattcaaaatccagtttcctccttataaattgtacaacttttgtagtgctatttaaatgtactggaactcattttcttaatctaaaatacagagctaacacattttacttcacacaaacaaagtttaaatgaataagttgctttacacattatgaaggttaagcaaaatgttatgtcactggtagtaaatataatgatgtaaagcaatttgatcattgcatactcacactttaaatccatgtattgagtgaaatctcattataatgtgacttgttattatatagctaagaccatatcaggtgtaaatcacattccctaaagtagctccaagttgaattacaaggtagtgcataaaatgtgtattggccttgtagcttaataaacataggatatttaaatatgctacatctttgttaatggtttcaaaataaataacaattaaatagcatttcagtattcctttttctgtatttgacgaagtggcatataattccagagatattaatgttaaagattacataaaatcttaagtctagttttcttttcctcacctatctctctcccatcagagagatagaggtagagatagagagggatgtggtgggagagaaagagagagagagagagaaagagaaagagatacacagagagaaaatactgtgaatgagaacaagagagaagtgcttgagcaaattataaattctcaaatcatgaattgggatattgggaaaaaataagtcggtcttactatttccagtatccagtttttacagttatctatgaccatccatcagtagaaacagttaaaagcctgaacttaatggtccatatttctcaatatatgctgataatgccaattagctctaataggatacccaggcactctccaaggcgggaagagctgtgaagttcccggtttttgcttgtaatccattttcttttgcctatgtcatgcaagcagagaagaaaaatgatgggttaaccttcatataatgccattttccatgtcaacgaatcatttagaaggtggactgatggtacattgtagaggaagccatcccgtagagaataaagcccatctgatatattagtgctatgtaaattagtattctaatggctaattgtgggaaagtgtgcactttgagttattgtatcattttcaagtgacttcaaaatttagactctctcttttagctcgtttattttgataatacatttggaatctacagtagaatcagctgattctcaaattgtgtttctatgcatgaaaatgtctagccttatataatagtacacattttataagaggtcaatagcatattgaaattacattcctgacatgctagcaaacatcactcgttttagacggagtttaataacatggtaatgtttatgtaaagtgggcttatagtgtcacacttgaatctaataaagtggacatccatcatgttgcaataaagagaagagcttctaattaaaacaggacatcatttgcaggattaaagtcattgagcataattgaaaagtgttaataccctattttatcctcttccattggtattacttcaagggtaaaaacattttaaggtgaaaatgtgtcctgggcctttaattgaatgttattgcctcctgattgcaacgtattgaaactgtttaattacaaacctggaaaattaattactatatggagaaacagatcccagagggttaaaatgtccttttttgtaagtaaatacaacataaaaattgatatctccttatttataatccaacttggaaacatgccccaatataatttattatactcaaatgtttttcttaattgaacaacagtaaagcaacacagttcatccaaattaatgttactcctctcatagatgaactttcacaatttgtaattaggctatatgtatatatgagatatagagtaaactaaagtaattttgttttaaaaagaaagtaatattatgaaattgtttaaggtaacacacttttagaaacattctacattttctttttatcttcagtaatttgcttactcttgcttaaattgtagcatttgtttataaccccattcaaagctgcaaaaactttacagcagaagtacagtcagctctctgtcacacacttttgaacaactttgggagaaattcagttgagtccatcaagtattcaaaatgatcaacagcaatcatattttgcattcttcagagctgtgcggtttatacaacccatacacagtcaatgttatggccagatcttcatgaggccttagtagttgagtcagataagaattgttttgcccattttccagatgaagaaaaaagcttcaaagatattaagtaactagcagaaaatcaggatgagataaagatccccattctttaaaaacacagatgattattctttcaactagaaaatattgacttcttagaggatattattccaccatgatttggaaaacctttatcagtgaaacccactgtgtggcatttaaacatttctgaaccatatatattttaatctgtgtattttctttttcccactgtattccttaattgtagtagcttttattcacataatttttttaagtggaaaatgaatattgatgagattgtgcttgcttccacagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatggtgcgatatctttactagatttgtcttatgaaaacattgatttttatttctagatacacgttaaccatgtggagtttgctgatttgttaaatcatttctatgtatgcttatcttttaagtttgaatccaggtcacattcttttggtagtttctaattctccctgattgaataccacttattttccccaaagaagaacttcagagataatttacttaattcttaaaaatagaatagtgcatttttttaaataaatgtcatcacactcactgcatactgaaatgtaatctgtatatttttatttagtcttaggctgacatgattggctctactagacattaataattttatttcactctaggaggaggtcataccacctttaatattatcagagatgagattttagttagctaatcacattaggacattcctatgattttaattatgcattcactaagttaaattaactacctttcaaagtgctgaacaatgctaaaattattatttttattggcacatatgcactttgaatcttaactgaggcacctacattcatagtgaaagttgaaaaggatgaagggctctgcgtaatctggttttttcccagcagtttatttgtcacaattgacagctagcaaatttgagatatttcatgaacctctgagcgtgaatttaatccctattctttgatgtcttaaactgaaaattatttcttactctcctttatttgtgaggatttttacttttgttttctcccctaatgctggcttctgagatacaagtgctttggtctgtggtgtcttcttgatccccttctttctctgatggtgaaatttgatgtgcttttatacaatttaaatttacatgtagattaaaaggtcatttaaaattaatagaaaggcagtattttttaatatctgttcatggtatggcctgattcagtgacatgtcaggaatgggaataaatagaacagacaaacattggctgcagggacattgagtcgttaatggctgcacctgctgatgctgcagagatttactgctatggaactgaaaggagaagtcaggttcaaggatagcagtgatgagaaattcttccttagatgggcaaggtctttgattctttgtacctccatatttctttaaaagaataaaagataattattaatcattaaaaagatcttatgttttcacctgtcaacaaaaatgtccagatacatacacttgaaaaataagatattctgtccaaagcctatgttttattctatattcctaagaacacaccaaatgtaatgcttaagataccggctatcatttaactacttataatattttatagaagattgactctcaaatgtttctaaatgaagaaattgttatggaaaaggcaaaccatatttgtgggaagcaaagttgatgaactagaagagccagttaatgtgactgttatcgttcataaaacaggtggatattcagaattacgtctgatacaattaatggaaaacctttgaggccttacactagctcatgctatattacaaaacagtagttagtctagctttctttctgtggtcaaaaataagtgatgaccaatgttaaatcttctgccaactgagattgctctaaacattttgttacaactggcttgagtattaattcctatattgatttttacttgagtaagcaattacaaagtcaagatccttttgcagagacattgattagaagttacagtgttgttgattttgacagtaaagaaatgaaactataagaactaaatatgtacacacatgttatcaattaatctgtctctaaatatgaagttgccacattggctgatgccttaagcttctacccatagttttgatttttcatacaggttaatgatttaatactatctgagccattatttcattttgaacacatttattttgatataattcagggaattgtagagccatttgaaattccatggtagaatgaaaacgtatgtcatgttcagagaaagaagtgattacaggcataccttcctttgttgtactttgcagataccatggtttttacaaattgaaggtttatggcaaccctgggtcaaacaagtctgttggtgccattttactaacatcatgtgctcacattgtgcctctgtgtcacattttggtaattctcacagtatttcaaacaatgccattattattccatctgttatggtggtggtctgtgatcagtgatctttgatactactataatttttggggggtatcacaaactgcacccatataagatggtaaacttaactggtaaatgtgtgtgctctggtttctttacccactggtttctttacccctgttgttctgtctttccctgagcctccctattcctcgagacacaacagtattggaattaggccagtcagtatctctacagtggcctccatgtgttcaagtgaaaagtcacatgtctctgactttaagttaaaagctacaaaggcttaagtttagtgaggaaggcatgtcaaaaactgagataggccaaaagctgggcctcttgttctaaacagttagcaaagttatgcatgcaaaggaaaagtttttgaaggaaagtaaaagtgctactccagtgaacacaaaaaatgataagaaagtcaaacagcctattgctgatatgaagaaagttttagagtctggatagatcagtgagtcacaacattcccttaagccaaagcctaatccagagcaaggccctaactgtcttcaattccttgaaggctgagagaggtgaggaagctgtagaagaaaaatttgaagctaccaggggttggttgatgagatttgaggaaaaaagccatcttcataactaaaagtacaaggtaaagcatcaagggctaatatggaagctttatcaagttattcaagttatccagaagttcattcatgaaagtggctatactaaacagattttcaatgtagacaaagcatgcatatattgaaagaagatgttacctaggactttgatggctgaagaaaagaagtcaatgcctggctttaaatgacagactaactctcttgtaagtaactaatgcagttggtgactttaggttgaaactgatgctcatttactatttcaaaaattctatgacccttagaattattccaaatctactctgcctgtgctctgtaaatggaaaaacaaagcctgaatgacagcatatctctttacagcatggtttacctaccgaaatattttaagtacagtgttgagatctactctgcagaaaaaaaaattcctttcaaaatatgacttctcatctacgtgtaccttgtcacccaagctctgatagagatgtacaaagagattaatgtttttatacctgttaacacaacatctgttcagcagcccatggatcaaggaataatttcaactttcaagtcttatttaagaaatatattttccaaggctatagctgctgtagacagtaattcaactgaaggatctgggcagggttaattaaaaaccttctggaaaggatataccattatagatgccattaagaacatttatgatttatgggaggagggcaaaacatcaacattaccaggagtttggaaagttggatgactttgagggggttccagacttcagtagaggaagtaactgcacatgtggtacaaatagcaaaagaactagaattagaagtggatcccgaagatgtgactaaatggctacagtcacatgatacaaattgaacaaatgaagaattgcttcttagggatgaccaaagaaagtgatgacttgagatggaatctacttctattcaagattgttgaagtgataacaaatgattcaaaatatcacataaacttaattgataaagcaacatcagagtttgagaggattgtctccaaatttgaaagacattttactgtggataaaatgctataacacagcattgcatgctactgaaaaatctttcctgaaaggaatagtgaatcaatatggtaagctttattgtcttattttaagaaattggcacagctaccccaatcttcagcaaccaccaccctggtcagttagcaaccatcagcactgaggcaagatcctccatcaccaaaaagattaccactctaggctcaaatgatcattagcattttttagcaataaagtatttttaaggtatgaacttttttttagacatagtattattctacacttaatagactccagaatagtgtaaacatagcttttatacgcactgggaaaaaaaatttgtgtggccttccttattgcaatatttgctttattgttgtggtctagaaccaaacctacaatacccctgagatatgcctgtattccgtttagagcagtgtatctgttgtcacatttttgcgcttagactcattttctggaaatatttataattcaaacattcataaaagatgaaattgctaatgatgctgaatagtgctatgttgagcaacaattttactgatcatagattaagctaatatgtttcaatatacttgagtttcaatatatttctctaaaagacttccgcattagttcactggcattgttctgtatttcttctttccttttgctctatctttttctctcagagaattaggaaattgtaatcagcattctgtgaatagagccaatagaagttaaaaagactggggagataagatgtatttatatcttgtactgacaataaatgtcacatcatgatcttatatgaatggtttattgagtatttataatgcatagtgagagaaaaccgtggagttgttcacagatcactggaatccctaaatgttcatttaacctttgacttaagtgtcatggaaacctgtggtcatctttcacccataacatccttggaactgaaaattatgtctggccaggagattttcaattactttattgatcaattcattcaaaaggtgatgagctactcattagggcagtaaaaaaacagaaagaaaaaaactaattagatgacctttggctgcatctaatgatttcagggatatgacaataaaagcaggttataagaagttacctgaattctgcataggtatttaatttggaaaaaaaatcgtttaaaatttaattagtatgctttactctggtaacacagactcactttctcactgcattaaaaaattactcatagtgttttgttcattggccttctctttttgacccataaaaataagtcccatgaaacttttagtttgaatttctatttgcctaattactgacagatgtgccagaattattacaatattctacttcaatattttcttaaaatgttttatttagtattaaaagtaagaatttgatgaaaaaagcagtgaaataaatgattctaatttttgtttgtgaatgataaacagtttttattgtttttcttaggttttatcactgataaaataggtttaggttgactagaatctgcaatgtcttgatatgaaggtaacctgtatcataaattctagcttcaattaaatttggttggctttctcatgataggttctgaaaaggctgcttaactttaatcttttgttccctaaaactatgaactctagtaaatatgatgcaagtaaattggaaagatagtaattttaagctgccatttataaaagctggtgggcaaaggaaatttgaacgttaagcaaactgttttcaattgtatacattgcaatacaaggtgagttttttgagaaacaacagtttatcttcacagttgcttagaaattattagaatccatcattcattttttcttttttgtggaagtctttttcatatatattcttttatatactacatgtattttatatgttacatataaccatacacaataaaaagcatattttggataattaaccaaagtctatgctgtctatgccgaagtttatagaactttctctttagaaagacttccctggacctggacatgtccttttgattatatggtgatcttctaatgaattctaaatgaaatcttacctccggtcaactctatatttttcttaaccatgtaaataatactgtacattttgatgtccttcttaaataatcattaaatacttctaaaagcactgaaatgctactacgatacagttgtattgtactaccgaaatgctactacaaatacagtatttcataaataaaaagcaatactaagctaaacatttagaaattatggaaaatttatccaaatgaacacaacaattgatatacatgtaaacactgattttgcacaagcactgtttttgtcatatgataaatataatctagatgactttcctttgatcaattataagcactaattaaatcaaatcatccaaatgatatgactgtaatttgatgagctcatgtcacaattttggaaggaaattatttataatctaatattttaacatcagcagaaatattttagcctgtataaatacagcacataactggtgccataagggggaaattatgtactatatttatgataaatgcaaaagtgaaaattggctgtactcatatgatacttcacacactttcttaaatatgcatatgagataaaatgaacatttcataggtgactgactgccataagctattcaaattttaattttaatacgactaagcctttttatacaattaagtctttataaaatgtcagaatttatctcaatgccattttaattataggtaatgcagaggaagttattgacaataaatagtatggccttagtatagtatatatgtatgtacatatatagatgatagatatatgatagatttagaatatacatgaccaagaatatacatattgcttagaataagttataagtaatatatattgtgttggggctttaaccttactttcagtgtcaatatatcaagcctactgaactacattgatgttaaaatacctgaaaagagctttattcttcagttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacgggtaagtaatattggacttgtacatgaattatcatctacacataagtactgctctatggaaaaattgcatagtgaacttaaaatcttacatcctagtataattgctgcacgtttaaaaacagttaatgttattacttattttaaaaatgatgaaatgaaattagaggaaaggtcacagtttttacgttactcacacattcataacagaatctcgaaacttttattcctgtatcccattccatatgtatacagtcaacaaatctagaaatcttaaacacatagcattaatatgagtagtagggtattggaaatgacaaaaacaacaaatgcttctgatttactttcattcgcaaaagaaattgtaaggaaatgtagataaagtggcttggccaaagagttgagtagaagaaaaataaagagatgagactgagtacataaacggcgagtttgcctggttagtgggaaaccttaggttgtaggttaagttgttgtgtagtttagatttaaacccatggaaagaacaaggcattggtggttttttactgacgtttacatgataaaaaatgagcattcctggcaacttaacaagtcagtcctgcttcaggagcaactcaaaataaaatgtctacttctgaatattgtatcagttatctattattatggaacaatatgaacaaaaatacagtggctaaaagcaacacacatttattacatcacagtttctgtgagttaggagcctaggcatgactgagctgtgtcttttgcttctgggtcttacaaggctccagttaggtgtcatttagagttgccgtctcatctgaagattgacacaggatggatttgcttccaatcaacattattcttggtagcactcagttccttgtggctactggactaacaacctcaccttatcaatggctgttggcaggaggttgcctttggttccttgccatctggatcttccccatatgactacttgcttcctccaagtcagcaaggaagagagtctcctagtaagatgggcactacagtcctgtggaacaaatcacaaacatgacatactgacacttttgcaatattatattggccagaagggaaccaacaggtcccacttacactccaggtgagggattacacaagatacaaataccagaaggatgttatcatggagggcacctgtcctctatcagtacattcaactcattcaactaggtatggtaagtcccttcctcctacctgccatgtagcaagtgctatgtgaaagctggagagtatattttagtaatcacaagattggggatgagacccagaactaaggtagatgatgtaatagtgcatgaagaaaatttcagtggaggagaaatctgtagaatcttgggtccaggttgaaattcagagccaagatgaagaaaaacaaagcaaaacagcatttagaatcttcccattctggagctaaaaagaaaggcaaaaatttttaactacacatatttccaaatgatcacaatttggcatattgttcttttataatgggaatatgtttacaattatatgtttatctgattatcgctatatcatacagacgtatatcagaaaacaaagtgactatttttgctacatgcacacacatgcacacataagtttttactttatatatataatatttatctttaatttttgagatacaggcattaattattgctttaaatagaaaaaatgctgccaagttgagtttaaaaaagtaaattaatacagatattttgagcctgtctttttattgattgtaaattaattgttaaccttctttgaacaaaatggaagttattaaaaaattaatgccaactctctttgtgtaaacactttaacctctatttctgggctaaaggcagacttgggccatagaggttaatgcattttcactgtatcactgaattaaagggtatgcttgagtagtcaagatttctagtagtgtttgaaagaagcaattaaaggtgggtgcttgatgatgtcaaacaaactttgagccctctgacaggcttctgagtagtctctctgagatgccagctccttggggcttgtctgcagccaagtgcacaaggagaaaagtagatgatggaatttgcctgcacattaatctcattttaaagcaatttattaagggtaaaaggacaagcatggaaaagatgagaagcactcctcaccagaaaaagacattatttaaaattaaaggaataaaattaaaggaataaaatgtggtgatgatggtaataccaagagtgagttttagcaacgatatttaggtttatgaggaccccaaaatgaaaacgttgttcttttcctgtaacatgactgtccttacagggagacagaagtgggctttccaatagttcactcatacagtcaagagagtttctgtaggctgtattcctttgtgtctcactatttttttttcagtacttaatgcaagggaaaaaaataatgtgatgaatactgtgttcttctaggccagctaattggtaactgaatctttatcttttgagaagtagaatattccagcactcattaaaatatacctaccgcagctaatgtcatacttgtatctccacacaatgacaaggagatgcagttaagaagcattacctacatacttttcttttagcatttgcaagtaataacaagtgctacattttagttcaacagctataataaaatgcaaattcttttactctttcacagaccatattcaaatgaacatcccattaaaatccaacctcggctcattatatttagtttgtgagtgatgcttcttaaatgcaaagatttctaatgactataatgtgtgcacagccacatttgaaagaatggctctttctacaatggctatccccatcttccctctgtgtaatagaagacaattgtacagagataatatggcaaagaatgtcatgccagagcaatttggaacttaagttaaaatacataatggcatttaaaatcaattaagatagtgaaatggcagtaacatccaggcactaatgatttacctgagaatcaatcgagaaagcttgagtcatcaacacacttatagtttgaacccagcagatataatattccatgagcgactatatttcatcaacaattagactgatgttcatcacagaatattaattctacatcttctgccttgtctgactttgtttggtcatcagtttctcttcccagtgtgacttttcctttactcctaaattgatgagaatgaatgttgtttgcagtgtaagccacaaggcttgatcacacagaattttggagttgcctcttttattgatcttggggctttattcaaaatataatcacagaatcttctgcttcttgcatttgtaaaagaggactcttgattatattatcaactttttctgaaagtcctttgccactcttctgagaataataaaaccattttaagtgatcgatgaaatggcaagtttttattgtgatcaaaaaagagttatgaattatgatatatttatgttccctttcagcttgaaattgcagtcactccatagccacatttttttaatgatactttattctattcatttttccactactgcaatttacatataagtgaatattgaagtttttaaatgaagaagtttaccttaaaaatatttctttttctggctgggcacggtggctcacacttgtaatcccagcactttgggaggctgaggcaggcgggtcacctgaggtcaagagttcgagaccagcctgaccaacatggagaaaccctgtctctactaaaaatacaatgttagtcaggcatggtggcacatgcctgtaatcccagctactcgggagtctgaggcaggagaattgcttgaacctaggaggcagaggttgcagtgagctgagatcgagccattgcactccagcctaggcaacaagagcaaaactctgtctcggggtaaaaaaaaagttctttttcttcttcacttttttccatgtctttcaaaagaaagaaagtgtgatcccttattgtcttattgcttatttactcgggtatgttttattcattgaaacatagtttatttgagacagaacagttttgcattactgcttctctggaattttgtgagattctgaaagagttctgttctgagtcattcataaacaacttagatatagtagagccctgccataaaatggagttaagaggtaagagtattatcacagaggaagaaaaagagaggggcaaattgtttatcagacaaattaacattgaggtgcataaatattattttaaaagccctttggaccaatgttatgaataatattatatgagtttatttcattattttatgtatacatatgattgactctaatgcataatttagacaacaaaatgatacatctaattttaagaaattaaatattgcctggctgtcattgagtaattattctgcaaattgactgaaacaatttaattctctcccttctgtgcacactagatttctgatactggcacttatacttgtgtggctacaagttcaagtggagagacttcctggagtgcagtgctggatgtgacaggtgaggactttgtgaattaggagaaatcttgggccccttttctgatagctcaatatcaaataataagttaaggggggatcaaagtgtttaattcactgaatgtaaattttagcctttacattcaatgccattttttaattcatgcatgaatttgcacacaccattacatttgtggaatttaatacacttgtctttgataaccttattattttatttcctctgaagtgtaaggaattctaatgatcctatgtaaaaacacagcttacttttattaacatgtaggagaagcaaacattcacttacatacttctgattcatggagatgaatttctcactgtctaggtcaggtcctttagtagactgcttccttcttttaggcagtattgtcaacttatgcaatcaggaatgaagttttttctgtctgtcctctatagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcaggtatgggacaattccttctttctccactgggttttgtcttagctcctttattctaaaatgtcacctgaactatcctgctgttttattaaagacatgtccaatcaatgcattttaagaattgatctcttctctctgactttattcaagaacagagttaattttttttagtttacaacttaattataagatttaaatatgcattattcatgcctaggtctatggggatccagttcataacataatcacttagctccattctttacccagaccattgtagggatttaaggtgagaatttaggcatctgaactgggtagaaaatattttaattaggcataggcacaggcactttttaaagttatgtgacatttattgaagcagaggactctggcatttatattcctaataattagagcagaacttaaaataatcccaatatttttataccatatattacatacatctattagatatgcctgagagaaaattaacaacaataattaataaatttattccatgtgcttctagttgcttaatggaaaagatgtttccacgtgttatctgaaataattgttgccaatttaaagatttaaatgtaaattagcaaatatcagtataaaattgtcctatgaaaatttgataaaatgcttacacaaatggtaaaatatgctttcatattccctttcaaatgtgcttctacgtgacagtataaattttaatggataaccactgttttttttaaacattaggacaaatgatcactttcttataagcttctctaatcattatttaaggtaatgctaggtacttaattttcaaatttcaaaatactacgtttctatcattcttatgcgtggacagttaagcatatcagaaaaataaactgaccaccctgaaaattacatttgccctttcttctgagcaaaagtggcatttgaccttagacaaactgttctaaaatggcatccatctgtggctggctgtaaatgggtcctcacacacaaattcagagagatttcaccgttctgagatgagaaatcacaatactgtataatgtacaattttattaacaatgtaaccaagggaaaatattcattacctgcttcctctcttcttttacagatatgtagtttagaaggctcagttataatattgcatgtggaaatgatgcaaaagaaaacacaccttgtaacaggaaaatgtattggcataatttactctgtagtccatttattctttctacaggttaattcttttcaaggtatatatatatatacatttacgaggaccatacttattgtataaacttgatgttgtgatcttggcctctgttccttttacaggtattcatttagtgggctgctgtgcattagcaaagggctgtcacatctcctgggctgagtttaattttgttgtgcatggcacttttgttaggtgggctcggctttgttgtggaataaattgaaatcatccaaatgtttcatttattgggctgaatacttcaagtgttgtgtgtgtgtgtgtgtgtgtttaatttccagccattaacctttgtcattgatacccaactccatttccaatcttcaaatgactgttctttaaatgaaatttctgttcgcgtttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaaggtactttcaacagctgtcaacaagactggttctaggcagaaacatcagatatttaagaacgaggggcttgatgaggaaatatacatgtgcctgcattgctttgtatgatggctcactaggctttatccagggaaggagaaggtagcttgctgtttatcttggtgagatgtgttctctttctggagtttttgggtttattcagcaaaaaataaaaataattgggtacctctacgtcgaatgaattcactaaattagagctttactatatttcaaagggaggaaaatgtttctccttctttaaaattaattacacaataacagaaaagtggtctttaatgagtagatgcccaaatagaggtataaaaattatgtcctattgtttcggaattctgtttttatagtgcagtcgttctcacagtgtggttcctgggtaagcagcatctgcatagcctgcaactgttagaaacacacattttcaggctcaaattcaaacgctctgaggttggggcccagtgtttgttttaacaaaccctccttgtgatgctgatgtataagttttacaaccactgctacagtgaatttcgttaaatcagatgtttaaaggagcaatttattacagacagcaggaaatcaagttttctttctaaagaactcaattctttcgactataatgtaaaatacacacagagtattaaaatataatttcaaaatggaagatttcataattttatccttattacctgtctcttcaaactgagaagtcactggagtctgaggtttaatatacaatgctacattatagtttcccttctgacaagtaggaaaaagaaattaataaaatagaaacggtaattttattatttgttataacctacttcccacagggttcttcagaaagggttaattatttcttatttgtaaaagactttgaacaagatataattcaaagtagtatttttatgcaatgaaaagcaccatacagccataaaatattattataattacaatgtagttcggtgatagtaactagcatgctattataacggagaagggcaccttaaaggaatcgactgaaataaagtcaccacgtgactttgtaacgttgctgacatgatgacagtcaagggaggaggaaatgccattttgctattgttctctaagcagtaatgtgattaattttccatggcgataaagggcctgtaggtaaagaacctgtctcttgagaaagaaaaagcacaacaaggaatttgaaaatctgaaatttgaacctagtcatattttaccttccttaaatctgattgctttttactgtgtttgaattaagtgtgtaaattttattattgaacttaaaatggaaaatgtgtacaattttacgtcaagaaattgtagtaccgtgatcatttatacctttgtgcatagaaatagtttttgtgtgtagccagtgaaacgtagagagagatcagaatgggaagatatttggtgtgattgtatctggcagacctttttgatcattcgataactatgctagtcactaaatcttgactcataaaataactcgcagtgaagaggtcaagaaagattaatgaaaagttgtttgtggtctggtttgttccaatggaaagaatatatagagtgaaagacttctgtgctcttaacaaatacttaataggaaaacccacgtgttgtgtctgaaggtcaggattatttttgggtaccatactttcagcagctttgcaatctgcaaagcatttctttttcaaagaacactttgcactgtgaactcttatttttcaaaggtattaaataacagagaatctagaaatcttttatttcattaaaagtacaaatacttggattatcagcatcaaaacagaacatacatatataggcatagattaatgttattcacataaagggacttttttcaaattaagtaaaacttcattttactgtttatgttaaaaatgaaaaaaaaaaagtagaactggaaaaacattacctaagtattagtctcaattatttacgacccaatttaagttagtgctcccaatttaagtaatagctgagaaatgttcttaaaaatactttcgcgagagtgctgcatgcattgtagcctgagataataagaaaaaacaggattacgaaaataaataactttaaattggacttcctttcttaaatacaatagttggagaaaaacaattcaacaacattgtgtgccagcttaaaaagttaatctgagtatgtgtaaaattcaatgtttaatatcaatttgatggacttagctgcttacgatttatcattttttcttaatggacacagcctataatttatccttttttcttaatggaccgagaatataaaccatcatatggagaaatagaatagtacttaggagactgatgaataatgtggcataacaatgtgtgactgagggtataatattttaaacatgacctttctttcttcccttctccccaccactattcctaaacatgtctgcatgacctcgtgtcaggtattagagtactgctcaaaatgtattactttagaacatgttatcagtattataactatttctgtcaaaagtatctttgcaaatttgaggagctgtttcccctcttcccccaactctatttacctttaatgacagaattcactttcctagtccaccattacttctccatccatgctcccagactgaagtaggtcaagaagaaaacacaacctgcaaattgggacaagggattaacaggtcccttagcatcagtttttagatatatcccaatttacacatccagaaaatcattcaatacaccaacatctgtacaaagctgctctttctagagatctttctagacttctgtagagaagtcttacagcacatactttatcctttagtaataaagtaagtgatcttatacaacagtgtgtctgcatttgaatgcggatgagggattacaaatactcttctattagtatatttttaataaagatcaatatcatctttcattatgtcctaccacagtggtatatttatatatataggcttaaatgctttttgtcacaagagagttttcgttttgtttccctgtaattagttctaaagacatgaggttgatttacataaaataaattgtaattttaatatgaatttttaaaggtgggaatgattctcttctctaactgcagatatcagcccaccagcacaaggagtggaccacaggcaagtgcagaaagagctaggagatgtccttgtccgtcttcataatccagttgtgctgactcccaccacggttcaggtcacatggacggtaagctttcaaaggcaatgttaatagtaatctcttctctttcgggaaagcaaaacatggaaaatgcaaatgaacaaagagtgataataaaaattcccgccatttaaaatcaaggtgtaatcaatgatagtaaagaaaatcaacaaattaaaaagttactagaataaccatagtaagaatagattattatataaacatggcatatcctgtcttctgaattttctaacagctttcttgcgatataattagcataccataaagtgaacaacttcatgatttttagtgtatttagagtttctaaattatcaccaaaatctaattttagaacatttcatcatccccaaatgaaatcctgtgcctgttaacattgattctctcatttcccctaccgtagccctgtgtaacactaatctactctatgtttttgtagatttgcctattctggaccttttatatgagtacaattgtgcaatatgtggtcttttgtgtctagcttctttcactctgcataatgtttttgaggttcatccatgtggtagcgcgtatcagggctttgtttcttgttgttatcaaatagtattccattttatggatacttcacattctgtttattccttcttcagttgatggatgttcgggttgtttccagttttgtctattatgaataatgctgccatgaacatttgagtacaagtctttgggtggacacatgttttcatttatcttggtataaacctacaaattgttcagtaatattggtaactctccatttaatattttgataaactgccaaaatgctttccaaagtggctatagcattttctattctcactagcaatgtttcagtgttccagattctctcaaatccttgccatttttttctcacatccttgccaacacttattatcatctgccatttggattatacccgttctggtgagtgtgtagtggtatataattgtggttttgatttgcatttctttaatgactaatcatattcatcttctcatgtcctaattgaactttttttttagagaaatgtctattcaaactcttggtccatttttggacaaagagtttgtcttcttattgacttaacaagtgtttatatactctattttgtttgtcttcttattatagacttataagtgtctatatagtctagatacaaatgccttatcagatacgtaatttgcaaacattttctcccagtttggttactgtaaccctgttatgtatttaaagttgagtggcatgaagcctccttcttccttcttttttgcttaggattgccttagctattcaggctttttttgttattgttccatgttgttactccttaaagcaaactacataatcagtcaaattattggtttatgagtacaaaattgggttgtatatattttaaaaataagactaagtttataatattttaagagtaattatgattatttaggattacactttcttattccagttttgacataattttgcatagatttattctattttctgcatatattggtttctattcttctgttcccatgaagggaacacaattacgttattatttttacagtggcacagtagggggtattatctgccatgccttttctatctttcagtacccttgagtagatacaaaactaacaaagccaaaatactacgctgtatttttcacagcgtagtagttttcctcattctcaattgaaaaaagtctctgttctgttgcaagttataaggcggattcttttaagctgcatctaaatgtgggaagtctttgggtaagaatcaaagtcattatgttgatgaagttaatcactttaaagtcacttagtttcaagagtaaatagcattagatcaaaattgcatgacagcagactgggagttcttccaggagggggacgttgtctattcatctctgtaccccaagaagctatcattactagtttgcacatctatccccgtcatgggctgtaacttctgtgaggctacagccaatttctttcatttctgtttttttcagagcagagtgtctattatgaagtactctttttaataactgtttgttgaatgatcaaatcagttgttttcatacattttacactttttttaatagaagaaagaattcagttaatatcacggcatattgttctctatgactttgtagttgcacatgacataagtatgcatttgaaagagataaattaagtgaaataaagtcagactggggtgtgtccagtggtcaaataatttgtgtaactcttttattgatgtaatatttttgatttactaaatgcatgtgttatttaaattatcaaaatgttagcatttgctttacagaagtgttggggttgaagggagaaataattccccaccatgtgattaggttttgggccagctgaggaagtttcccagtggttggcaggattaatgaccaaaggcacaagacataactactgtagagaccattcgctgtcccccttctcaccaggctaaacttgaaacaatagttagcaacaactgctttctaaaatggctgcttttagaatgagtgtgggcaaaaatgataagaaacctgctgttccacaaagaaaaatagcaataagtcacttaccgaaaaatgattattctagctttactttttgtctttgttttgttcaaggacaaaaagaattacatactctttgcccattaagcatttttccacagagattgaaaagagtgcttcgacaaactagaatttcagaagtctgctaaaaccagatcagacccttagcagctaaacccatcaaagaaaattcactttgaatttttgctttatattgagttgttatgttgttttgttttgaaaatggaaaaggtaaatatgaagcatcacacttaaacagtttaactagaatgctgattttagggccacatataagccgtcttcttttttagcctgttgcttccttaacaattatgttttatcattgtgcatctctaaagccagcaaaatgctttcacttatatcagtcacttgattgtttctgtgcccttgagatatgggtattatgtgagcaaattaagtaaactgaggttcagaaagtttaagaggttgaagcctaattcaaattgagacctatggctggaagcctgaagttctcgtaatcattttatttttccttaagacaactctttttttattcatgtttcagaaaatactattttaaaaaaatatataaacccatgaatctgtggtcagactctgattgtaatcaactctaaaagaaaatcctctttcttagaatgttaataaaactcgtaacaaacatatggcctaacttgaaaatgaccacctgtcaaaatgagctccaaaatttagtgaggtagaacacacatccagtaaaaatctcacctattttttttaaagtaaatgttcagtgttttcatttctgcttccacctgtaacaacaaatttcgtcctgaaaaaaaaaaatgcattgccactgcacacaatcaagttaaactatttaattattaagccccatacgatatactggccgatgatagtgtacactgaagtgtgcaagtgtgcaaaacaatgttttgtggtaaacattagcttcataaagtccctaaaacacttaattaatgaaaaccaaacatggataaaaccaatttaccctgatttacagactcccttcatctggaaacagctgcttaatgttcttcttaaaaacacagcttgcttctttcagtattaacaagctattattgtgagttatgtctttctttcagtatataaattcacttaaagcaaatgcagagaagtttataaaatgcaaacttagtgttgttttaacatatactgcaagggtttttttgaacactgacagttttgatgaaagtcatctctctttggctctcataaatttaacttttcgcctcttggttgccttatttcatagtgtcagaaaaactcctgcttttcaaagaatgtatccaatggtagaaacataaactggtagcatgaatgaggacttgccgatcaccagcttccatgttacacctgggctcactttttttttttacctgacctcatacaagtgtagcactaatttcagaaagtctttgagggtgagaaagctttcaggtgggtgaaggaattcattcttgttgagacttatctgggaaactggaattagccgtacatagaaacacacacacacacacacacacacacacacactcacttaattgagggagttttctcgtttggacattctaagtatttccttttgttccactgtatttttattgaggctctgcatttttaactttctaaagccaatatttttagctaacattcatttgttgcccccaattaaaaataaataaaacaatactgcaactaaagaagggatattagtagttaatacatgaaagaatacgttttgtttataaactgccgacaaatttcaacatttcaacaaaagttgaaacaaatttcaaatgctgaacaaatttcaaatttcttggataaagaaatttgtttaaagctgaaattaataaccgtctccataattctcttttttatttcctctttctctacaaacttcctgaaatgaggttattccatttcttttccattaatctttacactttatttgatagtgaagtatgtcaaatttaagccttgttagactatagctattaaactatgataagggatattagttggaacatgctatcatagtttgtgtttaaatcaagtgtttctaaaaacatgacaaagtattaaaagatgcttaatttttaaaaataatttttaaaatccatagttgttttctccctgaaaatgaaacaaccataaaaccctggtaaatattttaaaataaatgtatacagagaagaatatatttcattttttaatcttgcatttttatatatttcatttttaggtgattgtcaatagcaaacaaaaacactttttaaaagttctatttggtatgagtttaatcttagattattatttaaaatagcttcttactgtatcttaaataaatgaagatatcaaaaagttgtcaaattttgtcaagaatgggacaattgaagagtcagaagttggtaaattagtaaaagtttttcatttaatatttggtaatgggcataaacgttcatatgcttttaaaacaaatgctctagctctacaactttaatctgtattatatgctttttccagccacagggactttatacatgatgtcctcacatttgttttcctgggtaaatcctgctcttcttgcctatctaagcacttacgaattcttcagggatgctttgcctctgcttcccaactcagtcacctttctctccactataggctttcttagctcttggcacctctcattcttaacatttgtttatgcttttttttttatgattgtaacttgaccatggttcagtcattattagaccactcctaccttctacctggactccatcttctcacctcagctcatgagggcaggggctgactctattttcattgtccattttatccccagagctcagcagaatttctggcacctatgagtaggaacccaaaacatgtgttttgattgagtgatgatgttagtgaatagacaaagaatgagaatggaaatccctgacaaagggcatattacatataaagccacataaaagggaattgttggatgcagaaaatgggtaagcagaggagacataaagttagagatactggcaggtctggcctttgagaggcccttgtgctaatccaaggcatcttaattaattaggttggtatcttagatactgtgaggtattttaaacaggagagagagttctcccaatcttcattttggaaacaatcttaggagcaatctgaactctaaaaggatagaagttattagaagcagagagattagctagaaagtcatgacatcactcagttgatagttatgaggacagaaatgggacaaatgaaaagaggacaaattcattgtgttgtctaaaatactttcctttagtttcaaatgcccttaactatgtttttcaggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaaggtcagtattcagatttcgaatataaatcaaacatgatgaaaccaatttctgttacagtacctatttgttatcttccttagaagaatggaaagatatcacctaaaagtaaattgaggaagtgtcgttttctccttttattctgagaattctatagaatctgacaagcagaaaaaaggacactaatgtaatttgaatttttcttaagtaaccatttgcaccaaatcttatgtttaagttcacttgaattggattattaaatattcccctatattttgtgtagatttagttcatttggatcatgaaagacagacgactggaaatttgagaacacaggctgttcattgtgactactcttcttttgttatagttaagtgtgacattttcttttattagccactttttcctatgggcactgccagtcaaacccatgatttctaatcaggaagggcacttgcgtatttgcagtagctttcttcttagtgaagttccctcgttctccccactttggaccttttcttacctaaaggtatgttaaagtcaatctgtgatgaacacaagctttccaccagttcatttagtagtatctctttcactaaacaagaggcttataataaatgttgtcattaaagttaaaaaaaaggagatgcgaaatgaaataaatccctccattctgcttttgtattaattttgtgctcacaactcttgtaaaaagccctttctttaaacatatttcatacaaaataagagaagcctttaaaaaatgtatataggttgcccacgttaacatctatgtgcttgaccaaagagctcttaaattatacatttcttacacaacatggcaaaaatgtcatcttcccattgttttgcagtgtgatacactggcaggggcaaaaatgcatattcaaaaaggcatcattaatctatttttaggatatgttgaaaagttgccagtaattataatagtatcttttctccttgccaacatgtttaaaaataataatcattatcatcatatctttattcatcgttaaatttcactctgtgttgcaaattggtagtattaatgagtggagcaggtaaccttaacacagaatgctctctttgaagcctgttaccaaaatcaatttcactgcagttagacttttcctctggattagacatttgtccctgttgggtatacattcatctccaatttctgtggctatgtgatggtaacaaatggaactcagctgggctgtgtctgggaatgatgagcggcgatttgggttctttcacatctgtagaacgaagctgagtcctggaataattgacctgtcaggaagcaggcacggtgttctcgccgagccagcagcaaggtgaatgagaaacccattctgaaagtcttatttttcaatgcattctacttaataactacaaggctcgtagacaagtggttggatttattcatcatgccatattttggagcaatattgtcacaaagaggaataggaaagaccagtactctattaacatgttgctgtgtgtgtcctatatctcaatgcaaatatggctatacctaagtgaaatatgtcatgacatatttacaaaacatgggatatctgctgtcaggcttttaaaatatattttaggatatttaggatagtttcaaaaaactaaaccatgtagagctatgtaagcattgatgattctacataaaaagccattaataccaccaaattatttgatattttaaactgttaagaacgatgttatgtaatactatgattttaactacccccacctttgattttaattcagagaatcactgagaatagatgaatttttccacaaagttattatttcttagttctcaggcacattaaatgagagatgtggcattctaaaatcaggaagagcttctctcttgccttttctcagtatggttgtaattagttataggagaaactataaaggcagagaattattgtaggaaatcaaaatcttcccatttcacatttgacccaacatgaactgttttcatttttatcatcagagtcccttgcccatccatataatataagttttcaatcttaacttgcgggtcaatttatagcagtcaattatttttcccagtatgggaagaaaaagaagttttttctgtgttgatgacatttatagttatgtttctgtttttatttagtaagcacaagctaaaagcataccaaaatagctatcaataatgccaccgttcagaaataacatgtgataaatactggaatatgtcttctcagaataattttggttagaagaagttatggttgtttttagaaagacagtctattagagtagagttctaaaatcagacatacaccggctcaaattctgacttgctctttgactttcctaagtctcttacagtaaccttctgtttcctcatctgtaaaaccgagataagagttgtttctacctcctgagattaatgcaagcattaaacctgacacttagctctgtgcggggtgtatagaaaacacttattagaatgttagctgtaaatttattattgagagcatattacaaaagctgttccatttgctttaaatctagatattgtatttaaagaacatttctcaaaaaaactgtcactgttgaacaccgtgtgcattcagaactcctggaagccagagtctcctgcaacttgtctttatactcatattctgaaagtagcatgaacgcacaccaaggcttatagtttgcatttattctaattacttcctctacagccccaagtgccccaccacagtctgtcactgtactgacagttggaagctacaatagcacaagtattagtgtttcctgggatcctcctcctccagatcaccagaatggaattatccaagaatacaaggtaggacccgggtgaagaaggacagctctcatgtaaaggttcccagagaaatctcagtgtctcacgaatgagacacatctctaaaggttctcttattcagtttaagtgtaaagtttttatttatatttctgtgtgacagagaatgaaacaaatgcataggtattagaacctgagttcaaggtcagagatcacacaaacccagttgaacaattaaaccacaccagtgaaatggttttctgtatagtgtgactctacaacctcaaggatttaaagagatgggacacagggtaggttgtgaagcctagaaaatggattttatctttgttattagaattctgcataagaggctttaaggcagctgtttttaaaccacgttctcagaaaaaaagatgcttcgggggttaaagaggtggagtgggttgtggcagcaccgactctcactctagatgctacttttgtgtatttattgaggttgtgtagaatatttcacctgaaaaaaagccactgaacatattttacaaaatactgacttacagaaaaaacagttgattgtctcatttttcaactgatgaatttttggctgtttagaaacatatgtatctattgtttcattgccatcatttggtgtgtaaagtagaaagtatgtctacgttttcaaaataagattctgtttgtgttgtgattagaccacatgtgaatgaaaaacccctcattaatctttgtaaaattcaaaactataatttattaataaatcatctattgatatcatttattaataaatatttctagatttctgaaaatagcatattctatacatctaatataatacaaaactagacacccatttcacctacaaaattcagagttggtatttaatattaagctgaataaatttactcaaaagtttgcagattaaattttatttctaaggaaatattaatttttacatacaattttattaaagaataacttgctaaagcaaatgaatggactaaatgtataaggctttattttaaaatgatttctatcatgttgtaaagacacatgcttaagaaacataagaataaatgcttttacaatacaataattatatagattctaagattttataagcattaggacattgttttaacagagtaacaaattatctactctgtgtgagtttgagtgtgtgtgtgtgttttaatgaggttaggaatttatttttgtaccatttggcactaaatatcctaaatttccatgtagttaaatattgttacttttttttacaacatgatgaattttttttccataagttgtaaatgttctcactctctaggcacttgccatattttggtttcaaagcacatatgtaggtaagagctaaatattccttcactaagaacacagataccatatatcaataaaagaaacacatgattcacaagaattattttttactgaaaaattctgggaacttacctgctccgaaacaaatcatatgttttcctacatatgtgtctacatgtagatttttaaatattgtataatatgaatacaaatgtggatacacagtggatttcttttcataacacatttcatcagaacaatttctatatccaagaagatgccctaaaatttgattcctacttgaaataaaagcctgacttccttaacatcaatatctaaagacttgccaccactttgttctcatgaatgtgtatgtgtgtgtagatatgtgttgatcaatattagatttattgctgtcaacgtaaatattggctttaatttcattttagtcaatacctataacttaggtcaattcatcttgttaactacttctgtgtaagttaatattttcttaaatgaaatataaattacttagatgtctacctatataccttagatattacaacttataatcaccatattttagtggattatatgcataataaatcttgataaataaaacagaggaaattatgtgttttaatccatacaaaaatgccatttgcaaccaaagaccacataccagaggtgttaaagaaatcactgtgctttctaaattactcactatgagcatgcagtgctgagaataagatataaatgaacatggcatagtttcagcttcccttattgttcttcctttaatacaggtgcatgtgcacacaaacacacttacatatacactcaaactgcagaggttgggctttagaagatgtcatttgcaaaacttctataagcctagaagatagacaggttatgattaaaaaatatttgatcagttacagtagtctcgttaccagaaacgataatcttatatccatgtgttattcactttccatttctgtagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcggtgagtatcaaactatgtggtctgtgctttagaatcagtcagctgacaaggtggatgatgattttgcatcaacctactaatagtgaatatacacttatgaatgatagggtacacatatcatattgacaaatgggttaactgactagagttttttacaaaaatacttggtgcaattgatcatgctcttaaaagtcccagagccttattaaaattgcaatatttaagagtttaaatgctgaaaggtagtttaaaattacttttaatcaattgcctcattagcaattttggtgccattgaaatataataaaaatgagatagttactgaagagagaccatcatgtttcaaatctgtatgcttcctcttagtcagagaaatgtcaaaaattaacaagaaacaggtcagaataagctttgtaatctaaatataccatcccaaagaagaaatcatattaaatctaatatcatcattgcataaaattgttccctcttatcatagattatgtttgtctgttcttgagatgtatataaatggaatcatacagaatgtgattttttaaatctggtttctttcactaaggataatgtttttgaaattcatccatgtatgtattattcagtttatatgttttactgctgagcagtattcaattgtatgaatatgccatattttgtttatctgcttttcacctgacagaatgaatattactgtgtaaatgtttgtgtccttttggagaaatacctagggtctaatgtctgggtaaaagagttgtatagtttgagtttatgagaaactgctaaacaatattcaaattgttatataatttcgtactcccaccagcaagaaaaatgacttctagttgccctacattgtcaccaacatttgatgtttccagtttttgtgattttagccattctaattgggataacctgtgattttaacttaaattttcttttatgactaataatgtcaagcaactttacatgtgcttattggccattcacataatttcttttgtgaattgaccacatgtttgccttttaaaaattgggttgtctcttgttactgattagtaggagttatttgtacattctggatacaaattcttttccatgtatatgtgttacaaatattttctcccagtccatgacttccctattcattttcttaatagtgtcatttgatgaacaaaagtattacattttaatgaagtacaatttatcatttttctttgatatttagtgcttcctaagaaattgtggcttacctctagatactgaggatattttcttctagaagctttataattttagcttttatgcggaggtctataattcatctgatggtaactgcaatgtggttaaaggaatgaggcttatttatttccatatgtttttctttcatagaggttatttataagtgtattatttaatttccaaatgtttagggacttttccagatatctttttgtttctgatttctactttaattcccctgaggccagagcctcagaataatttttctttgtgtaaatttactctattaaatatggagacttattttttgacacaggatttgatctcattgaatgtttcttgtacacttgaaaagtatttgcatttctctgttttttcagtggaaggttttatctcaggtcaaattatttgttagtattatcaggtctttattgatttctatttgcgctcttaattactaaaaacagtctggaaatctattgtaattatggatttatgtatttccccctttcatctataagtttgtgtttcatgttttggctactttgttttacatgagtatgttttaagattattatatcttctttttaaatttaccctttattattattaaatggctacgtttattttctggtgagattccctatcctaaaatttactttgtctgatattagcatagctacatcatcttttgtaagtaactgcatggattgtcattttttcattctttcattttaacccatgtttctctgtatttaatgtgcagttctattaaattgcatattgttaggtgatctctgctcactgcaaactctgtctccaaggttcaagagattctcctgcctcagcctcctgagtagctggaactacaggcacatgccaccacacccggctaacttttgtatctttgtagagacagggtttcaccatgttggccaggctgctctcgaattcctggcctcatgtgatcctcacaccttggcctcccaggcatgagccacctctcctagccagtcttgtttttttttaatccaatctagcaatctttgcctttttaattgcatactcagaatgttattattaatgtaatcattggtgtgtttgtttagaattactatcttgctatttgtttgctaactttgttactatcttccaaatttcctgctttcttttgataaaatgagaaagggttagtattttttggctgctcttggattattaggtacacctcatttctttgctgacagttgctctaggatttgactataagtatcctagagcagtatagtgtcactccttttcctctcatcttttttttgttgttgttattattataccttttacttctatgtaataaacagcaatatacaaattatagctctagtgttgtttttgccttaaacatcagttatcttgcaaataaattcaaaataaaaagtgcagttctcatatttatctgatattctgctccataaattcagtccctggtcaggcgcagtggctcacgtctgtaatcctagcactttgaggggctgaggctggctgattacctgagctcaggagttcgagaccagctgggcaacatggtgaaaccccatctctagtaaaatacaaaagaaattagccgggcgtggtggcgtgcacctgtagtcccagctactcgggaggctgaggcagtaaaattgcttgaacttgggaggcggaggttgcagtgagctgagatcgtgccaccacactccagcactccagtctgggtcactgagcgagactctgtctctccaaaaaaaaaaaaaaaaaaaaaaggaaaaaacattttcagtcccctcagcttccatgagtgcttcagtcttttcaactcagggatgctgttcagcaatgtttgggttagtcttggctgcatcatattttaaagttatctgtaggtacaaagctgtgaaaatattaaagttgtccctgtttctttcccttctgtctgagatcacagccctactcttttctttcacatattttgcctagtcttctacttgtttgcaatgggagtgcatatcccaatacctgttatttcttcatgggcagaagtggaagtgtccagggaactggtcatttcatatattacactttcctgttctataacttccatttgctttcttttacacttttcatttccctctgatgttttccatgtaatcatttattatgaccatattaagtccatacacctattgtaatagctgcttcaagttcttttctccttatttcaacatccatcttgtctcatagtctacttctattgattatcttttctgctgaccttgggttatatttttctggtttgttgcttatttattttcacatgcctagtaattttttactatactgaacattgcagatgaaataaaattttgtgatcttttgaagcatgtttgtgtcctagcaggcacatacattactgtctggtcacctttaaccagtgatgtcttagtttttacattggttagtatgggacttcttatgtttgcccttattctcaagacaaaacctcagtaaaatactttcaaggcatgatcctctcctgggcttccggtgagaagcctcatatgtttatctggtcttcctaacatggtttggaagttttgcggtgaacatgagcttaaacctgtgctttcaccagatcctacaatcttctctttgcatgcacagttcagggttcacctttggatgtaaggggagagtatacacaaatttgagagcatcactctccaccatctccctctttcatatggttctcctctctattttaagtcactctggcctccctgaactccaccctgagacacctcatatcaataagattgagttttttcagctgaggtcctaactgcctcacactgtatggattgcggtgctccctaagggaaagaaagcctcacccctgcagatttcctctggtaaagcgccgttcattcaatacatgcatccccttcagttttccctgcttttatttgcttgccagtgcctttaaagaaaaataaacaaataagaaatcttcttcctagagtttacatgtttttaaagtgtttgatataagccgttctcatttttttctatttatttgctaaaatgatgcatataaagctgactgccagcttctagagaattctttctattacaaataagtattgtatatggacagatttaacattcagtcatagcgttaaaattttttagattctctaggttttctttcttttatatattaaaagcattgtagagaaaaagttacagtattaacttttctttaaattgtcttctctttcttaattagtcattcagactgaattaattccttaacctgagggaaacctacaatcttgtccttctgagattttctaaaataaattggaataagaaagaaatacaggtataccaaaaaggatttaacttacatgtgtgtgtattcatttatagtatttagaaataagcccttattttttcacttaagaagttatatatatatgtatgtgtgtgtgtgtgtgtgtatacacacatacatatatatacatatatatatatacacacacacatatatatacacacatatatatatatatactatatactggcatatatatgccagaaagacagtacaaaatatctatatctgtatatctttatgaaatggattggctgaatataattgttctaagtgaaggataactaagattgtcaagtaactgtcaaataacgtattttcctttcatagttttttttggttatctttagtaataaatactaaattcttaagtagagctttctgtttctttttcttcctagtgactatctgtttgccagatattttatctgtttgccagatatttgggggatttatttccttatagggaagtaaaaaattacaagcatacgatataaccaagctcatgtcatgacaatcacagttatgcactgaacaattgaactgtaacttaaaataataaagttaatgattattttaaaccaaatagaaaatttcacttaatttccctatcatttataaaagtctgagtcttcagatgggtaatgagtaccttttaatttactatttagcatttcatacaagtgttttcacatttttctatgagataaaagtaacctagaaaataatatatctatcttttgttcaaatagttggaatatgctgtactcaaaatgtaattataaaaatagaattacagaaattctattttttgtgtacacacacacacacaaatcacaattcaacctagaaaaggctatttgttcttcagagatttatttctttttaatatctactcttgtactgagaagccttctaattgtttctttaattactccttcgtatctaccttaacatcttgtctgatgcccttatctacacaactgttattccttagttgagaagtgatttagtgatggctaatcttcttttctgtttcaatttacactttcccattgtctattcagaactggaaacggcacttgaagtgactcaaactgtatcacatttcccctttgttttaattaaatcatgtattggcatttgatgtaatttatggttgagaattttagatttgtactatgccagaccatgtattgtttcatctattccttctcagtttagccttccttccagaaagttccattaaggaaccattaattaaaacattgtaaaaatgtaacacgctgccttacactggcgtaacattggtgttgttcttttctgtgcagtttcctatggtaagatgacttttacatcatagtgtccataattctgcatcattgcatttacagacacaaaaatgcaatcaaatacattcagatatatatccattaagcagcgtgtcatataaccaatttacattgacttaagagttttagttatcttgcttaatagtatagttattgcttctctaatcatttggcttttcacgcttacattacatagttggttataatatgtggaacagctgcaaactttcacggtaataggtacaatcgaatctgatgtgtctaattaatttttagtccaacaaattagttttgttcttcattactctccaatgggatgaagacattatatttcattatatttttttgtctgcaagaacaatggagcattacaggtcacacacatcccttgtctatgctctaattagtccaactgacaacattgtttcaaaaataccagcagcataaaaaatagcaatacaccttgagtaacataaatattgcaccttaataaaaatgaaatattatggatcctttacaaaaatgaaggccaaattttcttttctctttgttcaagaagttatttgttttctttctgataattcctaatagttaaggaaatcaccagataggtgtatgtctcatattgaaaatatgagctcattttaaatacagctttgactatgtttaataattatatgtataataatatataatattaaacatataataaatatatgtataataattaaaggcagacatagtgggaaaatgagccagatttactacataaatgacgctggtttttaaatctgaaatttaatacaaaagacctttcaggaatggattataagtatgtataaggaaatgctagcagctataataaaaaagcctgaattttgaaaagattaacaaaataaaattttatttctaattcacagctcagaccaatatgggtcagcagaatgggaaatggagtttctactccataccgttattcaggggttttggatctttcaaatcatagctctgccatttcttggaagcttaacatcctccaacagatcccctgtttctgtccaacagtgaggaaagagagtttcaagtcaaggcagtgttacggatcaggcctggagggtcgtgtgcactttttgttcctagttaccactggctaatgctcagttacttttttgaactctgctgcaaaagatgctaggaagtgtaggctaattttctgccttggaagaaaggagaagcagtgaggtaaacaagtgaattgagatttgcaggattctcaaatctagataatttatcactcatgacactgaggttgactgagaagcccttaaagcagcccttaaacttacatgggtcataattttgagtcaaaaactacatattagcctccacttcaaccctcccaaaatatatgaagtagacaatactggtgccaactaattgacaggggctctagaagatttagtgccctatataagcttactgcttacttagctagtaagtggcagagtggtttcatcaaaatcatgacttcaaagatcatgatctttttaacatattacagtgctatagctaaaacaaggaaaatcccacacattcctttgatgtgatatgctgaaatgtgccatttatattttgcttaccatttaccttttaaaagtctttcattaatcactaattaggcatgatattaacattagaaatcacttaattcccagcatctacatttcttaatctgctaaataagccaataaatcttatgattccacaagtttaagacctatttaaaatgtagattgagattttcttaattatctgagaggcctaaattttccaaacatgactagttctagaataatcttagttcagatttaaatgcatttctcagtaatggagacctcaaagttaatttttaagttgttctttaaatttagctttcaaatggattttcaaattagtttcagatactttaagggaatatatgagtttcatctttttcatattttaattatacacgctgatctctgtgaaggctgtttacataattgtcattgttttgtatagtagttttaatacttcccagaaaattaaaggatattggctcaaaataagttctttggtagaatattaaggtcaacattaagttacatgttcttgtgaattatgaacatttggaatatggaccgtgccttagcagaaaagcaatttgcaaataccccatgttaaaagttgtaattgctttcttaaaaatgagaactgtatttaaaaacacttgatgtaattcaagataagttattaattcaactcctagtacttatttttataatttataaggtgataaatcaactacgttgtgaatccatccatagcaaaccacaacacaagaggtcagtgttcttaatcacatttgcaaactcacgatttgattattcttttgaaaattatgggctatgcttatcaatacttgtgataggctcaaaactaaacaagcatttcctgccttcaaataatttttcttcatttttgatgcaccatgtttatattcctgtgcttattttcgttttaatatatactaatactatggttttttccatagggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctggtaagtgactatttccagctaagaaaatctcttgtctgtaggaatgtaatgaaatgaatggaaggaacagaaaggaataacaaatgagtgatttgggcttattttagaaacctgcactgtaaaatgcaattacactcaacatgctttaatgcattgctcttgacctatcgctttataaccataaggcagtctgtttgcttgtagctccagtgaagcataacaagagcacagactgataaaaatgcttaactgtttttctcaactagttctttgaaatcataaactcaaacacacacacacacacacatgcacacgcagactatgtgttacatgctatgaagccatgtttgagaagtggatttatgcatgagcattacttcaatgttcaggaaagaagaaaagtttgaaatatagcttttagtgtgtcaggatgcagattacaataggaaatgtccctcgtgaaaaatactgacaagcaaaaatctcaccagaattgataagactgatgaggcatgaattaagtgatttactgttcacttaaatagactcttattacaatgcaaatgaacagtattttaaaagaaaaggaaaacgaagaaaaagagaaagaagccgaagcagaacaataaaaagaagaccctagatggtctacatcttcacaacaatgttttcttcttagactccaagacagagtttcaagggtgtcctataatgtggccttcaaaatatctccatggtagagagagaagagagagaggacacacaaaattgtaaagtcagtgattgagagaatgaactcaatactgaagcaatgttcaattacaattttaagtgcactttattttaaatattttctccaacaacaatgataagaaatatctcacaacatttcacactttctagaattaataagggagcagttttaatttgacattattttacaaatatgtaagaagtttttgagacattatattcaatcttgtattcctaatattaaatttggtaggaagcataaatgtcttagtaactgattttgacagaggcgtcattgattattaagcttttacgatgctgtggcttgtaggctcctaaactgctgagaatgtggaaatagtgcaaaatgctaagtatagcactgacttggttgccttgtttgttatttgatgcatttatatgtttatgatcatttgattatagcattgtagcttgtgtctatatcttatgaagttaaaatttattagttacttgttagaagacatttccaggactagagaaagtactacagcatatccattgacaagaggcttccatgtttggtgacatgccatcattttgccattctcatttctcattggttgctgcctctctgcttcctcataatttgtcacccaagtgctatatcacttcaacagtgaaggattctttgcagaaaggggtgctaggcagtaactgagtgtcagagtctggaaaattaatgatactttaatgtaccttcttgttatgcagtccggttctctgccttcatcgctgaaggtattgcccatcaacctttctgtttaatcagccaccatgtcatattacatctctgtgatacactcgtataaatcatatgaaatataaggaagaactgatttaattcatggactattttgtgtttatccctttgcttgatgttagcaatgataataaaaaattgactgtgctggtcagttcggtgcaaagttctaatatattcacatttggagtgttgcatttttatcttccatacttcttcattcactcactccttataaataaaatatctctcatagttggtaagtttatactgttagtaaaattacaccagagagacttttcttcttttttttaacagcaattctttgcacaacctatgcacttaaattgaaaatatatgttgatcattgagcttgacaagaatagtgcatttcctgttacaattttttattgttattgctactcatctgcttgtagacgaactgctaactcagaaggtgctatgcccttcaggtgttttggagtaaggccaagccagagagaagcctttcagaagttttttacttaactgatagatggctcactatgaagataacagattttatgaagctcagtaaatataaacaatttaatatgagtgagcaaattatgtgaaatgctaaacacttcacacataggtcttaaaatcatcagtgaaatatacattattagacaaaaccatccaaggcacttaaaagatttgatggattttttatactctgattatctgggctgagttagtgcttattaaaaaaggattaatctgcattcatatttgagaaacagcttatcgggaaagggaatgaggcttgcctgcaacagtaaagtttctatttggagtaggaaaatgtgacctactaaagataggcactctgaaagcttcctcactcaaaatgtcaatttgccacagttatgttttctcctcctctaccccagttgtagcaggcatgagattaggattcatcctgtgaggtaatattagagttactttttgtatgttataatcttgcgaaatctctttaccttatatttgtgtaaaaattgcaagaaattcaaaatatttcatgcaattcaaaaacattttaaattgtggtgtctgcagaactttttggaaaccttagccctattcagttagtgtaagctaaaatattctgtatgtaactccttgaaagttcttaattttagatgctaacagagacttttgattgagagtcacagttattccatatgtatctctaataagcacaaagttactactctgtgattatcaaaattgtgacaagagcaagattgtctgaccaccccaacccttcttacagcttcaaggcaaacacttatttgaaatgagaactacctcaaaatagctttcaatttgctctggaatttgatttgtatgttcatctctctgcacacagacacacaaaatgctgatcaaaacaccagatatgatttccattttaggagttctaattgttcatagttatttgtagtctgccctaaatctcatgatctaatagaagttagttacttttgatctacttttcaaaatagaacaaatctaaaagttttgaagcataaagtaaaaaatgaaacttgaaaaagtgttccctgtttttcccttgctttaaaaacacaactaaataacccattaagataagggtttttaaaaaaattctgacagaaacaatacaaaatggaaatttagattgtgtactaaattgtatgtgaacctttttaaggtcatcaaatatttacataatgtgtgaagttttgcctttgtatacttaatatgcagagatacagagataagtgtctttatagaatattttgacaccctattagcagtctagaatcatttgaaaaacatattttaatgatgacgggaacagaaacagaaaatagattgtcccaaatgcttaataagaaatatttttaaatttaaattattttgctcacagcatttaattttcaattgccagatatgggccatacatactatagtgttcatactctaacaagtttgcaaattaactttaatgcattatgtgtgtatatatatataaatatataattttttcttttgagagagagtctcactctgtagcccagactggagtgcagtggcacgatcttggctcactgcaacctccaccctccaagttcaagcaattctcctacctcagcctcccgaatagctgggattacaggcacttgccactgcgcccggctaatttttgtatttttagtagagacggggtttcaccgtcttggccaggctggtcttgaactcctgacctcgtgatccaccccctccttggcctcccaaagtgctgggattacaggcgtgagccaccatgcccggcctcatgatatattttttatagggttttcagtgttctattataatactttaaactttacatgtcatgaagaatttgccactggttcatgtattaaagttaagggccactcaatgtttgtacctctgtgtctgttgtcctccttttctctaatattatttattgctctggcagtaacagaaagtttgaatgggacaaaagagcatctaaattagggaaaactacttagcttctcacatatctcttgaacagcacattttgaggtgtaacccatgagcatctgcttatttgcatattcacaatgatattcacaccattatcttaactctcttttaacagactaaaacaatcacttgatagtccattaaaaaaaaaaaaaacacaaactagaaagtcacatcagatggaaagctaattagctatactgttttcacattgcatgtgtactaatcaggcatttatttaatatctccagtgctcaattttttgcattaattatttcagattaattcttttttgttaaaagcagttattaaacgggcacaatgtgggacagatgcactgctgattcctgatttcccgcatttcagtgagccttttcatcttctctgagcatgtgcctatagccagtgttgagcagatgcaaaggttatgtcaggattgttttgcaatgcatttgagatattacacataaaattgataaggcagtatatttcaggtaccaataagaagttcctaaaagccctgatatgctttactgtctcatgaagacccttggagtttagagtcatattacctgattatgatagcatgagagataatattagtagataaccttaaaggagggacttcatttggaaatgtgtaaaatttaaagagcgatcatcatatttgatagcccaaacttgagaacagaggagttatggagagttattcaaagtaagaagtattcactatgtgtatatatattaagtggcaatatatcctctatttacttacagtatgaatcaactaattaaatttcatttattttcacctgtactcaccacaggaaaaaaaatcatagtaaatataatcaaccccttccaaagatagggtttattgggttcacagctgtgaaaatagtattttttttccttcatcccggtgattggtttagccaatccacattaattgtggtcagaattgcaggtttattgcacttttgcaagctgtacacttctaaacaccatgtttctttttaaaaataattttctagttaactaatttaatggcaaaatttgatccaaactaatgtgaagctacttgtagactttatcctactaatcatggatattcacattccactgcagaaaaactaaataactttgaatacagtttactgtctcagaacctctttgtaatatgcaaagtatattacttttctcaattctgaatcattctggagtccagatccatttggctgcaaaggtttgggtaatggatgatggacctgaactgataataacattctttggccagtccttaaaatccactttcatgttgttaggtttgtaggcttgaaactatcggctggagagagtggcttcactggctgtggctctggtggatgcttattggtgttgctaataagttccatagttacatggaggattcaacttttctgatcactacatacaattaggaatatattcagtatcaattatttgaaaatttcattttcatgagcatgttattctctattaattatagttcacacctgttgtaattatcactgtttatgagggtcataaaaggatttgtgatggtgaaaaatctgtagtcaataagtatttgtttttcttgtttcattagaacgacgtaacatgttggaactttcctgtttcaatttatattatgagtgttttgtcttatgccttctaattaggacacctttgttttaaaattaaaaatcttgatttgataaattcacaataatgctacgttgatcttgcaataccactatatatactaattgtaacaggtttgacatttaaatacaaattagttctttaacttaaccatggatttggcttaaagaatttgaaaatgtcctattaaaattggagcaaatgatggctttgccttgggccaaaccactgcttgttactctctgtacaatgatgttaattatattttgttaaaattcccagaggcctcagctctaaactaagggccaatatgtagttgttattaattgtaattaatattgactacttgtgtgtgcatgtcttcctttttttcttttttcatagttacgtttcaaagaggagatggaggactaatgagcaatggaaggtatgctacggagattgtttcattattatttttatttttaatcaggactggggaaactctatagtaagagcctattattgtaataaatgatcacttaaaagtctgagaattctaggaggaattaaatggcttaccacaaagtttaatgatctatctgttgtgcactttagaggaatcaagtccagatgtttcataactcccagatgcccctgaagaaattagtagtaaatatcacatggaatgtgttcatttgttagcaggatgtttattgcattaattagacattagcaaatgaagttgctgttgtttaagactccttataggctctcactaaattgctgtgagtgaacaattacacataatcgatcacaaagtaaatgattcatggatgatgaataggctatagattgataggactggattccacaactttggatattcaattgaaattgataaaagctgataacaaactcatatatcctcatctattttccctttgccaatatggagattgtaattaggctctggtaataacttccaatctcccatttaatcaatattttagcaaaaagagattaagtctaatgagagtttgtggatgtagcaagaaagcggttgggtcttcttattgcagtttccatagaaacacatgtttctcttagggattgtaccagaaggggtctatcaaaagaaaagtgcaatgattatagatgttctatttctgtgtaaatatgctagtaatctggaaaggaatcagaatctcatcttttatattaaagaaggaagttctttactaaatatgacgtgaaggaaattttacttatagactatactcacatgctggatcagatcacagtgtatcttttattacctttaaaaaaaacccttaatatacccctgatattttgcaatttagaacttggaaatgtgctatttatggagcagtataaatactgttcattaatttcacttcagttccttgcctccaaatcaagcatgagggctcataacaagggttacagcctagagggaacagatacgtaaggtagctgcaggaattgaggaaggaatagcccaaagtcttagaaatggctgacatagagcagtcactttgagcagttgttcccttgtggtgccaatgtatcatcaaaccttgttttgggatcctagtatgttactgatttctaccagtttcagggcagacacctgaattcatctggacattgacaaaatcccgggcaaggactccctgcgtccactgttaatgtatgtatagccttaatgaattgctggagttctttaattccagggagtctacttatattaatttgaagtcaatgaaaatcttccatttcttaacgctttatattgcatgagacgagtgtcaaaatcttgcattgagctccatgtgttgatttccttgtaatttctgttttagccgtccaggtcttctcaatgctggtgatcccagctatccatggcttgctgattcttggccagccacgagcttgccagtaaataatagcaacagtggcccaaatgagattggaaattttggccgtggaggtaagttgtgttttttaaaatagtgttatttgagttctctctctctttttttttttttgaccttcctggatttttttaaagaaacatatcagagagtatttactcccataattaaaatcaatgaaacatatgcactaacagtgttgtacatttgctaaatattttaatataaaacgattgtatcttcattaccttgagtaaaaccaaacttttaaggaagctattactaaccaagatgataaatatttataatatatatgctttcaggattactagtacaagattactgaactcagagactattttgttaactagggcttatggttttggactagaggtttcccttctccatctcatttaacatgtatttattgagcatctcctgtgtacttggcactatggaagaccataagaatataataatgatataaaaaagatggttcttgccctcatataatatgtcatgtaagaaatagacaattaagtcaatataacatgttgagagagaacttttctgtagttccacaactagtaactgttatccaaaaataaataaataaataaataaataaataaaaaagacaaaaaagtgctaagtagccacatgcaagccttcaaaatttggtgccagagtcctctccctgtgggtttgtaaggagacacaagtaacctactgtaaataactaccacctcccctgacttcaccttttcatccagtcaataggagagagctgggtttagagaatgatgagaggagtagggaactctctgatctcagtgtggcttggcaggttcatgtgagttttccgttggtggaagattgtacagacattaaatgtgcttaaactgccttgccagaaccccatgtggcatgtctaccaattgggagtaagaaagctctatgaacagaatattatttaagttgatacctgaagcaaatttaaaaatgagtcaaaagtatggaaaaaaaaaagtgtttagaaaagaagttgctgtattttaagttccacaaataaaagagacattgacctacttgagaaatggaggaatttcctaatgacttgagtataaaatacgaggaagcagaaatggtaagaaatatagaaggatagataacaaaggaccttttaagccacatagagaatttagacttcgttcagagggtaatcagaagctgttgatggatttttaagaggagaatgctgggatccaagtactccaagtactgttttaagtcatccagcctgctgctggatgaagaatggagtaacggtagaaaattggagtgattaattagaatagtgctgtaatccaagcaaagctgtatgaattctctgtaagatttctgcacttttagaattaatgaaggaggcccagggctctgttaaatttttctgagtccactataagccttgatgggttaatttcatatgtatgagtatataaccagattgactgagaactgagaaggatattcatagcatgttctctttaagaatggattaccactatgtttgactatatttgaagttgtatttcaaataatgaagctactgattattgcataagtctgcattctgtcagtaccaactatgagaaggggaactcccttcccttctgcaaataaaatacagaaaataaccattcctacttcataggtgtgtaatgaggattaaatagatgaatatatatatatatttatttatatagaatatatatatttatttatatagtgtgtatatatatatatatacgcacacacatatatatatatgtgtatatatatatatatcccaaagcttggcataccatcaatcatcaggcatcagtgcagtgagtgagagaatggaaagtaagttatatgactcctcagcttcctcttccgcttctgcaagccaacacaccccacttaggactctcacttgcccagatactctggtagtggcttcctcccctaagtgacccgactgtgagcaactgtcagctatcactttgccatgggtagtttctgtgcctgagcacctgctcatcaggaaacaagaatgtccctccccctgctatgtcgactgattttgtcaaaaggaattctgttcccacagcttttgtcaatgaaggaatagctgactcttttacctcttgtatttttattgaaataatatgacatgctattgttacatgaaaaagtgaatgcttacagatggagaaaatgaatattcagtttccacaggctaccttaacgtctaaaatatctcagtcaaatttaacaaaagggtacacctggagatttgcaaggtttttcttccattttcccttaattttcatgatgtgaaatatctcatagatgaacagcaaggccaagacaacgtttttgtagagttgactgtatcccttatccatgtgatagtcattttaagcatttactatgtgccagaaatactgttaaaattttttgtatattttaattcattttgcttgcatagtaatatatgaaatagtcatatttccattttaaggatcaagaaactaagttttctcaagataaataatttgagatctggttgtagaaaactctgctttgtattgtaaaggcagattcacatgtatgactatataaccatattcacttggaagaataagaatggatactgacattttcccacaccacatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacaccaacatggcacatgtatacatatgtaactaacctgcacgttgtgcccatgtaccctaaaacttagagtataataaaaaaataaataaaaaataaataaaatttggcaaaaaaaagaatgaaatgacaatacgtttgaatgtaataaaaatagtacttagaataataaagttactaattatagcataaatccatattttatcaaaggaaaccataaaaaaaattatttaaccattcaagtcagcaagtgcttactctcttcaaaacactgggtgagcaactatgaaaatgcagacataaatcccatatgctcctgtcttcaaatgacttcgtgatacagtgaaggagacagtcatttgtacagataattatataaaacaaaaggaaataaatgtgagtacaagtataaccaaggtgctgaaaaactacagaatgaattaccaattccaagtagaggaagcatttccataactcataggtttcaaacataagtgttaacaagcaccagtcagacagcctaaaacattaaggactggtaggtggggactgctataaatggaaatggaaaaaagacctgctaaatatgacatcacctatttaggtctagcctgttgggaggaaggctagcccagagttccaaatcatctggtattataggactctccttaacatccaaatattcatgtgcaatattccaatatttcgatgctagaatacaattcagtttattttttgaaaatgtagggatgatcaaatcatatttgaagacaatatgcagcctaaaaatcaatacagaagcacttagacttaaaggctgactataattttatctagcagggagaggagagattcaatttccagagccatagcattagttgtatagcaatattatgtaggattagattcttggaccacttttcttcattgtttaacatttgagcacacagccatttgaaaagcttgccatcgaagtggcttgcaatccacatctaaagctttggagaactttaaattcaaggtgtgtgaaattggagctcaagttggggaatcaagtatattcacttaatattcatcagtgaaggacatggtagaagcggcagaaacaaaagtctgaaaaatcacccagaatgaaggatctattgtgaccaatttggatatactacatattaaaagtttttgagaaataaaaataatactaacacttgagaatgcagtatgcttaacatcaaattttgtaattaggacatagctcaaagaaagaagggcaagaaagtagttgtgaagttctgaaatttaaaaataatgttatttgcttatacaacctggtgaaatatgataagttaaaatatgtttaacaacttcactgatacacatttaagatatttacttcaatatcttaagtacatatccgctcagctgtaaaacaagctccaaacttcaaaaccttcataaagacttaagttatgcagtgtacaaaatatagtatacatttctttctacacttgctaaagaagacaatttttagcttatgtaaaattcaaaagcaaaagtaatatttctataagaatttttatttcaggtactattgagtatcagctaatctaaaagttttaagatagttgaaaatgtcctataatgaaagaatgcagtgatttgatggcctcaagtcccatgaaatgaagctttcagaagatagcttattttaaaatgtactatataataattagattcattttaacgctacaggattaaaaacagtgttatttagtgatttctattttagattcacttagtatctttcttccaaaaagggaaaataagagctcaggagagaggcagcagttctgaattataaagcatcatgtaaaaataattcagcataccaaaatgaaaaatggactgattgatattcagtgttgctcctggagtttaattttactctagctgtattacaacatgaaactgtaattctctagttcggagttgatagcataaattaaactcaccgatcactgagattgctttttctatagttaaattctgctatattgtgaaaatggcttacacctgaaaattttcctttgttatacaagaaaaaaaatgcactctccttttctggagcaattaaatcacacaataagtggcaagttatagcttcaaaaaatatacttcatagtcggtatagtataatttttgaaatgttagcatgtatttagcagttgtagtccatgtctcttgggataaagtggaaagagatgtttttcatctgtgagttgtggattcagtatcattgcaactgtaaagtgctaacactttcattggctctaaaacagagtgaacaactgaaagcatttttctgtagtgaagtatgccaaccgtctcattcatggttaaagaaaatagggggaagggtgttttaagcagtgagacgtgaagggcgagcagtaggcctgcctgtcactgaggctgatagcttggcgatggttgtatatcatctacccttcagtggctcatgaagcccatctcagctgaaatgcaaacgtgcagtgtgacacacttatttttcatcttcagtcctgatagttttgggcttccggtgcctcattaaattgtttcatttccctatgttcaccacagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgagtcaggttcttgtgtcctgaggaggtattttcatatcatttgtgcatgagatagaaattagtatttgttgtttgacttagtgattcattaccaggtttactacctaaactaaaaaaagataccagcatgtttccagtaacttgagtaattcctaccaccaccaccgccaccaccaccaccaccaccaccaccaccgccgccgccaccaccacctcctccaccaccaccacacaccagtgccaatcggtttcatcttttagctctttttcaacctaatgatcaacaatccatctctacttccattagggcagggtagacaaaacattcctccactctcccacaacatctgcttctgagttgctaactgcatgttctgcatgggcttgtgctgtgaactaatcacatgatgccactatgacctctgccctttaacccttagccttactttacattcctgactaccgattggctgagggattgtctaatagaatgccacacaaccagtctcaggatttcagcaccaccagctctcacaacagctcagaaaggagtggcagtctctcaggttggtctcatcacagtaaggagaaatatttgtttgtcaccagcgtatgacctgtgttcctaacaaccatgaagatatactgaatcacagctcactgtcaggcatttatctgtcaaatgacaacagtttatgctaatgaaatcatgccttggtgggataaaagggaagagaaaaatcactgtccccttttatatactaactctatgaggaaatatttaaagaaaaattatgccattctactaaatactattcattaaagaacgagtaaagagaattttataataaaaagatcatacatgaaagtcaattccatgttatagataccaaaagatgaattcaactaaaatgaaaatgattttggagtagttcataatattagtatatcattgatgtgacctcctatttttggacaagatttcgaaataccatataataggattttttatctattgaatgatattctactgcactatacaagaaagttaatatgggaaattaatatttaatttccaaaaaaccatataatctttgatattgctaattcttttatggtataaattttaatatgtatttgagatatatcagctaaactgacaatctataatgtcagtatcatatagcacaaatggaaagaaacaccctttactggacaaaaatatatacctattgtaatgacttatgaatgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtaacattttctaaattacttttcctcaggagatggaaccctttcagtctgaaaatgttaatgctccctcttcccttcaaaatgggtcatttgctcttcttgcctattggtagaattagctatattatagaatccagaaaattttaaacatctgttatgaatttaaacaggtttaataatataggagaactttttgaataaccttatatgtcatttagactgccatttatttataataagtctcacaattgttctgaataattaaaaagtaatttatcctgggcttcctttttatttcattaaagatatgcaaagtcacatgcagtatgtaaaaataaatctatatactataatccatggattacttaagacttttaaaaatctttctttaagtattctatatgtgttgattgccaccaccaagttttaaaagttgtcttttgagtaactgtaagcagaacacaattcacaatagtacttagtgcttttttgaatccattaatctcctgagtgacatttatatatatctatgaattatattaactacttcatctacatttgaatacaaaattacttaaattgatgatagaaagcattctttagtaggtgagagtgattattctctttttagtttagttcaattgagtttaatattagagttttgtcttatgcttataatcataggtatctttcctaagacttaaatttaagatcaaaccaccttgtggataactaatcatatggtattataagattttcttaatttgtggatagcaatgtaagcaatttaaaataatcacagtgataaaagtggacatttcagaattatttgagtgtattaccctctttgaaacacttaatatttattcaatatataagttctgagcacttccattaaaaatctaaccattaaaaatataaaatcaccagcctgagcaacatggtgaaaccccatctctgaaaaaaatacaaaaattagccaagcatggtggcactcgactgtattcccagctacttgagagtctggggtagaaggatgcttgagcctgagaagttgagcctgcagtggatgtgatcgcaccactgcactccagcctgggtgacagactgagaccctgtctcaaggaaaaaaaaaaagtatatatatagtatatatatacatatatattaatatacacacaaattaaagagtttatatatgtaagtcattaaaatatgctcccttaaaagataatataagaaattctcaccttaaagtgattgaaggttctttgtttgcaagtaacagcaacagactgtggcttacttcactcaaggttcagatctcagagaatgtaagtggctttggttctatgtatgctctccaccatgctatgaacctaccattgctcactgctaaaagaagtcaggtgtgttgatttgtaatcctacacgtactgcccataatgagagagcagaaatttcctcaaaagaagagaaagtgattgttggatagaaagccctcacatatttcttctatgaatcacccgtttcccaaatagatttttaaatctgtttggaagagtaggtaatgaatggctttcttgaactttggacaatgacttcaacagaattcagggctctggaagtagtaatttccagtaaagaaagctgctacattctgaattctgatttttctcttactgggtgaatgtggaccacgtaacactcagaatgaacctcagttgcttcatctataaaatggagatgcaagaacttgtctatttctgttactcagttctggtggtgaccacctaacatttctaaaagtaccatggaaaacgaaaagcactctctctatatataaataaataaggaataaaggaggtgaaactagagagaaagctatggaagacaagtagctcagtctgttccccttttaatcattgaaaccgagttctgatactacaacagaagaaatggttcctgtctgataattttgctgactcatcaggaaacaaaggattaaggttcatctaccttaaagacaaacattacagatgtatattcaagcaagtttattgttattctgagtcaggctgtttgtgggatactcatagggcctggagaagttgggagtaaagaaagctttagaaatcaagaggagctgggtttgctctaagatagaggatatgggggaaaaaaaagaacacaaatgagtggcatttattgaatgttctgtccattctgagtagttgatatgcattgtctcttgtaattctcaaaataactgaaaaaagtagtaactttatatctgttttacatgtgcaaaaatgtaggcagtaactattgagtaacttatccagtaagtgggaaactggtctgtaaacccagatacgaaactcttgtcctctaagcaaaagatgtctgctctccttcctcttaaaatcttttattctaccaaacaagtatactacaaggcaagatgaaagcaatttgtgtgcagggatgttctttgaaatatgtgtgaaggtgtgcatgctatgtggaaaacacacactattttataactggcaataaagtatatatccagtttaacagttttatcacttcctggtgctcaaatatgttcctattaaattacataatattcaacgtggctgatgcagatgagtaattggtagaagtaaggggaatagtaggcttctagtgatattataatacattgctaaatagccctgctacaaatagtttttgctcacaacttgcggttccagaaagatgaagtcgaaagaatcagtaagatttttggcagatattgctgtaggctgtggtgggagccacagaagttatatagtgtcccctgaaatgtcctttgttattctgctccaagaagtactcattcctcatttaactgtagtccacttttaaggaagaagctttatctacttaattttggaagagtaaaaaccatggcactgtccaaatgataaattgtattttttatatttcattaagctccatgtaatcctagatatggctcatatgctgctagcttactttcttctcatattttgtgcatgaattcatttgtattagaatgccactgaaactgattactgtattaatttttcctcctttttggaatattatatgatgttatgcttaaaatagctaagaactattcacatatgcaaaaataattgtgccattcattagttaaaaagtctataaaacgtatcttcgcaaaatatttacaggtattttcctgattgtagctgattgatttttatcagttacttttgggataaaaattgttacccttcctggattaattaaattgaataaattctaatggaaaagtttagcctatatccttagaccttgcattttccactgagagagattatgcaaaagagcattataagtgtactaaaatttgacatttaaaagaatttgttatggcccattatttcctctaacaatgaaaacatgaaggcaccagacgggaataaatcaataagcatgcttttgatacagcagccatgtttttggttcattcagctctgctgttaatgcactggggaaaaaaaaacagtatcattttgagtgatttataaaaatgtttttctgattatatcatttcattgtttatagcttttaacaactccaacatactgattctggtgttttgaaacataaatacaccttgccatctgatgtattctctttattctgctatttggcatctctgaataaatacgttattactttcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgggtaaagatattttatatactagcaaaatggccagggctctcctctcctctctgttgttcatttttgccatcatcttatgttctctcactgtttcctttgccccccaccaccatgttcattgcatttccccctctttcattgtttgcactgtctatatatttttagctgataaatacaaaacagcacatattgaggactgagaatccttggccttcaagtgccttagattgtctgcaatcatgataatgcagcctccatttataatattgcttgttagtttgaaagcaagtacccacagctctgtgaactaaagagccactcctgagaagggctgaaaagggaattaaaataaccttcttcatcatcccttgcagttctctaatgacttgatgtctggccatagcagggcgccactgtagagcaccatcacaatgggataattgtagggacctggccagtgggtagaactttaatcatcagctctgatgggaatttaggggccagaacaataatagagccaatgcatactctgtaatgaaacctttttaagatacaaaattttcttcgagggtctttaaatgggaccagtttccttattctttcccaaatgtctcacaagagttagttttcctctgttactttaagctttaattgattttaaatacaaagacactgatattttttatcctctaattccaagaaaaacaaaaattggtcaaaaaatcatactgtttccttttctagtttaataattctgaatgctttgtcttccttataattcccaggtcactatttattttgactgggcctttatgtaagctaaaaatacagaaaaaaagcagtttttcttttcacaggattttttttcacttagaaatagttagatattaaaataaatctatttatttctataatggttgtttatttattatcttggcttaaaaaatcacatatacatgtttataaatttcttcttcatcctcttttctttgtacataactcctgtctttgaagtcttcagattaatttttctaactagaattttctatgtcataacattggcttcctttaatgatatcatttgcctttttttataaaataaaatatatatacatatatgctctatatatgcattatatatgtatacacacatacgcgaatattttttgtctatgtcttcctttccctccaaaagccttcatttgtctctctgagactgtagcacttattatatatgcatatattgttattttacttcttttaagttcacatttgaaatgggaaactaaaagtatatcctgtgtcctccttctctaacataaaaaataaaattctgtatatgatcttaatttatattaatgttataaatgtgtcagtgtcacataaatcatgagcaaagaaaaaccaaagatgtgtattccacaagagattaatacagagcttagaaacctgcattttaaaagctatagtcagagactacagacatggggacttgtaaaacaggaagagaaagtagtgctgttaaagctttatatgcataaagtcttgaactcatatcacatgaaaactgtggataatttggagggttttttttcccattgagtctactaaaatatacatagactatgataattcctgtaaccccctgcaataaaaccaattaaatcaaaatcaatgctaaacttctcactttattttattatcttgcagtagaattgaaaatattcatgaaatagtagatggtgcaaatttttattatttaacacaaattattttcagtataattaagatataaaacacaaaattgtttctacatatttggaaactttatatatacatatatatatatatatatatttatatgtatgtatgtagtttgagttaccttcaagtttttgtttgtcttaaatacctagtatttgctaaaaaaagaagttatcattcttactaaaaatagtggttagatcttagccagtcagtaatattgacaacaaaattcaatttccttatttttttgagctcagtttttaaaaggctaacacttgaaaattattattttaattatttgtaataaaaacatatttaaagttaatataaaaacaaataaaaattaatagattgggcatgattttgtccattttttgatattctttatacttttatattttctaatcggtaaaccatatgatactgaaaaagaaagattattgaacacagtagagtattctactattcataatattaagtaagtcaaaaaagaaatcttcagaattgatcttctagaaaatttttctataatttagaaccttcataattcaggtttaagcttttcttggcatacaaaatataaaaacttcagatacttttttgctctccatacttattagagaccagacactaacattatcctgttcctgacacacacacatgcacacacacaaacacacacaattttgtatgataagccctagctgagcaatgtggaagaactaataatctccccacagaaaggggcaatcatatataccagggaagccaggggaaagcttgtagaagttaagttttgaggtgaatctagaatcatttactcacaaataatagaaaaacatttggtggctgttggatgccaggcactgagccaaaaataaggacaaagatagcaagaaaacgtctctgtccaaaagtggtctagcattagaatagattgttagtcaacaactataacaaaattttactattgttgtgattttctgtgcaaatggagacaaatttccctggccaaagaccaaaaaaaaaaaaaaaaaaaaaaaaaagaaaataaatataatacaatgaaagacgagaaaacaggaaatagcagatagtcccattagtcttcctttggaaaccccaccctcttttctttaaggttatctgccttaactaaactgttgttttggttattcctaaagcttgctcctctattgtagtactcctcatattgcacttaactgcttgtctgtgccctttatcaatttgtacctgatgtatgaggcttgttgagtttgaaaactgcatagggtggctgggcgcggtggctcacacctgtaatctcagcactttgggaggccaaggtgggcggatcacgaggtcaagagatcgagaccatcctggctaacacggtgaaaccccgtctctactaaaaatacaaaaaattagctgggcgaggtggcggccgcctgtagtcccagctacttgggaggctgaggcaggagaatggcgtgaacctgggaggcggaattcgcagtgagccgagattgggccactgcactccagcctgggcgacagagcgagactctgtctcaaaaaaaaaaaaaagaaaactgcatagggtaggagataatctaagaagacgttttgaagccaattgtgaagccttgtatgtcatattggagttctgatgtttgagtacagatgatggattggaggatgtgaggctgaggcaggtagataaagcatggaatattgcagcagaatggctagcagaatggctaatatcatgtaaatgataagggaataaaacaaagcaaggtcaatgggttggaggaaaggtaagtatttaggagatatacccagctaatggtaatcatcaccctgaaaatattgtctctagttttttgttacaatatttagtattatttctaaaagcttagctatcatcagttttcattctaagcctttccccacaatatcaaaataaatatcaaaatcaaataaaaagtatcagaatatcaaaagttatcaaacaattgcccaaagaagaaaagtatttgttaattcaggaatataacaatgatggcaatgttttctcctatcattattcttctctcagcttgacaaaaatatgtcaaaatgtattaatccctagctataaatacagtgcattttattatactcatatgattccaggaagaattctatggtaattaaattgaaaagtggggcttttctttgctactgcagttagagattggcaagcttctgccagtgttgaactttattgtatttttattagtaatttggtatttgtatctggcctttacaagttaattcacatgaaacattgatttgttgtcatctttatcattagttgccaggcaagacagataatatgatgcctcatagttcactgacaataagtcaaagaacaaaaccttctccaggaaaggttgaccaaaagatctttggtttggcattagcagcattttcacagtctttttcaatgttactacaagaaaaagttgaaattctgtcactcaaataagatgtatatctgtaaaatgtgaaggaaactataaaaacagggctacacttcataaaatttgtagagtcatctgttactttctcatccttcttcggtaactgcatgaaacctaagtatttgttgcttgcaatggattaagacgtgaacaccatagagataacagaccattcttctccttcatatgatatacaccatgccccaactttccttcatttattcttccaggttcttctagtcttttcttttatctcattttccatttttcctcttttggtacatggtaggtagatggatctgtggacatttttcagtttcgctatcccaaaggggtaaagaatttgctccttcttgttctaaattatcttcacacacacacacaaaatgacacagaaaaattggtgataactggctaggcgcggtagctcactcttgtaatcccagcacgttgggaggccaagatgggcagatcacgaggttaggagatcgtgaccatcctggctaacatggtgaaaccccgtctctactaaaaatgcaaaaaattagctgggcatggtgatgggtgcctgtagtcccagctaccagctactcgggaggctgaggcaggagaatggcgtgaacttgggaggtggagcttgcagtgagccgagatcgcgccactgcactccagcctgggtgacagagcgagactccgtctcaaaaaaaaagaaaaaaaatagaaaaattggtgataacattaattctagttaatgggaatagctaatgaaatatgttttagttaattaatgcattaagcaatgtatttgactaatgccaaatacaatatttatatggttaggctctccttggcctgacattatttgattaataaaaatgaattgagtacaccaaattataacttttcttatgttttcttagcacatgatgcatataacacatatttcttctaatatattctctatgaattttttttttttttaaatttcatgtgtatatccccattagattttcaaaagtaaggatatcttactacctatggagtttcagaaaaatcttaggaaataacagactatttccatttgaaaaattgaatatgtgaacattttcgttcttttttccaaggtatgatatccttggcaacgaacgagtgtaagtaaggaaagtccacccattactttttggcagaaaaaaggactcttttgtagtaagagttacaaagtaaatttaattatatctagttatgaagcagaacagcacatttcatattgaaaatagatagttctcttttgattagcctcctcttacgtatttctgtttaacttaataatgtggcttaagtcagataaataaattaggaaaaaagaacaaagcattctaattagtggaatgatatgtgtgttttcaaatcaaatcaatacatacgcgtatgacttactctttttaaggtgttatattagatgtaacaaaacaagaacagttcaatgtcataactataatgcacttgaggaaaaggtattataaacatgtgaaaagttaaatactaaaataaattagtcaagagttacagaaaccagcactggaaatgacataagactgcatataatcaattttcaaagaaatgtacatcaaggaaaccttcatacaagatatgggatttagcctgcatcttgatggatttataagattaagataggtaaaactggaggagtacagcttattggaaataagttggttcttataaataaatgcaccaggatgggaagaaagtacaaagaaagatgaaaacaaattaatttatttgagcaggagattcttgttgtaaaaactgtctgaaaaggtagattgcggcttagacatattcaatggatggaataaagagaagtaaatcttcttattcagaccattctgatattttcatagatgaatttgtaagtggtgggcaggattggttagaggatgcgaaaaactgaaagcagaaaatcccaccaggacagtgagttacaatattttaaagcaataggatcttttttccacatgaaatttaattgtgatctccaacatataaaacagataaaaatggcatcaattttttagagcaatatgttctttaaattcagattagcactcattatatagtcaattaaatgggaatacagtttaaatgatggtattttctagtataaaaattgctatttgtaacacactagtgtgtgtctgttgtttataatgtctaatattatagtagatatttaggaggaaatattcctatcaaaccatacagggcttctgaaacagggtcttgcaactcacttaggtagcctcagcaagagaataaaatggccatggaaatgaaaataaaggagttacaattataactaactttgaaggaagaatctttggaattcgggaaaaagcatttaggggtctaaggaaattgaacatccaaagatgatattattcccccaaaaaaccaaccaaccaaccaaccaaccaaccaaccaaacaaacaaacaaacaaaaaccctttctgtaactatctctcacccacaggaaaatttcaaactccttgtaggggctgataaggccttcagtgaccagcctatccctaactctcttgcctcttccgtggccaattttcttctttctttgccagctcttggcatttagggaagtatttgaactcttcaaattcctttctcttcctccgggcttccacacgtgttgtttaaaatgttccttttactggtggtcaacatagccctgcccaactccaaaactagtttagacctcctgctttctacttttatggcatcttgcatcactgattatttgtttaatatcagctttccccactgaattgtatgctctgtgaaatagattcaggaccctgacacataactgtccaaaaaaataaattaagagtttttttttaaataaagtttatttttacatctgttttaggcttacagcaaaattgagcagaaggtacagatttatcccagcccccacatattgatagcctccccaactatcaaggttctccaccagagtggtacatttgttacaattgatgcgcctacactgacacatcatcatcacctagagtccatagtttacattagggttctctctgtgttgcacagtctatggatttggacaaatgtaatacatgtatccaccattattttataatacagagtggtttcactgtcctaaaattcctctgtgctctgcctgtccatggtttcctctcatctagcctctggaaactactcatctttttcctgtctccgtagcgttgacttttccagggtgtcaagtagttggaatcttattgtgtgtaccttttttagacctttcacttggtgatatgcgttcaagtttctgccatgtctttttatggcttgacagctcatttctttttagcaacgaataatattccattgcatggatgtaatgcagtttatttatccatctacctactgggagacatgttggttgcttccaaattttggcaagtatgaataacaccaataaaaatatacacgttcaagttttatgataaattcagcttttaaacaaaataaatggaaaggcattcaagtgaaaatattcaagaatcatccggacatttataagttactctttgtaagagagatcaagactagagatgtacatttctgatatttactcatatcacagtttccctaatgaatatctcccatgtaccagaaactgtatgaggtgcaagaagtagataagaatgacagctttcttgaatttaagaatctcacaaaatagtgggagaaaagaaacacagaaacaaataatctcaatataatatgaggagtaccacaatataagtattatggaattgcaattaattccatttggagtggggaagagaagacttcacaaaactgatgacgtttgaagtgactggttgaaggaagagtaggcagttacaagcaagtgatttgagaacagtcataaacagatgcagactttagagaaaaatatagtatatggatgttgaggaaatagtgcgagattaagctggaaagatgagtttatcagactaggatgggttttttagacctagctaatgagttggaaaggtttttttttaatactagttataatcactgaataattttaggcttaagcgtgatgtgaatgaagattttagagatataattctgttgcacgtgtttaacaaagggtggaagagaagatgatgataccggaagagtaggaaagctaatgagcttgtttacagcaggaaagtgatgtgtgattgtgggagtgggggtgaagtttggagaaagattcactaggtatttaagaggctgaatgtataagaccactatatccaataatattatttatcttttccttgtctgtgtttaaaaggatgttataatccatttgatttatgaaagtattcagactacagagaattgaaataaaaaagctattgattttgtctcatggttaaaactttttggattaattttctatattcacagaccacagtccctaaaaaaatatggttttaaaataattgtcatattttatactcaaaattttttaaaaggatagatctcgtgttaaagttttttactacaataaaagtattatttttattttatagggcaaggttttgaactcctgttttgtgatttgcatttggatgacaagataaagaggacattagtttctactgagaaaattaagagaatcaaagagatactgaatgcatttatatgatagtcttaatgacatatggaatgaaaggttgtcagatatctagaacaagaacaagtaaaattctccaatacttcttagataatcaatcagcgatattggcatgtaatggtgcacaagtatgaacaggagaaggaagcagttaaatctacaagcactaaattcattaattgtctttaattagcaatttggtttttccacatgagtaagtttgttgggaagttattgcctcttgtaactgtggggtaacaattagctaaaaaggtcttttaagaataaattgagatattgagataacagatgtaattacaattagaaattaagataacagccaggtgatttactgtggtgacaccaacagcttcaggaagaaataaaccgagagaacatttcagataccatgtggttgctacttattgccagtataattgtgtgcatgtatgtgtatatgtatttgtgtcaatgtgcatatttttctcatttaatttcagctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaagtgcctgtgattaattctgtatgtggttgtcaatatgtaaatgtgagcttctgcaaatcacatatggtcagtattagttattaaaagactctctttacctgagttaagtgcaacagaaaaaaaaagacaatactagtatcagtaagtgcataaaaagcaggagtaaatcaaaaatttcacatttctttttctaatctataaacttttgtaaactacaggtgtcagtttacctaggtatcctgtggaattaacacagatatataaatgggactaacgctaacagttttatacaggatttttgttattcaatctttctattttaattttcaaaagcccaggcttttatatcactattttaaagctccatgtcatactccaattttcttctgttgatttaccctttgtgcttgaagtctgagtaaattttttaaatagtatttgttttgttttttaaattgttctagtcatggggataaataattcttattctcattattaatgaagtatgtattattaaaatacagctaactatacatagaaagagataccaaaaggaagagtattacttaaagattattacaaacagcctcttttcttaagatattcttgaacattttccaacagtcatcagatgctttctcaaaggtcaaagacaacttaccgttaaacgctgttatttttcatcaatctgcttttaataaaacatcactatgtaagttgaagccagctgcttcaagagccacagggcttccttcacgttaactaatgaagcaatgcagtttggtcatctaaagcacagactcaagctgaagggttctcaaatttgccacattttagaaccatttggataaccttaaaatatattggtacctgggctccactcccagagaaagattctgactgccatgatctggaatttgatccagatcatgggacagccaaggttgggaccactgccgtggagatgaacctgtcttactagctgcatgactttgggcaacttgctcaacatttatatgctatagtttccccatgtgtaaaatgatggtgatgataatagtaattagctcatataggaaattagagggcagtccccaagacaacctatatttctgataccaagtacaagtttcaagggtccccaagaccaccctgaagtttcagaattctctatagtaagtcatagaactcaccaaaagattttacactcaaagctacagtctattacagtgaaaagatacgcattaaaatcagccaaaagaagaaatgcatgggacaaggtccaggaaaattccaaaagtagagcttccagttgtcctctcagtggaatcatagcgttactttcccaacaaagggtgtgacattacacaccatggagaattgccagccagggatgggcacaccttccttgaggtcctgcgacttcattttggctctgtcacacagacattgttgactacccatatggctgacctcaatttccagcccctccagaggctgaggtgacaccatgcaactccaagcccccccataatcatattgcgatgctttttggagtagcctaaggcctctaggtaagcagagagacttttatccacaggacattctaagggcttacagattacctcccaggagtagagggcaaaggcctaacctctcttgggtcgaggttcaattctttgttacatatcctagtttttgtgagaatgaaatgagtatgaacttatatactactgtccctggctgtatattagctgttattagttagaaaggcctaggttttcacccctgagttgttcacttctgtcttcccacacttagaagagtgtcccacttagtaaatgcttgatagatatttggtaaaagaatgaacaaattagttcatctccacctgctgcaaatacccatagaggacaccctgtttcttcttctgagtgtgttcctactcaaccagcaatctttcagaatgccttggctgactccacatctgggagttatgagcttgcatgtgcttctggtttggaagtgactcaccatctgggtagcacatcaacatcataggactgtttaacaaataataattcccaggctccacctcccaggatctgtttctattgattcgtgaagtaaacagcacagtgcctgtcactagaagatatttataaatgttatgtgtcctcttcctgtatttcaatttacctcttaattttgcttaaataggagtacattttttattccatcaaggtatatttgttttatcaagaggtatcaattcataagcatattgatggcaacatttatagcaagatgtgctcatctatcctcaagcttttctgtactaatacttaggaaacttgctatttcttcctatttttcaactagcaggctgtgaggaatgctgaatactaacttggggcctgaactttctaatctgttaaagattgaagattgggatctgatgatattgaggtagcttccagaattagaaatttttttaacattgaaacatctagaatcctgttaacattgaggttggttacaagttcaagaagccagttgggagaggaatattaaacaaattcgggaagattaaaatattttccccaaatcatgcaaatgacaaagaaaagtaatctaatgtctttcattcaccagccaacaataaaaatgcatagtactttttaagatctcacctaaatagcacagccttttaaataccttttatatgaaggcaaagaaaatacttactatgttaaaacatgtagtacactcactttttaatgctggtaacaaataacaataaattcatttcatttagcattttatggtttagaagaaaatctgagtagactcaaagcaaatcaactggaccctactgcccagcttcacactttgttagctacctgatttgaaacaagtcacttaaatttgaccttcactttaataaattctaaagaaggttgggccaagcatgatagctcatgcctgtaatcccagcactttgggttgctgaggcaggacgcttgcttaagcccaggagtttcagaccaacctagacaacatagtgagaatcccactctacaaaacatttaaaaactaattgggcatggtgaagcacacctgtaatgccagctacttgggagaccaaggcaggaggatcgcttacgcctgggaagtcagggctgtagtgagccatgatcgcatcactgcactccatcctgggtggcagaacaagaccccttctctccaaaaaattaaataaataaataaataaataaatgagggttgataatgcatgatctatttatttcataaggttgagattagaattatttattcattgcaaaaggtttatttaacacactagtgttccaaacacagagaatccttagatgaattgtttatgcctttgaggagtttaagactttgttgggtgagacagatacataaatagctactagagcacaaattagttgtgcctaccctaaactgggttatagtgaaagtggaaatagccttccagccttgatgtgagagagatcgtgtggggaggaagccttctagggtgggaaatgtgttcagggttgggaggtaggggatattaggtcctcatgtgacatcttttcttcataagggccagcaggcagcatgggttacacagactgagtagaattttgacactaaactgagaacaaaagtataatatttttggagaaaaatattcactttaaatagttactcgtggcgaatattcctagtcccctctagataacttcttttcacaaaaatactgggcccgtatttttttttctccgtgtgttatcctataaataccaagtgaagagtttaatggtttatgttttccttgtttggtgaggctcgtattcgtagccattgtttctgctgaaagcattatgaactcctaaattagttaatggaaaggaagaagacagtatgagttactatagcatgcatttaattaaaattatgattttgttgcatgttaataagttgcttttcttttttaaatttcatttgaattctaggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggtaacggaaccaatttaataggaaaaactgacctattggtaacattaaaatgcatcaaaagtcaactacttccttattgtaagatttattccactccatctatttctgtaacattttaaatgtgttaatattaaatacaaaattcaaaaaggatttggaaatacttttgctttgctgcaaaaatgataagaaaattcatgaattttaaaaagctttaaagacatgaaagaaaactcaattatatctagggctttcatgagaagttcactctactaggaaaccaagtctattacattaaaaaccttgacttttagaaatgatcttttttatatatatcaggaataacatatgaagtgaatgcaatcttaaaatgcttcttgatatttcactctgtaaaatcattcactgatggaaagtaagcacgtctcctgaataagccactttaaggttgcacaaggtattatttttagaatgaagaaaatgtgtagtgagataaaccatatgtttatgcatttcacattgctgcatctagtaaatgcttctcttccaagaaatgcagttattttttctgtttatttctttggcttcctcttgccttgttcatcaaacgaaagagttgcattggtactcttctatgatgatcccaggactaaggtataacctattttcagggatttaaatgtaccaatttttttaaagaaaactttaaatcctaaaatggacacaatgaatttggagaaaactaaaaattcagtctttctattcaaatagatatacactgttggacacacaagaaaatgcctcttacatgactgtgtagaccgagctactacaaactgaagtctggtctctgcatttcactgggtcttctcagaagaccactcatatctgtatttaccgtgatgacatctttcatcctaggagatattttaccacaatcccgcttaattcatttttatgccaacagcttccaaactttcacagattttacacaatgtgttagagttctacaaacactgatgggaactggtttatgacaggataaagcagcatcagcgcctatgattttcctctgtattcctccctgaattactcaatgtgtgatgcatgagcccatttttcagtttttcttcttatccaggggctggtctgcttgccagcctaattaagatttaagagctgcagatacaccgctgtgatttgaaatccagatccaaccgaaggtgacagagcacaagttaaaatcttcaaatgcagagagctgacttattagtgcactattatgttaagcccctttgcctgaatttccagcataatctccttcagggtaaaattctgcatatttttgcatatttcactaatgatactgaactcttttccattaggaatgcagtaacaaattgcaataatgatgaaaaacagtcagctatagtctgtgtagttcttttattaaatattataatgtcaaagatgataaatacgtctataaatcaagagaatgccattttgcacttttacatgctcacctgtgacatgttaggctgcctgatgtgactgcagctcaagcagtctgtatttctcctgtagctagtgtaatgttcattccaaatgaagcttttattgctgagaaaaaaagtctggttttctccttgaattcactgcttaattactgccatatataaaaacctcagggtgtttaagtttgtattccatgatgagtttatcctatgaataatacatctctttagtaaaagaagttgtgttctacacaaaagtagccaaatacaaactcactttttttttcctttctcttccacaataactttgtggagaaggtgtgatcaaagatttaatttgctttctatggtatgtgagtaagtgcttataagtgtgtgtgtgagagagtatgtgttagatgtgtgagtgtattagaacgtgggtgtgggtgcttgtgtagggagtgagtacgtgtataaatgtgtgagagtgtagataaggttgtaagtgtgatatagtgtgtgtgcatgcatgcatgcagacatgtatgagaatagccctgaggtagatgtatatagagactgaatattagagaaatcagcatgccaatgaatgttgttctaacatgcttatgttttcctcagacacttaatgctagtttaatggcgctgaatgaggtggacaataaaacaggcattatttctatgagctttttatgtttttaacatggtaagtgcccatacagtggatgcggatcataccaccagttactttgggttctaaatatatttgtggtgtgaataaattagtcattacctccccctgaaatgctgttagttattttcactttcatgaaactaatgaccattttattaaagagatctaacagttacaggaggcagcatgggttacacagtccctgaaaccctgaaaccaatcagaatattgggttccagtccctgcaactctgaagccaatcagaatattagttcaataacaacactgggatgggctggtaagcctgtatgtaaaattatgcaggattttacttggatatattgcacttcacagctgccacattagggaatatatcagcagttatccagggacagagcccatttttttgtaaagaaataagcatgttaactacaattagttgtttttataacaactaatttgtgagggatctcttaaattttgaaatgatgttctatgagtggaaaaggctaaaaaaaagaagaaaatatcagcagttccatatcccataatctcagtactggataatatgtatatttgcaggtctgctgttaatatttctttcttcctacaacaaacacctatcgaatgcctattacttctaatcacttggctaaaaatttagattcagtaataataataataataggtaacacatatacaacctttacgaagtgcaagccatctttctttctttcttcttttttttttttgtcggagtctcactctatcgccaggctggagtgcagtggcacgatctcggctcactgcaacctatccctctcgggttcaagcgattctcgtgcctcagcctcctgagtaactgggactacagacgcccaccaccatgcccagctgatttttgtatttttagtagagacggggtttcaccatgttgaccaagagggtcttgatctcttgacctcgtgatccatctgcctcggcctcccaaagtgctgggattacaggcgtgagccactgcggccggcccatgcaaggcatctttctaagcagtagcctgtattttgtgtggtctcattagctaagaatggtttttcacatttttgaaagggttgtaggaaaacaagaaactaactaacaaacaaaaactaagaagaatgtatgacagagacagcaaagcctaaaatatttactatctgtcattttacagaaaaaagtttgctgatccctattataaagttttaatgtatattaattcatttgatcctcacaaccctattaatagtattattttcatttaatagattaaaaacagagggttttaaagcctttgtccaggttacccacctgataaatggaagaagaatgttcaaaatcaatcagtcttactctaaagacaaattatcatgatccctgctctggaaacacacaactttcttctaatctgaggaataggtatatttaagaggaaaataatatgctggtttgttgcttcatatgtggaactgagtgtgtgtgtatataaacacacatgaataaatatgtatacaagcacaacatataattttctctctcgaaacattagtcctttttccttatgcatttaatcaagatcaagatattaattttagatgtgacttttgtgattcatttttttcacattcagttctatgtttatttaaagtgacccatgctaacaaaattcaactgtatcagcactttttgcaatgaacctcattttaataattttcattgtaatctatgctcataatgcacacctatttgattgtaataaaatacaacatatttatttattgcagctcattgcactctgtttgggctagaaagtaaacataaaggcttgtttctgtcttcaggaataagcctgtaatttcttcctaaatgccaaaccgttgggtaacggggagggagagggctacaatacttctttctgtaatttccatggcaggagtcaatggtaattgtttcccaaatttcatgacaccaccaggaaaaaagaaacagaaggcagtaggagagagtgcagggggaaaatgccctcaacgtgtagcaaagattctaactgcctcagtgatcacaaaaaggaagactgagattgtgtgctgttcagtgaaacaagtaaaaagtttccttgactgctggaccccacatgaatatcacagctgaaaggaaatcatggctctatattttgtgttacgtttttggaggtttgttgtggaactcccacaacagatcagtatggaaacaatgaaacctggtggcctcaccatctgactcgaccacacagcttttagagcctcggccactaaaatatttgacctgaaactttgcttttctacaaaacttaaaggaaaataagtttagtattagggaaaagttcagggataatgctacagtaatcaaattaatttcttagactacttttacaggtttgatgcctttaaagaacaattaaatgtgtatttcaaaattgaacagataaaaaggggaagtgggatattacacgtgtaatttttatctgagtgaaacaaggtatcaagcatcgtatgtcctaatgaagatatttttaattgcttattttgctttccatatatattacacattccttttctttctttctttttttttctgagatgttgtctcgctctgtcacccaggttggtgtgcagtggcactatctctgttcactgcaacctccgcctcccagattcaagagattctcctgcctcagcctcctgagtagctgggattgcaggctcgggccaccacgctaagctatttttttttttgtatttttagtagatacggggtttcaccatgttggccaagctgttctcaaactcgtgacctcaggtgatctgcccattttagcctcccagagtgctgggattacagatgattacacatccctttctctctgaggcacgcaggtggaattgttgcacattcaatatgtttgagtgaaagaagaagttctgtagatttgacatgtttttctacgtgtaggcaaaggtcaatatttggattaatttgtctaaagacatttgtagctgcagcttttacttaataggtagacaaataacatttaataggaaaagttcatagattaaatattggttgaaaaaatggagaatggctagtttttgtatctcataaaaatggtaatgcaacaattagcagggtcatcttataaagcacagactttagcttaatggatctaaggataagcatttatcagcaaggaaagatttagcataaaatgacatgtaaatgaattgatgactgatcataaattaattttagtgctgaagatgtaatagagacacagcaagatgccactttatcatgatattttactgctcagtaacatctgagcaacaacttaatgtcctatgtgcagtactactttaacagcttgaatacatttgagatttttttttgccttttctgcaatttaaatcagggaaatttggaaagattgaaaatgtaaacacaaataaatttggctatctaacataaattcattgttcattaaatgtttaaatatgtattgattatgtttggggctgaaacatgtcaaattggtatggagtgcttattaatttgtaagaagcctctagccgaattggttttacctggtgttcattttaattttcgtgtttatacttatgtttgtgaaagaaaatcagttatcacaaaagtgacttacttttaaatttgtagattaatgtttttattttcattcattcattatcttttcttctctctctctctttttgtggggggggggtaattgtttacctaaatcttcagctcattgctcttgtttaaatctcaacatttttccttttttcagaaaggccactagacgtaaaatcagtagatgttcaatacattttagccattttacagaaggaattctaacatcttatatactatttgattcatggaatgtggccaaatgtcttttaaaaatatttaccataaatatgcccattccatacatcttaaccaaactgtagaggaagggatgtcgaaaatcccagacagagaggcagagagacaaagagaaggagagagaaaatttctttctatgttccttgccctccgttttgaaggcaaacacaactacactaacgtgagacacttccctctcttcagattgggtcatgagatttcctgttgcccaatatggccaagtatctgtggtcacatatctttaattctgaagtcatctatctagtctctttgctcttacaagaagtacaaaagaaagaatagctgacgttctttctgtatttaccaatactcacttgaagccctggcttccatgtgactctctcttcccagagggagacaaaaagcagcagggaaaacttcatgaataattgggagttttaaggacatacaaggagcattaaaggctgggagaaaggcagagcaaagacacaaaggctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatggtaggtttcttccctttactcttgtttcctcgctgaagagacgtgctccatgcaatcatttacttagattaatgtagtcatggtagattagccattgcttcattacataacaagacaaaaacctggcaatatggccttgtttaaataaaacaccatttttaaaaacaatctagaattatttctatattattaagcctcaagaaatacattccatgcaattttttgaggttgatttttttttttttgccattctggcatatttcataaatgctttttagtgagcatttaagagtagggaagaacataagctgcatgtgcacttatatgatcagaacttttatcatattaaattacaatatcttagctgctatttcacttttggaaaaaaagacttttgaaatgatttagtaattttttagtcacaaatttcagagccaaaatcaggctacagtagttgaagagtgtcttagtctgtctgggctgctataaaaaaatagagtcatgcattgtatgacaatgtttcagtcaatgacagactgcatataagacagtggtgccataaggatgtcatactgtatttatgttgtaccttttttgtttaaatatgcaaatatttaccattgtgttataactgcctataacattcggtacagaaacacgctgcacagatttttaccccagatcaatggtatgtagtcagctataccatctatgttcgtgtaaatatactacgtgacacttgcataacaacgaaatcacctaacaccacatttctcagaacttatctccatcattaagtgacatgtgactgtaccataagctggtagattccaaacaacataaattttctccacaaatctggactctgcaaagtccaagatcaaggcattggcagatttggtgtctggtgaggacccactttctggttcatagagggtgccttttcattgtatgatcacatagcggaagggacaaggttctctctggggtgtgttttatagggtgctcatcccttcatgaggactccaccctcatcatcgaatcacctgccaaaggccccacctcccaatatcatcacattggggattaggattttaacgttgaattttgggggtacacaaacatccagactctagaaaagggtcagcaaacttcttctattaaagtctagatagtaaatatctttggcttttgggacatagggtctctgtcacaactactcaacactgccattgttgtatgactgcagctataagaaaagtagaataggccaagcacggtggctcaggcctgtaatcccagcactgtaggaggctgaggcgggcagatcacagggtcagaagatcaaaaccatcctggtcaacatggtgaaaccccctctctactaaaagtacaaaaattagctgggcgtggttgcacgtgcctgtaatcccagctactgaggaggctgaggcaggagaattgcttgaaccagggagtcagaggttgcggtgagctgagatcacaccactgcactccagcctgggcaacagagcaagactccttcttaaaaaaaaaaagaaaaggaagaaggaaaataaaagtagaatgatggaaatgattgacttccaataaaacatcattcacaaaatgggcagtggctggatttggcccatgggccatagtttgctgatctagctcaatatttttatttatatatagcatccaacatttgaatacttgcttaaacactgttagtttcaggaaacacaatattactggaagatatccatgttcgataatgagtatttcattagctttacagaatatagtctatttcccgtatttttaatttaattcttataacttttaaagaatgaattaaaatatgtatcctgaagttatattctaaggatatgtaacacatatttaaagtgtgtagtacaatgtcagattgaaaggtgaatttctttttccttttcagcactgtaccctataagcacacaaacattatcctaacatagttcaattaaacaccaaaaggataaacttttaaaaactgcacattagaaccatctggaaagctcttaaaatataccctagatattcagatttaattattctggggtgaaacccagttacaggtaattttaaagctccacaagtgaatctaaagtataactaccttagagaagctatgacttagtccttagcacacttacacttatcattataggacagaatgaagcttagttgaaaaagaagaaaagcattggttttttattagtttggggaagggagtatccaatcctgcagccctatttgtgctttcttttgtcatcttgcaaaggtaagaggacttaaaaagccaaatatattgttctacatactttccggtttacttatctttcctgcttcctttgttttcaatagaatatgaaggttaagggtagaattgagatttttgagtctctataaatgtgtatcctgtggtgagtaaaaatggtcaccactgcctttctgccttatatgttcagaagattagctgagcatttaaaactattcgtagtgttcatctaattcttcgtaaataaaaaaggactactttcactgaattgctaggtataaatctagtaattgataattttgtatattttttctgttgtgaatattgtggagagagaaaaatgtctaggtatagaattttctgtggtttttcagaaatgtttgaagataatattcagaatatgtggaagatataaaatataaatcaacaaaatacagatctctttttttctaagacacttttattgcaagcttttttagaatgtttccttaaagcaagctacctcctagtttaaagtatgatcaatatattgcttatctttctaaaaaataaatgtttctaaattttcaaaattgccagcatttcaaaaaggggttatggattatgtgttattagaaaatgatacattttagaagtagtgatatagcaaaggaaatttcagcccacatatcttcccaagtgcttaatccaaagccattttaattatgatacagtgcaaagacatttattttggatggtgctctacaggttatccttaagaacattgttattttgcagcaaatgcatatgccatagcatttatatggtatggatccatatgtcagaaataatttcataactttttatgtaaaaatcaagttgttctttttgggaaggctgatacttagcagcattgattgtacagacattttacaataaaccttttgcattatagattttacaacagtgtttgctgttttctaagcagtattgtaaagatgtaggcctttttagcactgggataccatcatttctggatcagacctttatggtttctgaggggaagacagaacatgagtggttgttgggaggttgtaatggcaagtggcacacatcacttctatttcattgaaaacaactctgccacgtggtgtcaaactaactactggggtgagaaagctgccttccctgtgtcccataagagagattatgaatggtgggaaatgtcagtctgtatcccaaagactgaaaaacccacacacatcttaaagagtgttcttctcccttttgtaaagtttctccaaagcaggcattgctgagtccaaatcttgtattccatttgtcttataaatcaaagaatacccttggaagccaatatattaaccaatgctaaaaaagatagatctgtctatccatcaacctgtttctcctagataatttatttccagcctattctccctttcacctagctttttttttttttttttttttttttgagagggagttttgttcctgtcacccaggctggagtgcaatggtgcgatctcagctcactgtaactcccaccttccgggttcaagcgattctcctgcctcagtctcccaagtagctgggattacaggcatccaccaccacacccagcaaattttgtatttttggtaggtagggacagggtttcaccatgagggccaggctagtcttgaacttctgacctgaggctctctgcccacctccacctcccaaagtgccaggattataggcatgagccaccatgcccggcccctttcccctagttcttaatgtcctgttcagagaaggggctctttctcagctctgccacatactagctttggcctttgagcaaataaatttacatattaattaatctattcactcaaatacttattaagtatataacatataatagacaatgggagccaaacagacaaaatcccctgcctttttatattttagttggggaagatagataaagaccaacctaagtacatacatgaacatataagtaagatggtgataaatgttatggggaaaaaacaaagggaagggagttgagaagtataggtgtagggaggaagtatttttaagtagagtgactggggaagtcctcaccaggaagtcagcatttcagaaaagactggaataacataagcaaaaaagtaatgctgatatctgaggaaaggttattccaggaaatgagaatggcaagtgaagcttgagacttatttgataaaaaggaaagggaacgatatgactggagcagagagagaaacaagatagagtacgaagtcaggcaagcaaacaagggctagtgtttgtgagacctttaagctaccataatgacattggctcttactttgaatggtaaaccactggacggggtgtgtatatgtgtgcatgcatgtgtgtgtgtgtaaggcagggaagtgacatgatcttatttgtatattttttaaaaagtcattctattctagctgctgtgttgagatgtactaaatgaggcaaggtggagattgtggaagctacctagggaatagatgacggtggttcataccaaaggagaatcaatggcagtgttaacaaaggttggattttggaggtagagctaacgggagttgttatgaaattaacataggccataaagaaagcaaaccacattactctgaaattttggctaacttgtagaatgtaactgtgaccaactgagagaagaaacactgcagaggaagcattttttttttttttttttttttttttttttttgagacggagtctcgctctatccgccaggctggagtacagtggggcgatctcggctcactgcaagatccgcctcccgggttcacgccattctcctgcctcagcctcccgagtagctgggactaaaggcgcccgccaccacactcgggtaattgtttttgtatttttagtagagacggggtttcactgtgttagccaggatggtctcgatctcttgacctcgtgatccgcccgccttggcctcccaaagtgctgcgatttacaggcgtgagccactgcgcccggccgcatattttatataggatgatctagagctgagttctcatacatgaaatttgagaagctttctgaacacctaagtggaactgtccagtgtagctctggttacatgagtctggagttcatgggaggaaagatccaagctggagatttttaattactttgtgccttcattttcttgtctaaaaacagaaggtaataatggcacctatctcattggactgttgtgtgcctgaaaagagctaatcctcggtaggccagtaagagactttatagtgaattgatttagtggaaatgaatcaacatagaaatgaataataaatttaatttaagtaaatgtatttgattacatacttttatttttcaaaaaaccattcttaatcccatgtctttttccaattagtttatttcagtgtgcatgtaatgtcctttcttaaaatatacaaactccaaggatattacttatgaagctatataattttaggttaaattaaataataatcagaattttagctgcataagcagatgccgttttggccattttaaaaattaagctgctctgatgcagaataaaaatcaatgacaagataagttattttggaagaaaatacaataatttctcctcactggcagtctaagttcaatcaatcaaatgaaataattaatttgcatttataataacatatagtgaaggaagtcagtactatcgaatataaaggaaacaccaaactcattggattatccaacaaacagatatctcaatattggattagctcttcattttggaaaaatattccaaatgcaactttatcctccgaaacagagaccctgttcccttcagttattagcaattcataatttaacatgaggacatacgtaagaactggcaatgctgctccaacttaggaactcagaggagatgctccagagaccaacattatcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataatataattaccaatattctaaggatgaacaaagaagtttacaatagcatgcaagaaaaatgagaagaaaatgatacaaattgatgttcagaagatttcaaaatcttcagcaaagtaatttcagaactaatacatacttaaaagagaaagaaagaactgtgatttcacagtcgaaggcatacaaaatataaaggtattatgatctgaagagttaataaaagagagatgaaaagggagttgatattggaaccttaaattttttcctatctgatatttactttaaagagcttttctgaaaaattatctcttctactctatctcaaatttctgtgaggcattgtcttctctagcaccataaaacacattcagtctttactctgaacattggttattacttattaaaattaatacatcggaagattgtaatatattagttgtaactcattagctaactcatgaaacgaacagccagaattggttgtcaagcagaatattaattgcatttaataaatgttagtttaatgttgttaaatgtgccacatacatgggtaaaggcagtcatatgttgcatatgacacggcatacagttctaaatttcccgagggtgacattccctttggagattggcaggagagcttttgttcttggggccttttgttagtacagcttcaggaatttctagtgatcttattttgtgtcatggtatttctactttggggaaggagggttggacaatggatggaatataaacaatgaactgccctttacaccttgaatgatagcctcaatatgtaactgaaaacactttccacatttaactgttgaataaaactagtcaattttgtttcaatgatgctatggccaaaagacagcagagagagcaataatatgagctttggaaataaataattgacttttattttccccaaattttttttgtatgggtaatacctgtataagggcaaagattttcttcaacttgaactaaaacctgtatttttcattaaattttagtccattctaaacattattcaaaatttttagatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcaggtgtgttctgcacagtcccaagaaagtgtggactgttaccatttcttttcctaccaggtattctagaaatggcagttgtttaagggcatctgaaaaacatttgccttcaatcgtaatggaatttggaattccttaggagattttaccagtacatgccttaaggctgattccaacgggcattgctcctcagtcagcctctccacagggtctttgatcccaagagacttccaggcttcatctaaacggctcagtagaaaattttattttttggcctattaatgtttatattgagtactttaaagatcgctaaatttaatcttttctgtcagtttaatctctgccttcagcaagtttgttcattttggctgaaataaccagtcattcgaaaggagaactcacatcaaatatgtgaattcattaaaattacaaagttgcagaaaaatgcccaatcacagatcctcaaattagataaggttatactgggcttgcactttctccaactgttaatcagttgattgatttagttggttgttaatctgtctatgggaaatgctcttttttataaatcaagcttcctggaaatgtcacagaaataaatttcattgtttgtagttagatttttttggggggagaggtgtggcgcgggaggtggggagcctgctttataaacgcattttctgagacatctcatgtcaggattcattgagtactgaaacacacacatacacatacacacaatctttgaaaaaatgtcttttcacttattcatttggacttaatgtgttgtagataggcctctccatgcatttcccataactacattttgtcacaacttggtgctcaagtttttggaaaatgtcatttgtgcaagggccagtagatgacaattttaatatctaggtttagtgaaacatttagaaaggttacaccattcaggctgtgagagaaaaatcatgtggttcttgtcattgaagactatgtaaggggagaaatagtaaattcagtgagcattaatcacaaaataatagcccatacatagaaagaacgtgaaagacagaggggatggggtgtggagagggagcaatgagaatagagagggaaagaaaaaacaatttttgaactattgagtgattatttgtaacatatgtcatgagttatttgtagagagacaatctgtaaaaaaaaaaaattagcatattatttatttaaatgtgtgagtttctcttttacttttaaggaaatacatagccctttaaataatgtatttctgtctcaaaaagcaacataaattttaaaagcttatttaactaatatatagttctttatctaaatcaattgagaaaatgttgccataatttaagctgaaacaaaaaacatgtttctttaatcttaatgggaaaattaaattggagcctcattgaactttagaaattattctcagatatgcttttgttaaactgtagttcattgtatgcagctctcttttataatgaatttaaattttgcaaataatatataacattgtgtacttatcccaagatctcttttaatttaattctgctttggttcctattgtaggaaatgttgcttgcacatagaaatttctttaatatccggtcctgattaaacttcataattttaattttattaaagaatgaaatggtaaagtaggccattcacagtgttatattcaagagttaagtttagtttgcctccatgtttctgttcaatttagcctttgggttttttttctttttcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatgtaagtgcttaggtcatttaaaaggctatcgtgattcagaaagaatcttgggttaataacattgccacattaaacaaatttcagattaatagaaaacttgctctgttacaaaaacaatcaattgcaattttcaacaagtttggtcataacttaggccattgctatatttattgaagtccatttttataaatgtttctgctatttcacgttggatttatgctataaaaattgttttaagttaggcaagtagtcttaacacttatacatgaaattaaatatagagtgtttatcattttctttgcctttttaactgaacacaataaagaaatggagacactggccttttggtagttttaaagaaactcctaaggaatgcttcattttcaagttactctatatttattttttaaatttgggtagtcacccttgaagagttgatctttgattgttaattaaattgtaatgttttgactacaataacattttataaataaatttccatttatgaatgaaaactggcataggtagttagtacaattaattttctaaatgtaaaatactaggtaatagggaaaattaagaatgtcacagcaaaaaatgttgaactccttgtgttaatttcctcaggaaagttaccaatacagctttgcattatcagaaacatatttgctgaatatttttaactgcctcatcagaaaaatagcattaccattatcttcacatcacagattgtttggaagattctgtgagatgatgaaaagagaaataatttcaaaattataaatttctttattgatctcagttgtcattgttgttgactattgctaatctattattaagattcatttataattttaatttgattcataactacttgaatttttctttaacttttttttgaagtaatgacagactcacaggagtaccaaaatagttctactgggtgtttacatttccaaattctatagtgttttctttccttttactctttgatcatctccttcaagtaaaattacttaaattcacaaactcatctatctgaagaccttattttcattgattatctgttggctttgctttttgttatgctggtcagaaaagcagaatgcttaatttatattttatttctacttttttctctttctttagagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaa
